United States Patent 11,596,699 (RNA ENCODING AN ANTIBODY) - sequence listing, part 7

SEQ ID NO: 38162 - RNA, 330 nt, Artificial Sequence
  derived and/or modified sequence opt4 from IgG1_HeavyChain_CH2_constant_domain
gcccccgagcugcugggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38163 - RNA, 330 nt, Artificial Sequence
  derived and/or modified sequence opt4 from IgG1_HeavyChain_CH2_constant_domain
gcccccgagcugcugggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38164 - RNA, 330 nt, Artificial Sequence
  derived and/or modified sequence opt4 from IgG1_HeavyChain_CH2_constant_domain
gcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38165 - RNA, 330 nt, Artificial Sequence
  derived and/or modified sequence opt4 from IgG1_HeavyChain_CH2_constant_domain
gcccccgagcugcugggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38166 - RNA, 330 nt, Artificial Sequence
  derived and/or modified sequence opt4 from IgG1_HeavyChain_CH2_constant_domain
gcccccgagcugcugggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38167 - RNA, 330 nt, Artificial Sequence
  derived and/or modified sequence opt4 from IgG1_HeavyChain_CH2_constant_domain
gcccccgagcugcugggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38168 - RNA, 330 nt, Artificial Sequence
  derived and/or modified sequence opt4 from IgG1_HeavyChain_CH2_constant_domain
gcccccgagcugcugggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38169 - RNA, 330 nt, Artificial Sequence
  derived and/or modified sequence opt4 from IgG1_HeavyChain_CH2_constant_domain
gcccccgagcuggccggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38170 - RNA, 330 nt, Artificial Sequence
  derived and/or modified sequence opt4 from IgG1_HeavyChain_CH2_constant_domain
gcccccgagcuggccggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38171 - RNA, 330 nt, Artificial Sequence
  derived and/or modified sequence opt4 from IgG1_HeavyChain_CH2_constant_domain
gcccccgagcuggccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38172 - RNA, 330 nt, Artificial Sequence
  derived and/or modified sequence opt4 from IgG1_HeavyChain_CH2_constant_domain
gcccccgagcuggccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38173 - RNA, 330 nt, Artificial Sequence
  derived and/or modified sequence opt4 from IgG1_HeavyChain_CH2_constant_domain
gcccccgagcuggccggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38174 - RNA, 330 nt, Artificial Sequence
  derived and/or modified sequence opt4 from IgG1_HeavyChain_CH2_constant_domain
gcccccgagcuggccggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38175 - RNA, 330 nt, Artificial Sequence
  derived and/or modified sequence opt4 from IgG1_HeavyChain_CH2_constant_domain
gcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38176 - RNA, 330 nt, Artificial Sequence
  derived and/or modified sequence opt4 from IgG1_HeavyChain_CH2_constant_domain
gcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38177 - RNA, 330 nt, Artificial Sequence
  derived and/or modified sequence opt4 from IgG1_HeavyChain_CH2_constant_domain
gcccccgaggcccugggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38178 - RNA, 330 nt, Artificial Sequence
  derived and/or modified sequence opt4 from IgG1_HeavyChain_CH2_constant_domain
gcccccgaggcccugggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38179 - RNA, 330 nt, Artificial Sequence
  derived and/or modified sequence opt4 from IgG1_HeavyChain_CH2_constant_domain
gcccccgaggcccugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38180 - RNA, 330 nt, Artificial Sequence
  derived and/or modified sequence opt4 from IgG1_HeavyChain_CH2_constant_domain
gcccccgaggcccugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38181 - RNA, 330 nt, Artificial Sequence
  derived and/or modified sequence opt4 from IgG1_HeavyChain_CH2_constant_domain
gcccccgaggcccugggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38182 - RNA, 330 nt, Artificial Sequence
  derived and/or modified sequence opt4 from IgG1_HeavyChain_CH2_constant_domain
gcccccgaggcccugggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38183 - RNA, 330 nt, Artificial Sequence
  derived and/or modified sequence opt4 from IgG1_HeavyChain_CH2_constant_domain
gcccccgaggcccugggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38184 - RNA, 330 nt, Artificial Sequence
  derived and/or modified sequence opt4 from IgG1_HeavyChain_CH2_constant_domain
gcccccgaggcccugggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38185 - RNA, 330 nt, Artificial Sequence
  derived and/or modified sequence opt4 from IgG1_HeavyChain_CH2_constant_domain
gcccccgaggccgccggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38186 - RNA, 330 nt, Artificial Sequence
  derived and/or modified sequence opt4 from IgG1_HeavyChain_CH2_constant_domain
gcccccgaggccgccggcggccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38187 - RNA, 330 nt, Artificial Sequence
  derived and/or modified sequence opt4 from IgG1_HeavyChain_CH2_constant_domain
gcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38188 - RNA, 330 nt, Artificial Sequence
  derived and/or modified sequence opt4 from IgG1_HeavyChain_CH2_constant_domain
gcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38189 - RNA, 330 nt, Artificial Sequence
  derived and/or modified sequence opt4 from IgG1_HeavyChain_CH2_constant_domain
gcccccgaggccgccggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38190 - RNA, 330 nt, Artificial Sequence
  derived and/or modified sequence opt4 from IgG1_HeavyChain_CH2_constant_domain
gcccccgaggccgccggcgcccccagcguguuccuguucccccccaagcccaaggacacccugaugaucagcagaacccccgaggugaccugcguggugguggacgugagccacgaggaccccgaggugaaguucaacguguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38191 - RNA, 330 nt, Artificial Sequence
  derived and/or modified sequence opt4 from IgG1_HeavyChain_CH2_constant_domain
gcccccgaggccgccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38192 - RNA, 330 nt, Artificial Sequence
  derived and/or modified sequence opt4 from IgG1_HeavyChain_CH2_constant_domain
gcccccgaggccgccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaag

SEQ ID NO: 38193 - RNA, 318 nt, Artificial Sequence
  derived and/or modified sequence opt4 from IgG1_HeavyChain_CH3_constant_domain
ggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 38194 - RNA, 318 nt, Artificial Sequence
  derived and/or modified sequence opt4 from IgG1_HeavyChain_CH3_constant_domain
ggccagcccagagagccccagguguacacccugccccccagcagagaggagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 38195 - RNA, 318 nt, Artificial Sequence
  derived and/or modified sequence opt4 from IgG1_HeavyChain_CH3_constant_domain
ggccagcccagagagccccagguguacacccugccccccagcagagacgagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 38196 - RNA, 318 nt, Artificial Sequence
  derived and/or modified sequence opt4 from IgG1_HeavyChain_CH3_constant_domain
ggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 38197 - RNA, 297 nt, Artificial Sequence
  derived and/or modified sequence opt4 from IgG2_HeavyChain_CH1_constant_domain
agcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccgug

SEQ ID NO: 38198 - RNA, 297 nt, Artificial Sequence
  derived and/or modified sequence opt4 from IgG2_HeavyChain_CH1_constant_domain
agcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugaccagcagcaacuucggcacccagaccuacaccugcaacguggaccacaagcccagcaacaccaagguggacaagaccgug

SEQ ID NO: 38199 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaag

SEQ ID NO: 38200 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgccagcaucgagaagaccaucagcaagaccaag

SEQ ID NO: 38201 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagccccaucgagaagaccaucagcaagaccaag

SEQ ID NO: 38202 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaag

SEQ ID NO: 38203 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaag

SEQ ID NO: 38204 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgccagcaucgagaagaccaucagcaagaccaag

SEQ ID NO: 38205 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagccccaucgagaagaccaucagcaagaccaag

SEQ ID NO: 38206 - RNA, 327 nt, Artificial Sequence
  derived and/or modified sequence opt4 from IgG2_HeavyChain_CH2_constant_domain
gccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaag

SEQ ID NO: 38207 - RNA, 318 nt, Artificial Sequence
  derived and/or modified sequence opt4 from IgG2_HeavyChain_CH3_constant_domain
ggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 38208 - RNA, 297 nt, Artificial Sequence
  derived and/or modified sequence opt4 from IgG4_HeavyChain_CH1_constant_domain
agcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagagug

SEQ ID NO: 38209 - RNA, 330 nt, Artificial Sequence
  derived and/or modified sequence opt4 from IgG4_HeavyChain_CH2_constant_domain
gcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaag

SEQ ID NO: 38210 - RNA, 318 nt, Artificial Sequence
  derived and/or modified sequence opt4 from IgG4_HeavyChain_CH3_constant_domain
ggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 38211 - RNA, 1347 nt, Artificial Sequence
  derived and/or modified sequence opt5 from AAB-003_gamma1-Chain
gaggugcagcugcucgaaagcggcgggggacugguccaacccggcgggucccuuagacugucuugcgccgcuagcggauucaccuuuuccaacuacggcaugucuuggguucggcaggccccugggaagggacucgaguggguggcgagcauccgcuccggcggcgggagaacauauuacucugacaaugugaaaggacgguucacgauuagccgcgauaacuccaagaauacccuguaucuucagaugaacagccugagagcugaagacacagccgucuacuauugugugcgguacgaucacuauucuggcuccagcgacuacugggggcagggaacccucguuacagugucuuccgccagcaccaaaggcccgucugucuuuccccuggcuccuuccagcaaguccacaucugggggaaccgccgcucugggcugccucgugaaagauuacuuccccgagccuguuacggugagcuggaacuccggcgcccugaccagcgggguccauacauuucccgcggugcuucaaucuuccggacuguauagccucucuagcguggucaccguuccuuccucuagccugggcacacagaccuacaucuguaaugugaaucacaagccguccaacacgaagguggacaaaaaggucgaacccaaaagcugcgauaagacacauaccuguccucccugcccugcccccgaggcugccggggcuccgucuguguuccuuuuuccucccaaaccuaaggacacacugaugauuucccgcacccccgagguuaccuguguggucguggauguuagccacgaagaccccgaggugaaguucaauugguaugucgauggaguggaaguccauaacgccaaaacaaagccuagagaggagcaguacaauucuacguaucgggugguuuccgugcucaccguccugcaccaggacuggcugaacggcaaagaauacaagugcaaagugagcaauaaggcgcucccggcccccaucgagaaaacaauuuccaaggcuaaggggcaaccucgcgaaccccagguuuauacccugccucccucuagagaggaaaugacaaagaaccaggugagccuuaccugucuggucaagggauuuuacccguccgauaucgccguggagugggagucuaauggccagccugaaaacaacuacaaaacgacacccccugugcucgacagcgacggcuccuucuuucuguauagcaaacuuaccguugauaaaucucgguggcaacaggggaaugucuucuccugcagcgugaugcacgaggcucugcauaaccacuacacccagaagucucucucccugagccccggaaag

SEQ ID NO: 38212 - RNA, 1329 nt, Artificial Sequence
  derived and/or modified sequence opt5 from Abagovomab_HeavyChain
caggugaagcugcaggagagcggcgccgaacucgcuagacccggggccuccgucaaacugucuugcaaggcgagcggauacaccuucacaaacuauuggaugcaguggguuaaacagcggccuggccaggggcuugacuggaucggagcuauuuacccgggcgaugggaauacgcgcuauacccacaaguuuaaaggaaaggccacacugaccgccgacaaguccucuagcacagcuuacaugcaacucuccucucuggccagcgaggauuccggcguguauuacugugcuagaggcgaagggaacuaugccugguucgcguacuggggacagggcaccacagugaccgucagcucugccaaaacgacacccccuuccguguacccccuugcuccugggagcgccgcucagaccaauucuaugguuacccugggaugccucgugaagggcuauuuucccgagccugucacagugaccuggaacuccgggagccugucuuccggaguucauacguucccggccgugcugcagagcgaccucuacacacuguccucuagcgucaccgugcccuccagcacauggccuucugaaaccgugaccuguaaugucgcgcaccccgccuccagcacaaaaguugauaagaaaaucgugccucgggacugcggcuguaagcccugcauuuguacggugccggaggucucuagcguguuuaucuucccucccaagccuaaagauguucuuaccauuacacugacccccaaggugacaugcgucgugguugacaucuccaaagaugaccccgaggugcaauuuucuugguucgucgaugacguggaaguccauaccgcucagacgcagccucgcgaggaacaguuuaacagcacauucagauccgugagcgagcucccgaucaugcaccaagauuggcugaauggcaaggaguuuaaaugucggguuaacucugccgcuuuccccgccccuauugaaaagaccaucuccaaaaccaaggggcgccccaaggccccucagguguauacaauucccccgccuaaagagcagauggcuaaggacaaagucagccuuaccugcaugaucacagacuuuuuccccgaagauauuacgguggaguggcaauggaauggacagccugcggaaaacuacaagaauacccagcccaucauggacacagauggcucuuauuucguuuacuccaaacugaacgugcaaaagagcaauugggaggccgggaacaccuuuacauguuccguccuccaugagggacugcacaaucaccauaccgaaaagucucugagccacuccccuggcaaa

SEQ ID NO: 38213 - RNA, 642 nt, Artificial Sequence
  derived and/or modified sequence opt5 from Abagovomab_LightChain
gacaucgagcugacccagagccccgccucccucucugcuagcgugggcgaaacagucacgauuaccugccaagccuccgagaacaucuacucuuaucuggcguggcaccagcagaagcaggggaaaagcccucaacuucugguuuacaaugcuaagacacucgccggaggcguguccucuagauucagcggguccggaagcggcacccauuuuucucugaaaauuaagucccuucagccggaagauuucgggaucuauuacugucagcaccauuauggcauucugcccacauuuggaggcgggaccaaacucgagaucaagcgggccgacgcugccccuacagugagcaucuuucccccuucuuccgaacagcugaccagcggaggcgcuucugucgugugcuuccugaacaauuucuaccccaaggauauuaacguuaaauggaagaucgacggguccgagcgccaaaauggagugcucaacagcuggacggaucaggacuccaaagauucuaccuauagcauguccagcacacugacccuuacaaaggacgaguacgaaagacacaauucuuacaccugugaggccacgcauaaaacauccaccagcccuauugucaagucuuuuaaccggaaugaaugc

SEQ ID NO: 38214 - RNA, 1350 nt, Artificial Sequence
  derived and/or modified sequence opt5 from Abciximab_HeavyChain
gaggugcagcugcaacagagcggcgccgaacucgucaagcccggggcuuccguuaaacugucuugcaccgccagcggauucaacaucaaggacacauacgugcacugggugaaacagagaccugagcagggccuugaauggauugggcggaucgauccggcgaauggauauacgaaguacgaccccaaauuucaaggcaaggcuaccauuacagccgauaccuccucuaacacagccuaucugcagcucagcucccugaccucugaggacacagcugucuacuauugugugcgcccucuuuacgauuauuacgccauggacuacugggggcagggaaccagcguuacgguguccagcgcuaagaccacagcccccucugucuauccucuggcgcccgugugcggcgauaccacaggcuccagcguuacccucgggugucuggugaaaggauacuucccugaaccggucacgcugacauggaacucuggcucccucagcucuggggugcauaccuuucccgccgugcugcaguccgaccuuuauacacugagcuccucugucaccguuaccagcuccacauggccuagccaaucuaucacgugcaauguggcucaccccgccuccagcaccaagguggauaaaaagauugagccuagacccaaaucuugugacaagacacauaccugcccgccuugucccgcuccugagcuccugggaggccccagcgucuuccuuuuucccccuaagccgaaagauacacugaugaucucccggacccccgaagugacgugcguuguggucgacgugucucacgaggauccugaaguuaaguucaauugguacguggacggggucgaggugcauaacgccaaaacaaagccccgcgaggaacaguauaauagcaccuacagagucguguccguucucaccgugcugcaccaggacuggcugaacggaaaagaguauaaguguaaagucagcaauaaggcgcucccugcccccaucgaaaagacaauuucuaaagcuaagggccagccgcgggagccucaaguguacacccugcccccuucccgcgaugaacuuacgaaaaaccagguuagccugacaugccucgugaagggcuuuuaccccucugacaucgccgucgagugggaguccaaugggcagccugaaaacaauuauaaaaccacacccccggugcuggauagcgacggauccuucuuucuuuacucuaagcugaccguggauaagagcagauggcaacagggcaacguuuucuccuguucugucaugcacgaggcucuccauaaucacuauacacagaaaagccugucccugagcccugggaag

SEQ ID NO: 38215 - RNA, 642 nt, Artificial Sequence
  derived and/or modified sequence opt5 from Abciximab_LightChain
gacauccugaugacccagagccccagcucuaugagcgugucccucggcgauacagucucuauuacgugccacgccagccaagggaucuccucuaacauuggauggcugcagcagaagccuggcaagagcuucauggggcuuaucuacuauggaaccaaucugguugacggcgugccguccagauuuagcgggucuggauccggcgcugauuacagccucacaauuucuucccuggacagcgaggauuucgccgacuauuacugugugcaguaugcgcaacuucccuacaccuuuggcgggggaacaaaacuggaaaucaaacgggcugaugccgccccuaccgucucuaucuuucccccuuccagcgagcagcucacauccggcggggcuucugugguuugcuuccugaacaauuucuaucccaaggacauuaacgugaaauggaagaucgauggaagcgaacgccagaauggcguccugaacuccuggaccgaccaggauagcaaggacucuacguacuccaugagcucuacccucacacugaccaaagaugaguacgaaagacauaauagcuauacaugugaggccacccacaagacguccacaucuccuauugugaaauccuuuaaccggaaugagugc

SEQ ID NO: 38216 - RNA, 1341 nt, Artificial Sequence
  derived and/or modified sequence opt5 from Abituzumab_HeavyChain1
caggugcaacugcagcagagcggcggggagcucgccaagcccggagcuuccgucaaaguuucuugcaaggccagcggcuacaccuucuccucuuuuuggaugcacugggugagacaggcgccugggcaaggacuggaauggaucggcuauauuaacccgcggagcggguacacagaguauaaugaaaucuuccgcgacaaagcuacgaugaccacagauaccuccacaucuaccgccuacauggagcuuagcucccugagaagcgaagacacagccguguauuacugugcuucuuuucucggacggggcgccauggauuauuggggccaggggaccacggucaccguguccagcgcuucuacaaagggacccuccguuuucccucuggcccccugcagccgcucuaccuccgagagcacagcggcccuuggcugucuggugaaagacuacuuuccugagcccgucaccguguccuggaacucuggggcucucacgagcggaguucauacauucccugccgugcugcaguccagcggccuguacucucucuccagcgucgugaccgugccgucuagcaauuuugggacacagaccuauaccugcaacgucgaucacaagcccuccaauacaaagguugacaaaacgguggaaccuaagucuagcgauaaaacccauacaugucccccuugccccgcuccgccuguggccggacccuccgucuuccuguuuccucccaagcccaaagacacccuuaugauuagcagaacaccugaggugaccuguguuguggucgaugugucucacgaagacccggagguucaauucaacugguacguggauggcgucgaggugcauaaugcgaagacgaagccccgggaggaacaggcccaguccacauuucgcgucgugagcguucugaccgugguccaccaggacuggcucaacggcaaagaauauaagugcaaagugucuaauaaggggcugccugcucccaucgagaaaaccauuuccaagacaaaaggacaaccuagagaaccccagguuuacacccuuccgccuagccgggaggagaugacaaagaaccaggugucccugacgugucucgucaagggcuucuaucccucugauaucgccguggaaugggagagcaaugggcaaccugaaaacaauuacaaaaccacacccccuaugcuggacuccgacggaucuuucuuucuguauagcaagcucaccguggauaaaucccgcuggcagcagggcaacguuuucagcugcucugucaugcacgaggcucugcauaaucacuacacacagaagucccuuagccugucucccgggaaa

SEQ ID NO: 38217 - RNA, 642 nt, Artificial Sequence
  derived and/or modified sequence opt5 from Abituzumab_LightChain1
gacauccagaugacccaaagccccuccucucugagcgccuccgugggcgauagagucacaauuacgugccgggcuucucaggacaucagcaacuaccucgccugguaucagcagaagccugggaaagcgccgaagcugcuuauuuacuauaccuccaaaauccacucuggaguucccagccgcuucuccggcagcgggucuggaacagauuacaccuuuacaauuuccagccugcaaccugaggacaucgcuaccuauuacugucagcagggcaauacauuccccuauaccuuugggcagggaacgaagguggaaaucaaaagaaccguggccgccccuucugucuucauuuuucccccuuccgaugagcaacucaagagcggcacagcuucugugguuugccugcuuaacaauuucuacccgcgggaagccaaggugcaguggaaagucgacaacgcucugcaguccggcaauagccaggaguccgugaccgaacaagauucuaaggacagcacauacucccucagcucuacccugacgcuguccaaagccgauuaugagaagcauaaaguuuacgcgugugaggugacacaccaggggcucagcucucccgucaccaagagcuuuaaccgcggagaaugc

SEQ ID NO: 38218 - RNA, 1332 nt, Artificial Sequence
  derived and/or modified sequence opt5 from Abrilumab_HeavyChain1
caggugcaacugguccagagcggcgccgagguuaagaaacccggggcuuccgugaaggugucuugcaaagucagcggauacacccucuccgaccugucuauccacugggugagacaggccccuggcaaggggcuugaauggaugggaggcuucgauccgcaggacggggagacaauuuaugcgcaaaaauuucagggacggguuacgaugaccgaagauacaagcaccgacacagcuuacauggagcuguccucucucaagagcgaagauaccgccguguauuacugugccacaggcuccucuagcuccugguucgaccccuggggccaggggacccuggucacggugagcucugcuuccaccaagggaccuagcguuuuuccccuugccccuugcucucgcuccacaagcgaguccaccgcugcccugggcugucucgugaaagauuauuuccccgagccugucacagugucuuggaacagcggggcgcugaccuccggagugcauacguuuccggccguccugcagagcucuggccucuacucccugagcucuguugugacagugcccagcuccaauuucgggacccaaacauauaccugcaacgucgaccacaagccuucuaauaccaaaguggauaagacaguugaaagaaaauguugcguggagugucccccuugccccgcuccgccugucgccggacccagcguguuucuuuucccucccaagcccaaggacacgcugaugaucucccggaccccugaaguuacauguguggucguggaugucagccaugaggacccggaggugcaguuuaacugguacguugauggcguggaaguccacaaugcuaaaaccaagccccgcgaggaacaguucaacucuacauuuagagugguuuccgugcucaccgucgugcaucaggacuggcugaauggcaaagaguacaagugcaaagugagcaacaaggggcuuccugcccccauugagaaaacgaucucuaagacaaagggacaaccucgggaaccccagguuuauacccugccgccuucccgcgaggaaaugaccaaaaaucaggucagccucacaugucuggugaagggcuucuaccccuccgacauugcgguggagugggaaucuaacgggcaaccugagaauaacuauaaaaccacacccccuaugcuggauagcgacggauccuuuuuccucuacucuaagcugacggucgauaaaagcagauggcagcagggcaauguguucuccugcagcguuaugcacgaagcccuucacaaccauuauacccagaagucucugucccucagccccgggaag

SEQ ID NO: 38219 - RNA, 642 nt, Artificial Sequence
  derived and/or modified sequence opt5 from Abrilumab_LightChain1
gacauccagaugacccaaagccccuccucugugagcgccuccgucggcgauagaguuacaauuacgugccgggcuucucaggggaucagcuccuggcuggccugguaccagcagaagccuggaaaagcgccgaagcuccugauuuauggcgcuucuaaccuugagagcggggugcccucccgcuucagcggaucuggcuccgggaccgacuuuacacugaccaucagcucucuccaaccugaagauuucgccaauuacuauugucagcaggccaacuccuuucccuggacauucggacagggcaccaaaguggagauuaagagaacagucgcugccccuagcguguuuaucuuucccccuucugacgaacaacugaaauccggcaccgcuagcguugugugccuucugaauaacuucuacccgcgggaggccaagguccaguggaagguggauaaugcgcuccaguccgggaacucucaggaaagcguuacggagcaagacuccaaagauagcaccuauucucuguccagcacacugacccucucuaaggccgacuacgagaaacacaagguguaugcuugugaagucacacaucagggacugagcucccccgugaccaaaucuuucaaucgcggcgagugc

SEQ ID NO: 38220 - RNA, 639 nt, Artificial Sequence
  derived and/or modified sequence opt5 from Abrilumab_LightChain1_variant2
cagaucgugcugacccaaagccccgccauuauguccgcuucuccuggcgagaaggucacaaucacgugcagcgccuccucuagcguuuccuacaugaacugguuccagcagaaaccggggaccucucccaagcucuggauuuauagcacauccaaucuggcgagcggagugccugcuagauuuucuggcuccgggagcggaaccucuuacucccuuacaaucagccggauggaagccgaggacgccgcuaccuauuacugucagcaaagaucuuccuaucccaacacauucggcgggggaaccaaacuggaaauuaagcgcgccgaugcugccccuacggugagcaucuuucccccuuccucugagcagcucaccagcggcggcgcguccgucgugugcuuccugaauaacuuuuacccgaaagacaucaauguuaaguggaagauugaugggagcgaacggcagaacggagugcuuaauucuuggacagaccaggauuccaaagacagcaccuauucuaugagcuccacacugacccucacgaaggaugaguacgagcgccacaacucuuacacaugugaagccacccauaaaacaagcaccucccccaucgucaagagcuucaauagaaacgagugc

SEQ ID NO: 38221 - RNA, 1347 nt, Artificial Sequence
  derived and/or modified sequence opt5 from Actoxumab_HeavyChain1
gaggugcagcugguccaaagcggcgccgaaguuaagaaauccggggagucucucaagaucagcugcaaaggauccggcuacucuuucaccagcuauuggauugggugggugagacagaugcccggaaagggccuggaauggauggggaucuuuuacccuggagacuccucuacacgguauagcccguccuuccagggccaggugacgauuagcgcugauaaaucugucaacaccgccuaccuucaaugguccagccugaaggcgucugacacagcuauguauuacugugcccgcagacggaauuggggcaacgccuuugauaucugggggcagggaaccauggugacaguuuccagcgcuucuaccaagggccccuccguguucccucucgcccccagcuccaaaucuacaagcgggggaaccgcugcccugggcugccuugucaaggacuauuuuccugagcccgugacgguuuccuggaauagcggggcgcugaccucuggagugcacacauucccugccguccuccaguccagcggccuguacucucugagcuccguggugaccgucccgucuagcucccucggcacacagaccuacauuuguaacguuaaucauaaacccagcaacacgaagguggauaaacgcguggaaccuaagucuugcgacaagacacacaccugucccccuugccccgcuccggagcugcuugggggaccuuccgucuuucuguuucccccuaaacccaaggauacacucaugaucagcagaacccccgaggugaccuguguuguggucgacgugucucaugaagauccugagguuaaauucaauugguauguggacggcgucgaagugcacaacgccaagacaaaaccgcgggaggagcaauacaauuccacguaucgcgucgugagcguucugaccgugcuucaucaggauuggcugaacgggaaggaauacaaaugcaaggucuccaauaaggcucuccccgccccuaucgagaaaacaauuucuaaggcgaaaggacagcccagagaaccucagguguauacccugcccccgagccgggaggaaaugacaaagaaccaaguuucccugaccugucucgugaaaggcuucuacccuucugacaucgccgucgagugggagagcaaugggcagcccgaaaacaauuauaagacgacaccucccgugcuggauuccgacggcagcuuuuuccuuuacucuaagcugaccguggacaaaucccgcuggcagcaaggaaacguuuuuagcugcucugucaugcacgaggcucuccacaaccauuacacccagaagucccugagccuuucuccuggcaaa

SEQ ID NO: 38222 - RNA, 645 nt, Artificial Sequence
  derived and/or modified sequence opt5 from Actoxumab_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccaccuggacauuuggccagggcaccaaaguggagaucaagagaacgguggcugccccuagcgucuucauuuuucccccuucugaugaacagcucaaauccgggaccgcuagcgugguuugccugcugaacaauuucuacccgcgggaggccaaggugcaauggaaagucgacaacgcgcuccaguccggaaauucucaggagagcgugacagaacaggauuccaaggacagcaccuauucucuguccagcacacuuacccugucuaaggccgauuacgagaaacacaagguuuacgcuugugaagugacgcaucaaggccucagcucccccgucacaaaaucuuuuaaccgcggggagugc

SEQ ID NO: 38223 - RNA, 672 nt, Artificial Sequence
  derived and/or modified sequence opt5 from Adalimumab_HeavyChain
gaggugcagcuggucgaaagcggcgggggacucguucaacccggcagaucccugcggcuuucuugcgccgcuagcggguucaccuuugacgauuacgccaugcacugggugcgccaggcgccuggaaagggccuggaguggguguccgcuaucacauggaacucugggcauauugacuaugccgauagcgucgaaggaagauucacgaucucccgggacaaugccaaaaacucucucuaccugcagaugaauagccuucgcgcugaggauaccgccguguauuacugugcuaagguuuccuaucugagcacagccucuucccucgacuacuggggccagggcacccuggugacagucagcucugcguccaccaaagggccgagcguguuuccccuggccccuucuuccaagagcacauccggaggcaccgcugcccucgggugccugguuaaagauuauuuccccgaaccugugacggucucuuggaacagcggagcucuuaccuccggcgugcacacauuucccgccgugcugcaaagcucugggcucuacucccugagcucugucguuaccgugccuagcuccucucuuggaacacagaccuacauuuguaaugugaaccauaagccgagcaauacgaaggucgacaaaaagguggagcccaaauccugc

SEQ ID NO: 38224 - RNA, 642 nt, Artificial Sequence
  derived and/or modified sequence opt5 from Adalimumab_LightChain
gacauccagaugacccaaagccccuccucucugagcgccuccgugggcgauagagucacaauuacgugccgggcuucucaggggauccgcaacuaccucgccugguaucagcagaagccuggaaaagcgccgaagcugcuuauuuacgcugccagcacccugcaauccggcguucccucuagauucagcggguccggaagcggcacagacuuuacccucacaaucucuucccugcagccugaggauguggccaccuauuacugucagcgguauaaucgcgcucccuacacauucgggcagggaaccaaaguggaaauuaagagaacggucgccgcuccuagcguguuuaucuuucccccuucugacgagcaacuuaaauccggcaccgccagcguugugugccugcucaacaauuucuauccgcgggaagcgaagguccaguggaagguggauaacgcccugcagucuggcaauucccaggagagcguuacagaacaagacuccaaagauucuaccuacagccuguccagcacacucacccugucuaaggcugacuacgagaaacacaagguguaugccugugaggucacgcaucaggggcuuuccagccccgugacaaaaucuuucaaccgcggagaaugc

SEQ ID NO: 38225 - RNA, 1359 nt, Artificial Sequence
  derived and/or modified sequence opt5 from Aducanumab_HeavyChain1
caggugcaacuggucgagagcggcgggggaguugugcagcccggcagaucccuccggcugucuugcgccgcuagcggguucgccuuuuccucuuacggaaugcacugggugcgccaggcgccuggcaaggggcuugaaugggucgcugugaucugguucgacggaaccaaaaaguauuacacagauagcguuaaaggcagauuuacgauuucccgggacaacucuaagaauacccuguaucuccagaugaacacacugcgcgccgaggauaccgccguguacuauugugcuagagaccggggcaucggggcccgcagaggaccguacuauauggaugucuggggcaaagggacaaccgugacaguuagcuccgcuagcaccaagggacccucuguguucccucuugcccccuccagcaagucuacguccggcgggaccgcggcccugggaugccucgucaaagacuacuuuccugaacccgugacagugagcuggaauagcggcgcucugaccuccggcguccauacauucccugccguucugcaaagcuccgggcucuacucucugagcuccguggugaccgucccgucuucuucccuuggaacgcagacauauauuuguaacgugaaucacaagcccagcaacaccaaaguugauaagcggguggagccuaaaucuugcgacaagacacauaccugucccccuugccccgcuccggaacugcucggcgggccuagcgucuuucuguuucccccuaagcccaaagauacccuuaugaucucccgcacacccgaggugacguguguuguggucgacgugucucacgaggauccugaagucaaguucaauugguacguggacggaguugaggugcauaacgccaaaaccaagccgagagaggaacaguauaauagcacauaccgggucguguccguucugaccgugcuccaccaggauuggcugaacggcaaagaguauaagugcaaagucagcaauaaggcgcugcccgccccuauugaaaagacaaucucuaaagcuaaggggcaaccccgcgagccucagguguacacccuucccccguccagagaagagaugacgaaaaaccaggugagccugacaugucuuguuaagggauucuauccuucugacaucgccgucgaaugggaguccaauggccagcccgagaacaauuacaaaaccaccccucccgugcuggacagcgauggcuccuuuuuccucuacucuaagcugacaguggacaagagccgguggcaacaggggaacgucuuuuccugcucugugaugcacgaagcucuccauaaccacuauacccagaaaagccugucccucagcccugga

SEQ ID NO: 38226 - RNA, 642 nt, Artificial Sequence
  derived and/or modified sequence opt5 from Aducanumab_LightChain1
gacauccagaugacccaaagccccuccucucugagcgccuccgugggcgauagagucacaauuacgugccgggcuucucagagcaucuccucuuaccucaacugguaucagcagaaaccugggaaagccccgaagcugcuuauuuacgcggcuagcucccugcaaagcggaguucccucucgcuucuccggcagcgggucuggaaccgacuuuacacucaccaucuccagccugcagccugaggauuucgccacauauuacugucagcagucuuauuccacaccccuuaccuuuggcgggggaaccaaaguggaaauuaagagaacgguggccgcuccuagcgucuucaucuuucccccuuccgacgagcaacugaaaucuggcaccgccagcgugguuugccuccugaauaacuucuacccgcgggaagcuaaggugcaguggaaggucgauaaugcccugcaguccggcaacagccaggagucugugacagaacaagacuccaaagauagcaccuauucucucagcuccacacugacccuuucuaaggcggacuacgagaaacacaagguuuacgccugugaggugacgcaucaggggcugagcucccccgucacaaagagcuuuaaucgcggagaaugc

SEQ ID NO: 38227 - RNA, 1359 nt, Artificial Sequence
  derived and/or modified sequence opt5 from Afasevikumab_HeavyChain1
gaggugcagcuggucgaaagcggcgggggacucguucaacccggcagaucccugcggcuuucuugcgccgcuagcggguucaccuuugacgauuacgccaugcacugggugcgccaggcgccuggaaagggccuggaguggguguccgggaucaacuggucuagcggaggcauuggcuaugcugacuccgucaaagggagauucacaaucucucgggauaaugccaagaacagccucuaccugcagaugaacucccuucgcgccgaagacacggcucuguauuacugugccagagauauuggaggcuuuggggaguucuauuggaauuuuggacucuggggccgggggacccuggugacaguuagcucugcuuccaccaaaggaccgagcguguucccccuggccccuucuuccaagagcacaucuggcggcaccgcggcccucgggugccuggucaaagacuacuuucccgaaccugugacaguuuccuggaauagcggagcucuuaccuccggcgugcauacguuccccgccguccugcagucuagcgggcucuauucccugagcucuguggugaccgucccuuccagcucucuuggaacacaaaccuacaucuguaacguuaaucacaagccgagcaacacaaagguggauaaacgcguggagcccaaguccugcgacaaaacccauacguguccucccugcccugcucccgagcugcucggcgggccgucugucuuucuguucccucccaagccuaaagauacacugaugauuagcagaacccccgaagugacauguguuguggucgacgugucccacgaggaucccgaaguuaaguuuaauugguacguggacggagucgaggugcauaacgccaagaccaaaccucgggaggaacaguauaauagcaccuaccgcgucgugucuguucucacagugcugcaccaggauuggcuuaacggcaaggaguauaaaugcaaggucuccaauaaagcgcugccggcccccaucgaaaagacgaucagcaaagcuaagggccagccuagagagccccaaguguacacccucccucccucucgggaagagaugacaaagaaccagguuucccugaccugucuugugaaaggguucuauccgagcgacauugccgucgagugggaauccaauggacagccugagaacaacuacaagacaacgcccccugugcuggacucugauggcagcuuuuuccucuauuccaaacugaccguggacaagucucgcuggcagcaagggaauguuuucagcugcuccgucaugcacgaagcucugcauaaccacuacacacagaaaagccucucucugucccccggaaag

SEQ ID NO: 38228 - RNA, 645 nt, Artificial Sequence
  derived and/or modified sequence opt5 from Afasevikumab_LightChain1
gagaucgugcugacccagagccccgccacacucucccugucuccuggcgaaagagcuacgcuuagcugccgggccucccaaucuguccgcagcuaccuggcgugguaucagcagaagccggggcaggcucccagacuccugauuuacgacgccuccaaccgggccaccggaaucccugcucgcuucucuggcagcggguccggaacagauuuuacccuuacaauuagcucucuggagcccgaagacuucgccguuuauuacugucaacagagauccaauuggccucccgcuaccuuuggcgggggaacaaaaguggagaucaagcggaccguggccgcgccuagcgucuucauuuuuccgcccucugaugaacagcucaaauccggcacggccagcgugguuugccugcugaacaauuucuauccucgcgaggcuaaggugcaguggaaagucgacaacgcccuccaaucuggcaauucccaggagagcgugaccgaacaggauuccaaggacucuacauacagccuguccagcacccuuacacugucuaaggcugauuaugagaaacacaagguuuacgccugugaagugacccaucaggggcucuccagccccgucacgaaaucuuuuaacagaggagagugc

SEQ ID NO: 38229 - RNA, 1293 nt, Artificial Sequence
  derived and/or modified sequence opt5 from Aflibercept_Fusion_protein1
agcgacaccggcagacccuucguggagauguacuccgaaaucccugagauuauccacaugacagaagggcgggagcuggucauuccgugccgcguuacgucucccaacaucaccgugacacucaagaaauuuccucuggauacccuuauucccgacggaaagagaaucaucugggauagccggaaaggcuucauuaucuccaaugccacauauaaggaaauugggcugcucaccugugaggcuacagugaacggacaucuguacaaaaccaauuaucuuacgcaccgccagaccaacacaaucauugacgucgugcugucuccuagccauggcaucgagcucuccguuggggaaaagcuggugcugaauugcaccgccagaacagagcucaacgucggaauugauuuuaauugggaauaccccucuagcaagcaccaacauaaaaagcuggugaaccgggaccuuaaaacccaguccggcagcgagaugaagaaauuccugucuacgcucacaaucgauggcguuacccgcuccgaccaggggcuguauacaugugcggcuagcucuggacuuaugaccaagaaaaauuccaccuuugugagaguccacgagaaggauaagacacacacgugcccuccgugucccgccccugaacugcucggcgggcccagcguguuccuguuuccucccaaaccgaaggacacccugaugaucucucggacaccugaggugaccugcgucguuguggaugugucccaugaagaccccgaggucaaauucaacugguacguggauggaguugaagugcacaaugccaagacaaaaccucgcgaggagcaguauaacagcaccuacagagucguguccguucucacggugcugcaucaagacuggcuuaauggcaaggaauacaaguguaaagucucuaacaaggcucugcccgcccccauugagaaaacaaucagcaaggcuaaagggcagccucgggaaccccagguguauacccucccgccuucccgcgacgagcugaccaagaaucaggucagccuuacaugccuggugaagggauuuuaccccucugauauugccguugaaugggaguccaacggccaaccugagaacaauuauaaaaccacacccccggugcucgacagcgauggcucuuucuuucuguacagcaagcugacggucgacaaauccagauggcagcaggggaacguguucucuuguagcguuaugcacgaagcgcuccacaaucauuauacccagaagucccugagccuuucuccugga

SEQ ID NO: 38230 - RNA, 1332 nt, Artificial Sequence
  derived and/or modified sequence opt5 from Afutuzuab_HeavyChain1
caggugcaacugguccagagcggcgccgagguuaagaaacccggguccucugugaaggugagcugcaaggcuuccggauacgccuucucuuauagcuggaucaacugggucagacaggcgccuggccaggggcucgaauggggacggauuuuuccgggcgacggggauaccgacuacaauggaaaauucaaaggccgcgugacaaucacggcugauaaguccaccucuacagccuaugagcugagcucccuuagaagcgaagacaccgccguuuacuauugugcucggaacguguuugauggcuacuggcuggucuauugggggcaaggaacacucgugaccguuucuuccgccagcacaaagggccccucuguguucccucuggcucccuccagcaaaucuaccuccgggggaacggccgcgcuuggcugccuggucaaggacuacuuuccugagcccgugaccgugagcuggaacuccggggcccucacaucuggaguccacaccuucccugcuguucugcagagcuccggccuguacagccucucuuccguggugacagucccgagcucuagccugggcacccagacguauauuuguaaugugaaucauaaacccuccaacacaaagguugauaaaaagguggaaccuaagucuugcgacaaaacccacacaugucccccuugccccgccccggagcuucucgggggaccuagcgucuuucuguuucccccuaagcccaaagauacccugaucucccgcacccccgaggugacauguguuguggucgacgugagccaugaagauccugaggucaaguucaauugguacguggacggcguugaagugcacaacgcuaaaacgaagccgagagaggagcaguauaauucuaccuaccgggucguguccguucuuacagugcugcaucaagauuggcucaacgggaaagaauauaagugcaaggucagcaauaaagcccugcccgcgccuauugagaagaccaucucuaaagccaagggacagccccgcgaaccucagguguacacacugcccccguccagagacgagcucaccaaaaaccaggugagccugacgugucuuguuaagggcuucuauccuuccgacaucgcugucgaaugggagucuaaugggcaacccgagaacaauuacaagacaaccccucccgugcuggauagcgacggauccuuuuuccucuacucuaaacugaccguggauaagagccgguggcagcagggcaacgucuuuuccugcagcgugcacgaagcccuucacaaccauuauacacaaaaaucucugucccucagcccuggc

SEQ ID NO: 38231 - RNA, 651 nt, Artificial Sequence
  derived and/or modified sequence opt5 from Afutuzuab_LightChain1
gacaucgugacccagacaccccugagccucccugucacgccgggcgagcccgccuccauuucuugcagaagcuccaagucucugcuucacagcaacgggaucaccuaccuguauugguaccuccaaaaaccuggacagucuccccagcugcuuauuuaucaguccaaucugguuagcggcgugccugaucgguucuccgggagcggaucuggcacagacuuuacccucaagaucucccgcguggaagcugaggaugucgggguguacuauugugcccaaaaccuggaacugcccuacacauucggaggcggcaccaaaguugagauuaagagaacaguggcggcuccuagcgucuuuaucuucccgcccucugacgaacagcucaaauccgggaccgccagcgugguuugccugcuuaauaacuuuuauccucgggaggccaaggugcaguggaaggucgauaaugcucugcagucuggaaacucccaagagagcgugacggaacaggacuccaaagauucuaccuacagccucuccagcacacugacccuuucuaaggccgacuacgagaaacauaagguguaugcuugugaagucacacaccagggccuguccagccccguuaccaaaucuuucaaucgcggggagugc

SEQ ID NO: 38232 - RNA, 1347 nt, Artificial Sequence
  derived and/or modified sequence opt5 from Afutuzumab_HeavyChain1
caggugcaacugguccagagcggcgccgagguuaagaaacccggguccucugugaaggugagcugcaaggcuuccggauacgccuucucuuauagcuggaucaacugggucagacaggcgccuggccaggggcucgaauggaugggacggauuuuuccgggcgacggggauaccgacuacaauggaaaauucaaaggccgcgugacaaucacggcugauaaguccaccucuacagccuauauggagcugagcucccuuagaagcgaagacaccgccguuuacuauugugcucggaacguguuugauggcuacuggcuggucuauugggggcaaggaacacucgugaccguuucuuccgccagcacaaagggccccucuguguucccucuggcucccuccagcaaaucuaccuccgggggaacggccgcgcuuggcugccuggucaaggacuacuuuccugagcccgugaccgugagcuggaacuccggggcccucacaucuggaguccacaccuucccugcuguucugcagagcuccggccuguacagccucucuuccguggugacagucccgagcucuagccugggcacccagacguauauuuguaaugugaaucauaaacccuccaacacaaagguugauaaaaagguggaaccuaagucuugcgacaaaacccacacaugucccccuugccccgccccggagcuucucgggggaccuagcgucuuucuguuucccccuaagcccaaagauacccugaugaucucccgcacccccgaggugacauguguuguggucgacgugagccaugaagauccugaggucaaguucaauugguacguggacggcguugaagugcacaacgcuaaaacgaagccgagagaggagcaguauaauucuaccuaccgggucguguccguucuuacagugcugcaucaagauuggcucaacgggaaagaauauaagugcaaggucagcaauaaagcccugcccgcgccuauugagaagaccaucucuaaagccaagggacagccccgcgaaccucagguguacacacugcccccguccagagacgagcucaccaaaaaccaggugagccugacgugucuuguuaagggcuucuauccuuccgacaucgcugucgaaugggagucuaaugggcaacccgagaacaauuacaagacaaccccucccgugcuggauagcgacggauccuuuuuccucuacucuaaacugaccguggauaagagccgguggcagcagggcaacgucuuuuccugcagcgugaugcacgaagcccuucacaaccauuauacacaaaaaucucugucccucagcccuggcaag

SEQ ID NO: 38233 - RNA, 657 nt, Artificial Sequence
  derived and/or modified sequence opt5 from Afutuzumab_LightChain1
gacaucgugaugacccagacaccccugagccucccugucacgccgggcgagcccgccuccauuucuugcagaagcuccaagucucugcuucacagcaacgggaucaccuaccuguauugguaccuccaaaaaccuggacagucuccccagcugcuuauuuaucagauguccaaucugguuagcggcgugccugaucgguucuccgggagcggaucuggcacagacuuuacccucaagaucucccgcguggaagcugaggaugucgggguguacuauugugcccaaaaccuggaacugcccuacacauucggaggcggcaccaaaguugagauuaagagaacaguggcggcuccuagcgucuuuaucuucccgcccucugacgaacagcucaaauccgggaccgccagcgugguuugccugcuuaauaacuuuuauccucgggaggccaaggugcaguggaaggucgauaaugcucugcagucuggaaacucccaagagagcgugacggaacaggacuccaaagauucuaccuacagccucuccagcacacugacccuuucuaaggccgacuacgagaaacauaagguguaugcuugugaagucacacaccagggccuguccagccccguuaccaaaucuuucaaucgcggggagugc

SEQ ID NO: 38234 - RNA, 684 nt, Artificial Sequence
  derived and/or modified sequence opt5 from Alacizumab_pegol_HeavyChain1
gaggugcagcuggucgaaagcggcgggggacucguucaacccggcgggucccugagacuuucuugcgccgcuagcggauucaccuuuuccucuuacggcaugagcugggugcggcaggccccugggaagggacuggaguggguggcgacaaucacguccggcggcucuuauaccuacuaugucgacagcgugaaagggcgcuucacaauuuccagagauaacgcuaagaauacccucuaccugcagaugaacagccuucgggccgaagacacagccguuuauuacugugugcgcaucggagaggaugcucuggacuauuggggccaggggacccucgucacagugucuuccgccagcaccaaaggaccgucuguuuuuccccuggcuccuuccagcaagucuacguccggcgggaccgccgcgcugggaugccucgugaaagauuacuuccccgaaccugucacagugagcuggaacuccggcgcccugaccucuggcgugcacacauuucccgcuguccuucaaagcuccgggcuguacagccucucuuccguugugaccgugccuagcucuagccugggaacgcagacauauauuuguaaugucaaucauaagccguccaacaccaagguggacaaaaagguugagcccaaaucuugcgauaagacacacaccugugccgcu

SEQ ID NO: 38235 - RNA, 642 nt, Artificial Sequence
  derived and/or modified sequence opt5 from Alacizumab_pegol_LightChain1
gacauccagaugacccaaagccccuccucucugagcgccuccgugggcgauagagucacaauuacgugccgggcuucucaggacaucgccgggagccucaacuggcugcagcagaagccuggaaaagcgauuaagcgccuuaucuacgcuaccuccucucuggauagcggcguuccgaaaagauucuccgggagccggucuggauccgacuauacacucaccauuagcucucugcaacccgaggauuuugccacauacuauugucuucaguacggcuccuucccucccaccuuugggcagggaacaaagguggaaaucaaacgcaccguggccgcuccuagcgucuucaucuuucccccuucugacgagcagcugaaguccggcacggccagcgugguuugccuccugaauaacuucuauccgagagaagcuaaggugcaauggaaagucgauaaugcccugcaguccggcaacucucaggagagcgugaccgaacaggacuccaaggauagcacauacucucucuccagcacccugacacuuucuaaagcggacuaugagaagcacaaaguuuacgccugugaggugacccaucaagggcugagcucccccgucacgaagucuuuuaaucggggagaaugc

SEQ ID NO: 38236 - RNA, 1353 nt, Artificial Sequence
  derived and/or modified sequence opt5 from Alemtuzumab_HeavyChain
caggugcaacugcaggagagcggccccgggcucgucagaccuucccagacccugucucuuacaugcacgguuagcggauucaccuuuacagacuucuacaugaacugggugcggcagccgcccggccgcgggcuggaauggaucggauuuauuagagauaaggccaaaggcuauaccacagaguacaauccuuccgugaaggggcgggucaccaugcucguggacacaucuaaaaaccaauucagccugcgccuuuccucuguuaccgcugccgauacggcgguguauuacugugcuagagaaggacacaccgccgcccccuuugacuauuggggccagggcagccuggucacaguguccagcgcuucuaccaaggggccuuccguuuucccccucgccccuagcucuaaauccacaagcggaggcaccgcugcccuggggugccuggugaaggauuacuuuccggagcccgucacggugucuuggaacuccggagcgcucacaagcggcgugcauaccuucccugccguccugcaguccucugggcuuuauagccuguccagcguugugacagugcccucuuccagccucggaacccagaccuacaucuguaaugucaaucacaagccuucuaacacaaaaguggacaagaaaguugaacccaagagcugcgauaaaacgcauaccuguccgccuugccccgcuccugagcugcuuggcggccccuccguguuucuguuucccccuaagccgaaggacacacucaugauuucucggacccccgaggucacaugugugguuguggaugucagccacgaagacccugaggugaaauuuaauugguacgucgaugggguggaaguucauaacgccaagaccaaaccccgcgaggagcaauauaauuccacguacagaguggucagcgugcugacaguucugcaccaggacuggcucaacggaaaggaauauaaaugcaaggugucuaauaaagcucugccugcccccaucgagaagaccauuuccaaggcgaaaggccagccgcgggaaccucaggucuacacccuucccccuagccgcgaugagcugacaaagaaccaagugucucucaccugucuggugaaaggguucuaucccuccgacaucgccguugaaugggagagcaauggacagccugagaacaauuacaagacaacgcccccgguccuugacuccgauggcucuuucuuccuguauagcaaacucaccguggacaaguccagauggcagcaagggaacguguucucuugcagcgucaugcacgaagcucugcauaaccacuacacacagaagucccugagccucucuccuggaaaa

SEQ ID NO: 38237 - RNA, 657 nt, Artificial Sequence
  derived and/or modified sequence opt5 from Alemtuzumab_HeavyChain_variant_1bey_H
caggugcaacugcaggagagcggccccgggcucgucagaccuucccagacccugucucuuacaugcacgguuagcggauucaccuuuacagacuucuacaugaacugggugcggcagccgcccggccgcgggcuggaauggaucggauuuauuagagauaaggccaaaggcuauaccacagaguacaauccuuccgugaaggggcgggucaccaugcucguggacacaucuaaaaaccaauucagccugcgccuuuccucuguuaccgcugccgauacggcgguguauuacugugcuagagaaggacacaccgccgcccccuuugacuauuggggccagggcagccuggucacaguguccagcgcuucuaccaaggggccuuccguuuucccccucgccccuagcucuaaauccacaagcggaggcaccgcugcccuggggugccuggugaaggauuacuuuccggagcccgucacggugucuuggaacuccggagcgcucacaagcggcgugcauaccuucccugccguccugcaguccucugggcuuuauagccuguccagcguugugacagugcccucuuccagccucggaacccagaccuacaucuguaaugucaaucacaagccuucuaacacaaaaguggacaagaaaguu

SEQ ID NO: 38238 - RNA, 660 nt, Artificial Sequence
  derived and/or modified sequence opt5 from Alemtuzumab_HeavyChain_variant_1ce1_H
caggugcaacugcaggagagcggccccgggcucgucagaccuucccagacccugucucuuacaugcacgguuagcggauucaccuuuacagacuucuacaugaacugggugcggcagccgcccggccgcgggcuggaauggaucggauuuauuagagauaaggccaaaggcuauaccacagaguacaauccuuccgugaaggggcgggucaccaugcucguggacacaucuaaaaaccaauucagccugcgccuuuccucuguuaccgcugccgauacggcgguguauuacugugcuagagaaggacacaccgccgcccccuuugacuauuggggccagggcagccuggucacaguguccagcgcuucuaccaaggggccuuccguuuucccccucgccccuagcucuaaauccacaagcggaggcaccgcugcccuggggugccuggugaaggauuacuuuccggagcccgucacggugucuuggaacuccggagcgcucacaagcggcgugcauaccuucccugccguccugcaguccucugggcuuuauagccuguccagcguugugacagugcccucuuccagccucggaacccagaccuacaucuguaaugucaaucacaagccuucuaacacaaaaguggacaagaaaguugaa

SEQ ID NO: 38239 - RNA, 1311 nt, Artificial Sequence
  derived and/or modified sequence opt5 from Alemtuzumab_HeavyChain_variant_8005_H
caggugcaacugcaggagagcggccccgggcucgucagaccuucccagacccugucucuuacaugcacgguuagcggauucaccuuuacagacuucuacaugaacugggugcggcagccgcccggccgcgggcuggaauggaucggauuuauuagagauaaggccaaaggcuauaccacagaguacaauccuuccgugaaggggcgggucaccaugcucguggacacaucuaaaaaccaauucagccugcgccuuuccucuguuaccgcugccgauacggcgguguauuacugugcuagagaaggacacaccgccgcccccuuugacuauuggggccagggcagccuggucacaguguccagcgcuucuaccaaggggccuuccguuuucccccucgccccuagcucuaaauccacaagcggaggcaccgcugcccuggggugccuggugaaggauuacuuuccggagcccgucacggugucuuggaacuccggagcgcucacaagcggcgugcauaccuucccugccguccugcaguccucugggcuuuauagccuguccagcguugugacagugcccucuuccagccucggaacccagaccuacaucuguaaugucaaucacaagccuucuaacacaaaaguggacaagaaaguugaagcucccgagcugcuuggcggcccgagcguguuucuguucccucccaagccuaaagauacgcucaugauuucccggacccccgaggucacaugcgugguuguggacgucucucaugaagaucccgaggugaaguuuaauugguacgucgacgggguggaaguucacaacgccaagaccaaaccucgcgaggagcaauauaauagcacauacagaguggucuccgugcugaccguucugcaucaggauuggcucaacggaaaggaauauaaauguaaggugagcaauaaagcucugccggcccccaucgagaagacgauuucuaaagcgaagggccagccucgggaaccccaggucuacacacuuccucccucccgcgacgagcugaccaagaaccaagugagccugaccugccucgugaaaggguucuauccgucugauaucgccguugaaugggaguccaauggacagccugagaacaauuacaagacaacacccccuguccuugacagcgacggcuccuuuuuccuguauucuaaacucaccguggauaagagcagauggcagcaagggaacguguucuccuguucugucaugcacgaagcucugcacaaccauuacacgcagaaaagccugucccucagccccggaaag

SEQ ID NO: 38240 - RNA, 633 nt, Artificial Sequence
  derived and/or modified sequence opt5 from Alemtuzumab_LightChain
gacauccagaugacccaaagccccuccucucugagcgccuccgugggcgauagagucacaauuacgugcaaggcuucucagaacaucgacaaauaccucaauugguaucagcagaagccugggaaagccccgaagcugcuuauuuacaacaccaauaaccugcaaacaggaguucccagccgguucuccggcucugggagcggaaccgauuuuacauucaccaucuccagccuccagccugaggacauugcgacauauuacugucugcagcacaucucucgccccagaaccuuuggccaggggacgaaaguggaaaucaagcggaccguggcugccccuuccgucuucauuuuucccccuagcgaugagcaacuuaagucuggaacagccuccgugguuugccugcucaauaacuucuauccgcgcgaagcuaaagugcaguggaaggucgacaaugcccugcagagcggcaacucucaggaguccgugaccgaacaagauagcaaagacuccacauacucucugagcuccacccucacgcugagcaaggcugauuaugagaaacauaagguuuacgccugugaggugacacaccagggccuuucuucccccgucaccaagagcuuuaauaga

SEQ ID NO: 38241 - RNA, 642 nt, Artificial Sequence
  derived and/or modified sequence opt5 from Alemtuzumab_LightChain_variant_8005_L
gacauccagaugacccaaagccccuccucucugagcgccuccgugggcgauagagucacaauuacgugcaaggcuucucagaacaucgacaaauaccucaauugguaucagcagaagccugggaaagccccgaagcugcuuauuuacaacaccaauaaccugcaaacaggaguucccagccgguucuccggcucugggagcggaaccgauuuuacauucaccaucuccagccuccagccugaggacauugcgacauauuacugucugcagcacaucucucgccccagaaccuuuggccaggggacgaaaguggaaaucaagcggaccguggcugccccuuccgucuucauuuuucccccuagcgaugagcaacuuaagucuggaacagccuccgugguuugccugcucaauaacuucuauccgcgcgaagcuaaagugcaguggaaggucgacaaugcccugcagagcggcaacucucaggaguccgugaccgaacaagauagcaaagacuccacauacucucugagcuccacccucacgcugagcaaggcugauuaugagaaacauaagguuuacgccugugaggugacacaccagggccuuucuucccccgucaccaagagcuuuaauagaggggaaugc

SEQ ID NO: 38242 - RNA, 1341 nt, Artificial Sequence
  derived and/or modified sequence opt5 from Alirocumab_HeavyChain1
gaggugcagcuggucgaaagcggcgggggacucguucaacccggcgggucccugagacuuucuugcgccgcuagcggauucaccuuuaacaauuacgccaugaacugggugcggcaggcgccuggcaaggggcuggacuggguguccacaaucucuggaagcggcggcacgaccaauuaugcugauuccgucaaagggcgcuucauuaucucuagagacagcuccaagcacacacucuaccugcagaugaacagccuucgggccgaggauaccgccguguauuacugugcuaaagacucuaauuggggaaacuuugaucuguggggccgcgggacacucguuaccguguccagcgccucuacaaagggaccguccgucuucccccuggcuccuagcucuaaauccaccagcggcgggacggccgcgcugggaugccucgugaaggacuauuuucccgaaccuguuaccguguccuggaacucuggcgcccugacaagcggcguccauaccuuccccgcugugcuucaguccagcgggcuguacucucucuccagcguggucacaguuccuucuagcucccugggaacccaaacguauauuuguaaugugaaucacaagccgucuaacacaaaaguggauaagaaagucgagcccaagagcugcgacaaaacccauacauguccucccugcccugcccccgaacuucugggcgggccguccguguuucucuucccucccaagccuaaggauacccugaugaucagcagaacccccgagguuacauguguggucguggacguuucucacgaggaucccgaagugaaauuuaauugguacgucgacggaguggagguccauaacgcuaagacgaaaccucgggaggaacaguacaauuccaccuaucgcgugguuagcgugcugacaguccuccaccaggauuggcugaacggcaaggaguacaaaugcaaggugucuaauaaagcccuuccggcgcccauugaaaagaccaucuccaaggccaaagggcagccuagagagccccaaguuuauacacugccucccagccgggacgaacucaccaagaaccaggugucccugacgugucuugucaaaggauucuacccgucugacaucgcuguggagugggaaagcaacggccagccugagaauaacuauaagacaacacccccugugcuggauuccgacggcagcuuuuuccucuacucuaaacugaccguugauaagucccgcuggcagcaagggaaugucuuuagcugcucugugaugcacgaggcccugcauaaccacuauacccagaagucccucagccugucucccgga

SEQ ID NO: 38243 - RNA, 660 nt, Artificial Sequence
  derived and/or modified sequence opt5 from Alirocumab_LightChain1
gacaucgugaugacccagagccccgauucccuggccgucucucucggcgagagagcuacaauuaacugcaagagcucccaaucuguucuguaccggagcaauaaccgcaauuuccuugggugguaucagcagaaaccuggacagccgcccaaccugcucaucuacugggccuccacgagagaaucuggcgugccugaccgguuuagcggguccggaagcggcaccgauuucacacugaccauuucuucccuucaagcggaggacguggcugucuauuacugucagcaguauuacacaacccccuauacauuugggcagggaaccaagcuggaaaucaaacgcacgguggccgccccuagcguuuucauuuuucccccuucugaugagcaacucaaguccggcaccgcuagcguggucugccugcugaauaacuucuacccgagagaagccaaagugcaguggaagguugacaaugcucuccagucuggcaacucccaggagagcgugacagagcaagauuccaaggacucuaccuacagccuguccagcacacuuacccugucuaaagccgauuaugaaaagcacaaagucuacgcgugugaggugacgcaucaggggcucuccagccccgugacaaagucuuuuaaucggggagaaugc

SEQ ID NO: 38244 - RNA, 735 nt, Artificial Sequence
  derived and/or modified sequence opt5 from ALX-0061_HeavyChain1
gaggugcagcuggucgaaagcggcgggggacucguucaacccggcgggucccugagacuuucuugcgccgcuagcggauccguguucaagaucaacgugauggccugguaccggcaggcgccuggcaaagggcgcgagcuggucgcuggaauuaucucuggcggcagcaccuccuaugccgacucugugaaggggagauuuacaauuagccgggauaaugccaaaaacacgcucuaccugcagaugaacucccuucgcccggaagacaccgcuguuuauuacugugccuucaucacaaccgagagcgauuaugaccugggaagacgguacuggggccaggggacacucgugaccgucucuuccggaggcgggggaagcggcggcgggucugaagugcaacugguugaguccggaggcgggcuggugcagcccggaaauagccuccgccugucuugcgcugccuccggcuuuacauucagcuccuuugggaugucuugggucagacaggcgccuggaaagggccuugagugggugagcuccauuagcggcucuggguccgauacccuguaugccgacagcgugaaaggacgguucacgaucucucgcgauaaugcuaagaccacacucuaccugcagaugaacagccuuagacccgaagacaccgccgucuacuauuguacaaucggcgggucccugucucggagcucccaaggaacccucguuacggugagcucu

SEQ ID NO: 38245 - RNA, 1347 nt, Artificial Sequence
  derived and/or modified sequence opt5 from Amatuximab_HeavyChain1
caggugcaacugcagcagagcggccccgagcucgaaaagccuggggccuccgucaaaaucucuugcaaggcuagcggauacuccuucaccggcuauacaaugaacuggguuaaacagucucacggaaagagccuggaguggauugggcuuaucacgccguacaauggcgccuccucuuauaaccaaaaauuuagagggaaggcgacccugacaguggacaagagcuccagcaccgcuuacauggaucuccugucucuuacauccgaagacagcgccguguauuucugugcccggggaggcuacgauggccgcggguuugacuauuggggaucuggcacccccgucacaguguccagcgcuucuaccaaagggccuuccguuuucccccuggccccuagcuccaagucuacgagcggaggcaccgcugcccucgggugccuggugaaagauuacuuucccgagccugucacaguguccuggaauagcggagcgcugaccucuggcguucauacauucccggccgugcuccaguccagcggccuguacucucuuagcuccgucgugaccgugcccucuagcucccuggggacgcagacauauauuuguaacgucaaucacaagccuagcaacaccaaaguugacaagaagguggaacccaaaucuugcgauaagacacauaccuguccucccugcccggcuccugagcuccugggaggccccuccguguuucuuuucccucccaaacccaaggacacccugaugaucagcagaacaccugaggucacgugugugguuguggaugucucucacgaagacccggaggugaaauuuaauugguacguugaugggguggaaguccauaacgccaagaccaaaccccgggaggagcaguauaauuccacauaccgcguggucagcgugcucaccguucugcaccaagacuggcugaacggaaaggaauauaagugcaaaguguccaauaaggcucucccugcccccauugagaaaacaaucucuaaggcgaaaggccagccuagagaaccccaggucuacacccugccgccuagccgggaugagcuuacgaagaaccaggugucccugacaugucucguuaagggguucuaucccucugacaucgccguggaaugggagagcaauggacaaccugagaacaauuacaaaaccacacccccuguccuggacuccgauggcagcuuuuuccuuuacucuaagcugaccguggacaaaucccgcuggcagcagggcaacguguuuagcugcucuguuaugcacgaagcucuccauaaccacuauacccaaaagucccugagccugucucccgggaaa

SEQ ID NO: 38246 - RNA, 639 nt, Artificial Sequence
  derived and/or modified sequence opt5 from Amatuximab_LightChain1
gacaucgagcugacccagagccccgccauuauguccgcuucuccuggcgaaaaggugacaaugacgugcagcgccuccucuagcgucuccuacaugcacugguaucaacagaaaucugggaccagcccgaagagauggaucuacgauacauccaaacucgcgagcggaguucccggccgguucucuggguccggaagcggcaacucuuauucccugaccauuagcucuguggaggcugaagacgaugccacauacuauugucagcagugguccaagcauccucuuaccuuugggagcggaacaaaaguggagaucaagcgcaccgucgccgcucccuccguguucauuuuuccucccucugacgaacaacucaagagcggcacggccuccguugugugccugcugaauaacuucuacccuagagaggcuaaaguccaguggaagguggauaaugcccuucagagcggcaacucucaggaguccguuaccgaacaagacagcaaagauucuacauauagccuguccucuacccucacacugagcaaggcggacuacgagaaacacaagguguacgccugugaagucacccaucaggggcuguccagcccggugacgaagucuuuuaaucggggagagugc

SEQ ID NO: 38247 - RNA, 1350 nt, Artificial Sequence
  derived and/or modified sequence opt5 from Anetumab_ravtansine_HeavyChain1
cagguggagcugguccaaagcggcgccgaaguuaagaaacccggggagucccucaagaucucuugcaaaggaagcggcuacuccuucaccucuuauuggauugggugggugagacaggcuccuggaaagggccuggaauggauggggaucauugacccgggagauagccggacacgcuacucccccucuuuucagggccaggugacgaucagcgccgacaaauccauuagcaccgcguaucuucaauggucuucccugaaggcuagcgauacagccauguacuauugugccagaggccagcucuacgggggaaccuauauggacggcugggggcagggaacacuggucaccgugucuuccgcuagcacaaagggcccuucuguuuucccccuugccccuuccagcaaauccaccucugggggaacggcugcccugggcugccucgugaaggauuacuuucccgagccugucaccgugagcuggaacuccggcgcgcugacaagcgggguucacaccuucccggccgugcugcagucuuccggacucuacagccugucuagcgucgugacagugcccuccucuagccuuggcacccaaacguauaucuguaaugucaaccauaaaccuuccaauacaaagguugacaaaaagguggaacccaagagcugcgauaaaacccacacauguccucccugcccggcuccugagcugcucgggggacccucuguguuucuguucccucccaagcccaaagacacccuuaugaucucccggaccccugaggucacaugugugguuguggaugucagccaugaagacccggaggugaaguuuaacugguacguugauggcguggaaguccacaaugccaaaacgaagccccgcgaggagcaguauaacucuaccuacagaguggucuccgugcugacaguucuccaucaggacuggcugaaugggaaagaauauaagugcaaggugagcaacaaagcucugccugcccccauugagaagaccaucuccaaagcgaagggacagccucgggaaccccaagucuacacacucccgccuucucgcgaugagcugaccaaaaaucaggugagccuuacgugucugguuaagggcuucuaucccuccgacauugccguggaaugggagucuaacggccagccugagaauaacuacaagacaacacccccuguccucgacagcgauggguccuuuuuccuguacagcaaacuuaccguggacaagucuagauggcaacagggaaauguguuuuccugcagcguuaugcacgaagcucugcacaaccauuauacccagaaaucucucucccugagccccggcaag

SEQ ID NO: 38248 - RNA, 651 nt, Artificial Sequence
  derived and/or modified sequence opt5 from Anetumab_ravtansine_LightChain1
gacaucgcccugacccagcccgcuagcguguccggcucuccugggcaaagcauuacaaucuccugcacgggaaccucuagcgauauuggcggguacaacuccgucucuugguaucagcagcacccgggaaaggcccccaaacucaugaucuacggcguuaauaacagaccuagcgggguguccaaucgguucagcggaucuaaguccggcaacacagcgagccugaccauuucuggccuucaggcugaggacgaagccgauuauuacuguuccagcuaugacaucgagucugccacacccguguuugggggaggcaccaaacugacaguccucgggcaaccuaaggcugcccccuccgugacccuguucccuccgagcuccgaggaacuucaggcuaauaaagccacgcugguuugccucaucucugauuuuuaccccggagcggugaccgucgccuggaagggcgacagcuccccugugaaggcugggguugaaacaaccacacccagcaaacagucuaacaauaaguaugccgcuuccagcuaccugucucugaccccugagcaguggaaaagccaucgcuccuacucuugucaagugacgcacgagggaagcacagucgaaaagaccguggcccccacagagugcucc

SEQ ID NO: 38249 - RNA, 1341 nt, Artificial Sequence
  derived and/or modified sequence opt5 from Anifrolumab_HeavyChain1
gaggugcagcugguccaaagcggcgccgaaguuaagaaacccggggagucccucaagaucucuugcaaaggaagcggcuacauuuucaccaacuauuggaucgcuugggugagacagaugccugggaagggacuggaauccaugggcauuaucuacccgggggacucugauauucgguauagccccuccuuucagggacaggugacaaucucugccgacaaaagcaucacgaccgcguaccuucaaugguccagccugaaggcuucugauacagccauguauuacugugcccgccacgacauugagggcuucgauuauuggggcagagggacccucgucacaguguccagcgcuucuaccaagggaccuuccguuuuuccccuggccccuagcucuaaauccacaagcggcgggaccgcugcccuuggaugccuggugaaggacuacuuccccgaaccugucacgguguccuggaacucuggcgcgcucaccagcgggguucauacauuuccggccgugcugcaguccagcggacuguacucucucuccagcgucgugaccgugcccucuagcucccugggcacacagaccuauaucuguaaugucaaucacaaaccuucuaacacgaagguugauaaacggguggagcccaagagcugcgacaagacacauaccuguccucccugcccggcuccugaguucgaaggcgggcccuccguguuucuuuucccucccaaacccaaggauacacugaugauuagccgcaccccugaggucaccugugugguuguggacgucucucacgaagauccggaggugaaauuuaauugguacguugacggaguggagguccauaacgccaagacaaaacccagagaggaacaguauaauuccacguaccggguggucagcgugcucaccguucugcaccaagauuggcuuaacggcaaggaauauaaaugcaaggugucuaauaaggcucugccugccuccaucgagaaaacaauuagcaaggcgaaagggcagccccgcgaaccucaggucuacacccuucccccguccagagaggagaugacaaagaaccaggugucucugaccugucugguuaaaggauucuauccuagcgacaucgccguggaaugggaguccaauggccaacccgaaaacaauuacaagacgacaccucccguccucgacucugaugggagcuuuuuccuguacuccaagcucaccguggacaaaagccgguggcagcagggaaacguguuuucuugcuccguuaugcacgaggcucugcauaaucacuauacccaaaagagccucucucuguccccuggcaaa

SEQ ID NO: 38250 - RNA, 645 nt, Artificial Sequence
  derived and/or modified sequence opt5 from Anifrolumab_LightChain1
gagaucgugcugacccagagccccggcacacucucccugucuccuggggaaagagccacgcuuagcugccgggcuucccaaucugucagcuccucuuucuuugccugguaccagcagaagccgggacaggcgccccgccugcucauuuauggcgcuagcuccagagccaccgggaucccugaccggcugagcggaucuggcuccgggacagauuucacccuuacaauuacccgccuggagcccgaagacuuugccguuuacuauugucaacaguacgauagcucugcuaucacauucggacagggcaccagacucgagauuaaacggacgguggccgcuccuuccguguuuaucuuucccccuagcgacgaacagcugaagucuggcaccgccuccgucgugugccugcucaacaauuucuauccgcgcgaggcgaaaguucaauggaagguggauaacgcccugcagagcggaaauucccaggagucugucacagaacaggacagcaaagauuccaccuacagccuuucuuccacacugacccucagcaaggcugacuaugagaagcacaaaguguacgccugugaaguuacgcaucaagggcugucuagccccgugacaaaguccuucaacagaggcgagugc

SEQ ID NO: 38251 - RNA, 1344 nt, Artificial Sequence
  derived and/or modified sequence opt5 from Anrukinzumab_HeavyChain1
gaggugcagcuggucgaaagcggcgggggacucguucaacccggcgggucccugagacuuucuugcgccgcuagcggauucaccuuuaucuccuacgccaugucuugggugcggcaggcgccuggcaaggggcuggaguggguggcuagcauuuccucuggaggcaacacauauuacccggacagcgucaaaggccgcuucacgaucuccagagauaaugccaagaacagccucuaucugcagaugaacucucuucgggccgaagacaccgcuguguacuauugugcccgccuggauggguacuauuuuggauucgcuuacuggggccaggggacacucguuaccguguccagcgccucuacaaaaggacccuccgucuuuccucuggcgcccagcucuaaguccaccagcggcgggacagccgcucugggaugccucgugaaagacuacuucccugagcccguuaccguguccuggaacucuggcgcccugacgagcggcguccacaccuuuccugcugugcuucaauccagcgggcuguauucucucuccagcguggucacaguuccgucuagcucccugggaacccagacauacauuuguaaugugaaucauaagcccucuaauaccaagguggauaaaaaggucgaaccuaaaagcugcgacaagacgcacacaugucccccuugccccgccccggaggcgcuuggcgccccuuccguguuccuguuucccccuaaacccaaggauacccucaugaucagcagaacacccgagguuaccuguguggucguggacguuucucaugaagauccugaggugaaguucaacugguaugucgacgggguggaaguccacaaugcuaaaaccaagccgcgggaggagcaguacaacuccacauaucgcgugguuagcgugcugacgguccugcaucaggauuggcucaauggaaaagaauacaagugcaaagugucuaacaaggcccugcccgcuccuauugagaaaaccaucuccaaggccaagggccaacccagagaaccucagguuuauacacuucccccgagccgggaggaaaugaccaaaaaucaggugucccugacaugucucgucaagggguuuuacccuucugacaucgccguggagugggagagcaacggacagcccgaaaauaacuacaaaaccacgccucccgugcuggauuccgacggcucuuucuuucuuuauagcaagcugacaguugacaaaucccgcuggcaacagggcaacgucuucagcugcucugugaugcacgaggcucuccacaaucauuacacccagaagucccugagccugucuccugggaag

SEQ ID NO: 38252 - RNA, 654 nt, Artificial Sequence
  derived and/or modified sequence opt5 from Anrukinzumab_LightChain1
gacauccagaugacccaaagccccuccucucugagcgccuccgugggcgauagagucacaauuacgugcaaggcuucugagagcguugacaacuacgggaaaucccucaugcacugguaucagcagaagccuggaaaagccccgaagcugcuuaucuaccgggcgucuaaucuggaaagcggcgugcccucccgcuucagcgggucuggauccggcaccgauuuuacacucaccauuagcucucugcagccugaggacuucgcuacauauuacugucaacaguccaacgaagaucccuggaccuuugggggaggcacaaaaguggagaucaagagaaccgucgccgccccuagcguguucauuuuucccccuucugacgaacagcuuaaguccggcacggcuagcguugugugccugcucaauaacuucuauccgcgggaggccaaaguccaguggaagguggauaaugcucugcaauccgggaacucucaggagagcguuaccgaacaggacuccaaagauagcacauacucucuguccagcacccucacacugucuaaggccgacuaugagaaacauaagguguacgcgugugaagucacccaccagggacuuagcucccccgugacgaagucuuuuaaucgcggcgagugc

SEQ ID NO: 38253 - RNA, 1338 nt, Artificial Sequence
  derived and/or modified sequence opt5 from Apolizumab_HeavyChain1
caggugcaacugcaggagagcggccccgggcucgucaagccuuccgaaacccugucucuuacaugcacgguuagcggauucucccugaccaacuacggcgugcacugggugagacagucuccggggaaaggacucgaguggaucggcgucaaguggagcgggggauccacagaauauaaugccgcuuuuauuucucggcugaccaucagcaaagacacauccaagaaccaggugagccuuaaacucaauucucucaccgccgcggauacagcuguuuacuauugugcccgcaacgacagauacgccauggauuauuggggccaaggcacccuggugacggucuccagcgcuucuaccaaggggcccuccguguucccucuggcccccagcucuaaguccacaagcggaggcaccgcugcccucgggugccugguuaaagacuacuuuccugagcccgugacagucuccuggaacucuggagcgcuuaccagcggcgugcauacguucccugccgugcugcaguccagcgggcucuauucucuguccagcgucguuacagugccgucuagcucccuuggaacccagacauacauuuguaaugugaaucacaagcccucuaacaccaaagucgauaagaaaguggaaccuaagagcugcgacaagacccauacaugucccccuugccccgcuccggagcugcucggcggcccuuccguuuuucuguuucccccuaaacccaaggauacgcugaugaucagccggacccccgaggugacaugugucgugguugacgugucucacgaagauccugaggucaaauuuaauugguacguggacggggucgaagugcauaacgccaagaccaaaccgcgcgaggagcaguauaauuccacauacagaguugugagcguccucaccgugcugcaccaagauuggcuuaacggaaaggaauauaaaugcaagguuucuaauaaggcucugcccgccccuauugagaaaacgaucuccaaggcgaaaggccagccccgggaaccucagguguacacacugcccccgagccgcgacgagcugaccaagaaccaggucucccuuaccugucuggugaaaggguucuauccuucugauaucgccguggaaugggagagcaauggacaacccgagaacaacuacaagacaaccccucccguucucgacuccgacggcucuuucuuccuguauagcaagcugacagucgauaaauccagauggcagcaggggaauguguuuagcugcucugugaugcacgaagcucuccauaaccacuacacgcaaaagucccugagccuuucuccuggaaaa

SEQ ID NO: 38254 - RNA, 642 nt, Artificial Sequence
  derived and/or modified sequence opt5 from Apolizumab_LightChain1
gacauccagaugacccaaagccccuccucucugagcgccuccgugggcgauagagucacaauuacgugccgggcuucugagaacaucuacagcuaucucgccugguaccagcagaagccugggaaagcgccgaagcugcuuguuuccaaugcuaaaacccuggccgaaggagugcccucucgcuucagcggcuccgggagcggaaagcaguuuacacucaccauuucuucccugcaaccugaggacuucgccacauauuacugucagcaccauuauggcaacagcuaccccuuugggcagggaaccaaacuugaaaucaagagaacaguggcugccccuucugucuucauuuuucccccuuccgaugagcagcucaagagcggcaccgcuucugugguuugccugcugaauaacuucuauccgcgggaagccaaagugcaauggaaggucgacaaugcgcugcaguccggcaacagccaggaguccgugacggagcaggauucuaaagacagcaccuacucccucagcucuacacugacccuuuccaaggccgauuacgaaaaacacaagguuuaugcuugugaggugacacaucaagggcugagcucucccgucaccaagagcuuuaaucgcggagaaugc

SEQ ID NO: 38255 - RNA, 378 nt, Artificial Sequence
  derived and/or modified sequence opt5 from Apomab_HeavyChain
gaggugcagcugguccaaagcggcgggggaguugaaagacccggcgggucccuccggcugucuugcgccgcuagcggauucaccuuugacgauuacgccaugugggugcgccaggcgccuggcaaggggcuugaguggguguccggaaucaacuggcagggcggcucuacaggguaugcugacagcgucaaaggaagagugacgauuucccgggauaaugccaagaacucucuguaccuccagaugaauagccugcgcgccgaagacaccgcuguuuauuacugugccaaaauccuuggcgcugggagaggaugguauuucgauuacuggggcaaggggacaaccgugacagucuccagcgccucuaccaaaggaccg

SEQ ID NO: 38256 - RNA, 324 nt, Artificial Sequence
  derived and/or modified sequence opt5 from Apomab_LightChain
agcgagcugacccaggaccccgccguguccgucgcucucggccaaacaguuagaaucacgugcucuggggauagccugcgguccuacuaugccucuugguaccagcagaagccuggacaggcgccggugcuugugauuuauggcgcuaacaaucgccccagcgggaucccugacagauucuccggaucuagcuccggcaacaccgccagccugacaauuaccggggcccaagcugaagaugaggccgacuacuauuguaauucugcugauuccagcggaaaccacgucguguuuggcggcgggacaaaacucaccguucuggga

SEQ ID NO: 38257 - RNA, 645 nt, Artificial Sequence
  derived and/or modified sequence opt5 from Aquaporumab_LightChain
gagaucgugcugacccagagccccggcacacucucccugucuccuggggaaagagccacgcuuagcugccgggcuucccaaaccguccgcacaaacuaccuggccugguuccagcagaaaccgggacaggcgcccagacuccugauuuuuggcgcuucuagccgggccaccgggaucccugaccgcuucuccggaucuggcagcgggacagauuuuacccuuacaauuuccagacuggagcccgaagacuucgccguuuauuacugucaacaguauggaagcucuccuuggaccuuuggccagggcacgaaaguggagaucaagcggaccguggcugcccccuccgucuucauuuuuccuccgagcgaugaacagcucaaaucugggacagcuuccgugguuugccugcugaauaacuucuacccccgcgaggccaaggugcaauggaaagucgacaaugcgcuccagagcggaaacucucaggaguccgugaccgaacaggauagcaaggacuccacauauucucugagcuccacccuuacgcugagcaaggccgauuacgagaaacacaagguuuaugcuugugaagugacacaucaaggccucucuuccccugucaccaagagcuuuaauagaggggagugc

SEQ ID NO: 38258 - RNA, 1326 nt, Artificial Sequence
  derived and/or modified sequence opt5 from Arcitumomab_99tc_HeavyChain
gaggugaagcuggucgaaagcggcgggggacucguucagcccggcgggucccugagacuuucuugcgccaccagcggauucacauuuacggacuacuauaugaacugggugcggcaaccuccgggcaaagcucuggaguggcucggguucaucggaaauaaggccaacggcuacaccacagaauauuccgcgucugugaaaggccgcuuuaccauuagcagagauaagucccagucuauccuguaccuucagaugaauacacugcgggcugaggacagcgccaccuauuacuguacacgcgauagagggcuccgguucuauuuugacuacuggggacagggcaccacgcugaccgucuccagcgccaaaacaacacccccuucuguguacccccuggcuccuggguccgccgcucaaacaaacagcaugguuacccucggaugccuggugaagggcuauuuccccgaaccugucacggugacauggaacucugggucccuuagcucuggaguucacaccuuuccggccgugcugcaguccgaucucuacacacugagcuccucugucaccgugcccagcuccccucgccccagcgagaccgugacauguaaugucgcgcauccugccucuuccacgaagguugacaaaaagauugugcccagagauugcccgccuuguaaaugccccgcuccuaaucuucugggcggccccagcguguucaucuuucccccuaagauuaaagacguccucaugaucucucugagcccgaucgugaccuguguuguggucgauguguccgaggacgaucccgacguucagauuucuugguucgugaacaaugucgaagugcacacagcccagacccaaacacaucgggaggauuauaacagcacccugcgcgucguguccgcucucccuauccagcaccaggacuggaugagcgggaaggaauuuaagugcaaaguuaauaacaaggaccugcccgccccuauugagagaacgaucucuaaacccaagggauccgugcgggcgccgcaggucuacgugcuuccucccccugaggaagagaugaccaaaaagcaaguuacccugaccuguauggugacagauuucaugcccgaagacauuuaugucgaguggaccaauaacggcaaaacagaacucaauuacaagaacacggagccugugcuggauagcgacgggucuuauuuuauguacuccaaacuucgcguggagaaaaagaacuggguugaaagaaauagcuacuccugcucugucgugcaugagggacugcacaaccaccauaccacaaagagcuucucccgg

SEQ ID NO: 38259 - RNA, 639 nt, Artificial Sequence
  derived and/or modified sequence opt5 from Arcitumomab_99tc_LightChain
cagaccgugcugagccaaagccccgccauccucucugcuagcccuggcgagaaggucacaaugacgugcagagccuccucuagcguuaccuacauucacugguaucagcagaaaccgggguccucucccaagagcuggaucuacgcgacauccaaccuggcuagcggagugccugcccgguucucuggcuccgggagcggaaccucuuauucccuuacaauuagccgcguggaagccgaggacgcugccaccuacuauugucagcauuggucuuccaaacccccuacauuuggcgggggaaccaagcuggaaaucaaaagagcugaugccgcgcccacggucagcauuuucccuccguccucugagcaacucaccagcggcggcgccuccgugguuugcuuucugaauaacuucuaccccaaggacaucaaugugaaguggaaaaucgaugggagcgaacggcagaacggaguccuuaauucuuggacagaccaggauuccaaggacagcaccuauucuaugagcuccacacugacccucacgaaagaugaguacgagcgccacaacucuuacacaugugaagcuacccauaagacaagcaccuccccuauugugaaauccuuuaauagaaacgagugc

SEQ ID NO: 38260 - RNA, 1329 nt, Artificial Sequence
  derived and/or modified sequence opt5 from Ascrinvacumab_HeavyChain1
caggugcaacugcaggagagcggccccgggcucgucaagccuucccagacccugucucuuacaugcacgguuagcggaggcuccaucucuagcggggaauacuauuggaacuggauuagacagcacccgggaaaaggccuggaguggaucggguacauuuauuacuccggaucuaccuauuacaaucccagccucaagucccgggugacaaucagcguggacaccucuaaaaaccaauucucccugaaacuuagcucugucacagccgcugauaccgccguguauuacugugcgcgcgaauccguugcuggcuuugacuacuggggccaggggacacuggugaccgucagcucugccuccacgaaaggaccuagcguguucccccucgccccuugcuccagaucuaccagcgaguccacagcugcccugggcugucugguuaaggauuauuuucccgaaccugugaccgucagcuggaacucuggggcucucacauccggagugcauaccuucccggccgugcugcagagcucuggccuuuacagccuguccucugucguuacggugcccagcuccaauuuugggacacagaccuauacaugcaauguggaccacaagccuagcaacaccaaagucgauaagaccguggagcggaaauguugcguugagugucccccuugccccgcgccgccuguggccggacccucugucuuccucuuuccucccaagcccaaagacacacugaugauuucccgcacgccugaagugaccuguguuguggucgaugugagccaugaggacccggaaguccaauucaauugguacguggauggcguugaggugcacaacgcuaagacaaagcccagagaggaacaguuuaauucuaccuuccgggucguguccguucuuacagugguccaucaggacuggcugaacggcaaagaguauaagugcaaagugagcaauaaggggcucccugcccccaucgaaaagaccaucuccaagacgaaaggacagccucgcgagccccaaguguacacacugccgccuucuagagaagagaugaccaagaaccagguuagccugaccugucucgucaagggcuuuuaucccuccgauauugcuguggagugggaaucuaaugggcagccugagaacaauuacaaaacaacacccccuaugcuggacagcgauggauccuucuuucuuuacagcaagcugaccguggacaaaucucgguggcaacagggcaacgucuucuccugcagcgugaugcacgaagcccuccacaaccauuauacgcagaagucucugucccuuagccccggg

SEQ ID NO: 38261 - RNA, 645 nt, Artificial Sequence
  derived and/or modified sequence opt5 from Ascrinvacumab_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcaccagcuccagagcuacagggaucccugaccgguucagcggaucuggcuccgggaccgauuuuacacuuaccauuagccgccuggagcccgaagacuucgccguuuauuacugucaacaguauggaucuuccccuaucacauuuggccagggcaccagacucgagauuaaacggacgguggccgcucccagcguguucaucuuuccuccgucugaugaacagcugaaguccgggaccgccagcgucgugugccugcucaacaauuucuacccccgcgaggcuaaaguucaauggaagguggacaacgcccugcaguccggaaauucucaggagagcgucacagaacaggauuccaaagacagcaccuauucucuuuccagcacacugacccucucuaaggcggauuacgagaagcacaaaguguacgccugugaaguuacgcaucaaggccugagcuccccugugacaaagucuuuuaacagaggggagugc

SEQ ID NO: 38262 - RNA, 1314 nt, Artificial Sequence
  derived and/or modified sequence opt5 from Aselizuab_HeavyChain1
gaggugcagcuggucgaaagcggcgggggacucguucaacccggcgggucccugagacuuucuugcgccgcuagcggauucaccuuuuccacauacgccucuugggugcggcaggcgccuggcaaggggcuggaguggguggcuagcaucuccacgggaggcucuaccuauuacccggacagcgucaaaggccgcuucacaauuuccagagauaacgccaagaauacccucuaucugcagaacagccuucgggccgaagacacagcuguguacuauugugcccgcgauuacgacggguauuuugauuacuggggacagggcacccugguuacagugucuuccgcuagcaccaaagggcccucugucuucccucucgcccccugcuccagaagcacgucugaguccaccgcggcccugggaugucuggugaaggacuacuuuccugaacccguuacagugagcuggaacuccggcgcucucaccucugggguccacacauucccugccgugcugcaaagcuccggacuuuauagccugucuuccguggucaccguuccgagcucuagccucggcacgaaaacauauaccugcaauguggaucauaagcccuccaauacaaagguggacaaacgggucgagucuaaguacggcccucccuguccuagcugccccgcuccggaguuucuugggggaccuuccguguuccuguuucccccuaaacccaaggauacccugaucagccgcacccccgaaguuacauguguggucguggacguuucucaggaggauccugaagugcaguucaacugguacgucgacggcguggagguccacaaugccaaaacgaagccgagagaggaacaguuuaacuccaccuaucgggugguuagcgugcucacaguccugcaucaagauuggcugaaugggaaggaguacaaaugcaaggugucuaacaaaggacuccccuccagcauugaaaagaccaucuccaaagcgaagggccagccucgcgagccccagguuuauacacugccucccucucaggaagagaccaaaaaucaagugagccuuacgugucuggucaagggguucuacccguccgacauugccguggagugggaaucuaacggacagccugagaauaacuacaagacaacacccccugugcucgacagcgauggcuccuuuuuccuguauagcagacuuaccguugacaaaucucgguggcaggaaggcaaugucuucuccugcagcgugcacgaggcucugcauaaccacuacacccaaaagucucucucccugagccuggggaaa

SEQ ID NO: 38263 - RNA, 1311 nt, Artificial Sequence
  derived and/or modified sequence opt5 from Aselizuab_HeavyChain2
gaggugcagcuggucgaaagcggcgggggacucguucaacccggcgggucccugagacuuucuugcgccgcuagcggauucaccuuuuccacauacgccucuugggugcggcaggcgccuggcaaggggcuggaguggguggcuagcaucuccacgggaggcucuaccuauuacccggacagcgucaaaggccgcuucacaauuuccagagauaacgccaagaauacccucuaucugcagaacagccuucgggccgaagacacagcuguguacuauugugcccgcgauuacgacggguauuuugauuacuggggacagggcacccugguuacagugucuuccgcuagcaccaaagggcccucugucuucccucucgcccccugcuccagaagcacgucugaguccaccgcggcccugggaugucuggugaaggacuacuuuccugaacccguuacagugagcuggaacuccggcgcucucaccucugggguccacacauucccugccgugcugcaaagcuccggacuuuauagccugucuuccguggucaccguuccgagcucuagccucggcacgaaaacauauaccugcaauguggaucauaagcccuccaauacaaagguggacaaacgggucgagucuaaguacggcccucccuguccuagcugccccgcuccggaguuucuugggggaccuuccguguuccuuuuucccccuaaacccaaggauaccaucagccgcacccccgaaguuacauguguggucguggacguuucucaggaggauccugaagugcaguucaacugguacgucgacggcguggagguccacaaugccaaaacgaagccgagagaggaacaguuuaacuccaccuaucgggugguuagcgugcugacaguccuccaucaagauuggcugaaugggaaggaguacaaaugcaaggugucuaacaaaggacugcccuccagcauugaaaagaccaucuccaaagcgaagggccagccucgcgagccccagguuuauacacucccucccucucaggaagagaccaaaaaucaagugagccugacgugucuugucaagggguucuacccguccgacauugccguggagugggaaucuaacggacagccugagaauaacuacaagacaacacccccugugcuggacagcgauggcuccuuuuuccucuauagcagacugaccguugacaaaucucgguggcaggaaggcaaugucuucuccugcagcgugcacgaggcucugcauaaccacuacacccaaaagucucugucccucagccuggggaaa

SEQ ID NO: 38264 - RNA, 648 nt, Artificial Sequence
  derived and/or modified sequence opt5 from Aselizuab_LightChain1
gacauccagacccaaagccccuccucucugagcgccuccgugggcgauagagucacaauuacgugcaaggcuucucagagcguugacuacgauggggacuccuauaacugguaccagcagaaaccuggaaaggccccgaaacuccugaucuaugcggcuucuaaucuugagagcggcauucccucccgguucagcgggucuggauccggcaccgauuuuacacugaccaucagcucucuccaaccugaagacuucgccacauacuauugucagcaguccaacgaggaucccuggaccuuugggcagggaacaaagguggaaauuaaacgcaccguggccgcuccuagcgucuucaucuuucccccuucugacgagcaacugaaguccggcacggccagcgugguuugccuucugaauaacuucuacccgagagaagcuaaggugcaguggaaagucgauaaugcccuccaguccggcaacucucaggagagcgugaccgagcaagacuccaaggauagcacauauucucuguccagcacccugacacucucuaaagcggacuacgaaaagcacaaaguuuacgccugugaggugacccaucaggggcugagcucccccgucacgaagucuuuuaaucggggagaaugc

SEQ ID NO: 38265 - RNA, 1344 nt, Artificial Sequence
  derived and/or modified sequence opt5 from Atezolizumab_HeavyChain1
gaggugcagcuggucgaaagcggcgggggacucguucaacccggcgggucccugagacuuucuugcgccgcuagcggauucaccuuuuccgacucuuggauccacugggugcggcaggccccuggcaaggggcuggaguggguggcguggauuagcccguacggaggcuccacauauuacgcugauucugucaaaggccgcuucacgaucagcgccgacaccuccaagaacacagccuaucuccagaugaauagccugagagcugaagauaccgccguguacuauugugcucggcgccauuggcccgggggauuugacuacuggggccaggggacacuuguuaccgugucuuccgccagcacaaaaggaccuucugucuucccccuggcgccuuccagcaagucuaccuccggcgggacggccgcucucggaugccuggugaaagauuauuuucccgagccuguuaccgugagcuggaacuccggcgcccugacaucuggcguccacaccuucccggcugugcuccaaagcuccgggcuguacagccuuucuuccguggucacaguucccagcucuagccugggaacccagacguacauuuguaaugugaaccauaagccuuccaauacaaagguggacaaaaaggucgaacccaaaucuugcgauaagacccacacauguccucccugcccggccccugagcuccugggcgggcccagcguguuucuuuucccucccaaacccaaggacacccugaugaucuccagaaccccugagguuacauguguggucguggauguuagccaugaagacccggaggugaaguuuaacugguaugucgauggaguggaaguccacaaugcgaaaacgaagccccgggaggagcaguacgccucuaccuaucgcgugguuuccgugcucacaguccugcaccaggacuggcugaacggcaaagaauacaagugcaaagugagcaauaaggcucucccugcccccauugagaaaaccaucucuaaggcuaaggggcaaccuagagaaccccagguuuauacacugccgccuucccgggaggaaaugaccaaaaaccaggugagccuuacgugucuggucaagggauucuaccccuccgauaucgccguggagugggagucuaauggccagccugaaaacaauuauaaaacaacacccccugugcucgacagcgacggcuccuuuuuccuguacucuaaacuuaccguugauaagagccgcuggcaacaggggaacgucuuuuccugcagcgugaugcaugaggcccugcacaaucauuacacccagaagucucucucccugagccccggaaag

SEQ ID NO: 38266 - RNA, 642 nt, Artificial Sequence
  derived and/or modified sequence opt5 from Atezolizumab_LightChain1
gacauccagaugacccaaagccccuccucucugagcgccuccgugggcgauagagucacaauuacgugccgggcuucucaggacguuagcaccgccguggcgugguaccagcagaagccugggaaagcuccgaagcuccugaucuauuccgccucuuuccuuuacagcggagugcccucccgcuuuagcggcucuggguccggaacagauuucacccugacaauuagcucucuccaaccugaggacuuugccaccuauuacugucagcaguaucuguaccaccccgcuacauucggccaggggaccaaagucgaaaucaagagaacgguggccgcuccuuccguuuuuauuuuucccccuagcgaugagcaacuuaaaucuggaaccgccuccguggucugccugcucaacaauuucuauccgcgggaagcgaaggugcaguggaagguugacaacgcccugcagagcggcaauucccaggagucugugacagaacaagauagcaaagacuccaccuacagccugucuuccacacucacccugagcaaggcugauuacgagaaacauaaggucuaugccugugaggugacgcaccagggccuuucuagccccgugacaaaauccuucaaccgcggggaaugc

SEQ ID NO: 38267 - RNA, 1323 nt, Artificial Sequence
  derived and/or modified sequence opt5 from Atinumab_HeavyChain1
gaggugcagcuggucgaaagcggcgggggacucguucaacccggcgggucccugagacuuucuugcgccgcuagcggauucaccuuuuccaacuacuggaugucuugggugcggcaggccccuggcaaggggcuggaguggguggcgacaaucaaacaggacggaagccagaagaauuaugucgauuccgugaaaggccgcuucacgauuucuagagacaacgcuaagaauagccucuaccugcggcuuaacucccugcgcgccgaagauaccgccguuuauuacugugcuacagagcucuuugaccuguggggcagagggagccuggugaccgucucuuccgccagcacaaaaggaccgucuguguucccccucgcuccuugcucccggagcaccucugaauccacagccgcgcugggcugucuuguuaaggauuauuuucccgagccugugaccgucagcuggaacuccggggcccugacgucuggagugcacaccuuccccgcugugcuccaaagcuccggccuguacagccuuucuuccgucguuacagugccuagcucuagccuggggaccaagacauauaccugcaauguggaccauaaaccguccaauacgaaggucgauaaacgcguggagucuaaguacggacccccuugucccagcugcccugcccccgaauuucucggcggcccguccguuuuccuguuuccucccaaaccuaaggacacacugaugaucagcagaacccccgaggugacaugugucgugguugaugugucucaggaagaccccgagguccaguucaacugguacguggauggggucgaggugcacaaugcuaagaccaaaccucgggaggaacaguuuaacuccaccuaucgcguugugagcguccucacagugcugcaucaagacuggcuuaauggaaaggaauacaaaugcaagguuucuaacaaaggccugccguccagcauugagaagacgaucuccaaagccaaggggcagcccagagaaccucagguguauacccugcccccuucucaggaggagaugacaaagaaucaagucagccucaccugucuugugaaaggauucuaccccuccgauauugcgguggaaugggagucuaacggccagccggaaaauaacuauaagacaaccccucccguucuggacagcgacggguccuuuuuccucuacagccggcugacggucgauaaaucucgcuggcaggagggaaacguguucuccugcagcgugaugcacgaagcccugcauaaucacuauacacaaaagucucucucccugagccuuggcaaa

SEQ ID NO: 38268 - RNA, 642 nt, Artificial Sequence
  derived and/or modified sequence opt5 from Atinumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuaucaccuuuggccaggggacaaaacucgagauuaagagaaccguggcugcccccucuguguucaucuuuccuccguccgaugaacagcugaaaagcggaacggcgucugucgugugccugcucaacaauuucuauccccgggaggccaagguucaauggaaaguggacaacgcucugcaguccggcaauagccaggaguccgucaccgaacaggauucuaaggacagcacauacucccuuagcucuacccugacacucuccaaggccgauuaugagaaacacaagguguacgcuugugaaguuacccaucaaggccugagcucuccugugacgaaauccuuuaaccgcggggagugc

SEQ ID NO: 38269 - RNA, 1329 nt, Artificial Sequence
  derived and/or modified sequence opt5 from Atlizuab_HeavyChain1
gugcaacugcaagagagcggccccgggcucgucagaccuucccagacccugucucuuacaugcacgguuagcggauacuccaucaccucugaccacgccuggagcugggugcggcagccgcccggccgcgggcuggaauggauuggauauaucuccuacucuggcauuacaaccuauaacccuagccucaaguccagagugacacugcgggauaccagcaaaaaucaguucucucuucgccuguccagcgucacagcugccgacaccgcgguguacuauugugcuagaucucucgcccggacgaccgccgauuacugggggcaaggaucccugguuacagugagcucugcuuccaccaagggccccagcgucuuuccucuggcccccuccucuaaaagcacauccggcgggaccgcugcccucggaugccuggugaaggacuauuucccugagccgguuacggugagcuggaacucuggcgcgcuuacauccgggguccauaccuuucccgccgugcugcagagcucuggacucuacagccuguccucuguggucacaguuccuagcuccagccuuggcacccagaccuacaucuguaaugugaaccacaaacccucuaauacaaagguggauaagaaagucgaaccuaaguccugcgacaaaacgcauaccugucccccgugcccugcucccgagcugcucgggggaccuagcguguuccuguuuccucccaagcccaaagauacacugauuucucgcaccccggaaguuacauguguggucguggacguuucccacgaggaucccgaggugaaguucaacugguaugucgacggcguggaaguccauaaugccaagaccaaaccuagagaggaacaguacaacagcacguaucgggugguuuccgugcucacaguccugcaccaagauuggcuuaauggcaaggaguacaaaugcaaggugucuaacaaagcucugcccgccccuaucgagaagaccaucagcaaagcgaaggggcagccccgcgaaccgcagguuuauacccucccucccuccagagacgagcugacaaagaaucaggugucucuuaccugucuggucaaaggauuuuacccuagcgauauugccguggaaugggaguccaacggccaacccgaaaauaacuauaagacaacgccucccgugcucgacagcgacgggucuuucuuucuguacuccaaacugaccguugauaagagccgguggcagcagggaaaugucuucucuugcuccgugcacgaggcucuccauaaccacuacacacagaaaagccugucucuuagcccgggc

SEQ ID NO: 38270 - RNA, 639 nt, Artificial Sequence
  derived and/or modified sequence opt5 from Atlizuab_LightChain1
gacauccagacccaaagccccuccucucugagcgccuccgugggcgauagagucacaauuacgugccgggcuucucaggacaucagcuccuaccucaacugguaucagcagaagccugggaaagccccgaagcugcuuauuuacuauaccucucgccugcacagcggaguucccuccagauucagcggcucuggguccggaacagauuuuaccuucacaaucagcucucuccaaccugaggacauugcgaccuacuauugucagcagggcaauacacugcccuacaccuuugggcagggaacgaaaguggaaaucaagcggaccguggcugccccuuccgucuucaucuuucccccuagcgaugagcaacuuaaaucuggcacagccuccgugguuugccugcucaacaauuucuauccgcgcgaagcuaaggugcaguggaaggucgacaacgcccugcagagcggcaauucccaggagucugugaccgaacaagauagcaaagacuccacauacagccugucuuccacccucacgcugagcaaggcugauuacgagaaacauaagguuuaugccugugaggugacacaccaggggcuuucuagccccgucaccaaauccuuuaacagaggagaaugc

SEQ ID NO: 38271 - RNA, 792 nt, Artificial Sequence
  derived and/or modified sequence opt5 from Aurograb_SingleChain
auggccaaggugcagcugcuccaaagcgcuaccgaggucaaaaagcccggcgccuccguuaaagugucuugcaaggcguacggguauacauucacggacuacggaaucaccugggugagacaggcuccuggccaggggcuggaauggaugggauggauuagcgccuauaacggcuacacaaauuaugcccagaaauuucaagaucggaucaccaugacaaccgacgcuuccacaucuaccgccuacauggagcuucgcagccugagaccggaugacacggcuguccucuauugugcccgggaucgcgaagacgcgucccugcuuagagaugggcacuggggacagggcacccuggugacaguuucuagcggcgggggaggcuccgggggaggcgggagcggaggcggcgggucuggaggcgggggauccgagaccacacucacccagagccccggcacgcugucucuguccccuggggaacgggccacacucagcugccgcgcuucucagauuguguccagcuccuaccuggccugguaccaacagaagcccggacaggcuccuagacuucugaucuauggcgccucuagccgggcgaccggcauucccgaccgcuucuccgggagcggaucuggcacagauuuuacccucaccaucuccaagcuggagccugaggacuucgccgucuacuauugucagcauuacgggagcucuagcccguggacauccagaccccgggaucaaucugacaucaaacgcgcugccgcucuugaacaccaucaccaucaccac

SEQ ID NO: 38272 - RNA, 1350 nt, Artificial Sequence
  derived and/or modified sequence opt5 from Avelumab_HeavyChain1
gaggugcagcugcucgaaagcggcgggggacugguccaacccggcgggucccuuagacugucuugcgccgcuagcggauucaccuuuuccucuuacaucaugauguggguucggcaggccccuggcaaggggcucgagugggugagcuccauuuauccgucuggaggcaucacauucuacgcggacacggugaaaggccgcuuuaccauuagcagagauaacuccaagaauacacuguaucuucagaugaacagccugcgggcugaagacaccgccgucuacuauugugcccgcaucaaacucgggacagugaccacaguugauuacuggggacagggcacccuggugacggucucuuccgcuagcaccaaggggcccucuguguucccucuggcccccuccagcaaaucuacauccggaggcaccgcugcccucgggugccugguuaaggacuauuuuccugagcccgugacagucagcuggaacuccggagcgcuuaccucuggcgugcacacguucccugccgugcugcaaagcuccggccucuacagccugucuuccgucguuacagugccgagcucuagccuugggacccagacauacauuuguaaugugaaucauaagcccuccaacaccaaagucgauaagaaaguggaaccuaagucuugcgacaaaacccacacaugucccccuugccccgcuccggagcugcucggaggcccuagcguuuuucuguuucccccuaagcccaaggauacgcugaugaucuccagaacccccgaggugacaugugucgugguugacgugagccaugaagauccugaggucaaauucaauugguauguggacggggucgaagugcacaacgccaagaccaaaccgcgggaggagcaguacaauucuacauaucgcguuguguccguccucaccgugcugcaucaggauuggcuuaacggaaaggaauacaaaugcaagguuagcaauaaagcucugcccgccccuaucgagaagacgauuucuaaggcgaaaggccaacccagagaaccucagguguauacacugcccccgucccgggacgagcucaccaagaaccaggucagccuuaccugucuggugaaaggguucuacccuuccgauaucgccguggaaugggagucuaauggacagcccgagaacaauuauaagacaaccccucccguucucgacagcgacggcuccuuuuuccuguacucuaaacugacagucgauaagagccgcuggcaacagggcaacguguuuuccugcagcgugaugcacgaagcucuccacaaccauuacacgcagaagucucugucccuuagcccugggaaa

SEQ ID NO: 38273 - RNA, 648 nt, Artificial Sequence
  derived and/or modified sequence opt5 from Avelumab_LightChain1
cagagcgcccugacccaacccgcuuccgugucuggcagcccugggcaguccaucacaauuucuugcacgggaaccagcuccgacgucggcggguacaacuauguuucuugguaccagcagcacccgggaaaggcccccaaacucaugaucuaugaugugagcaauagaccuuccggcgugagcaaccgguucucuggguccaagagcggaaauacagcgucucugaccauuuccggccuucaagcugaggacgaagccgauuacuauuguagcucuuacacauccagcuccacccgcgucuuuggcacagggaccaaagugacgguucugggacagcccaaggccaacccuaccgugacacucuuucccccuucuagcgaggaacugcaggcuaauaaagccacccuugucugccugaucuccgacuucuauccgggcgcugugacaguugccuggaaggcggaugggagccccgugaaggccggagucgagaccacgaaaccuucuaagcaguccaacaauaaauacgcugccagcucuuaccucagccugacacccgaacaauggaagucccauagaucuuauagcugucaggugacccacgagggcuccacaguggagaaaaccgucgcuccuaccgaaugcagc

SEQ ID NO: 38274 - RNA, 1344 nt, Artificial Sequence
  derived and/or modified sequence opt5 from Bapineuzumab_HeavyChain1
gaggugcagcugcucgaaagcggcgggggacugguccaacccggcgggucccuuagacugucuugcgccgcuagcggauucaccuuuuccaacuacggcaugucuuggguucggcaggccccugggaagggacucgaguggguggcgagcauccgcuccggcggcgggagaacauauuacucugacaaugugaaaggacgguucacgauuagccgcgauaacuccaagaauacccuguaucuucagaugaacagccugagagcugaagacacagccgucuacuauugugugcgguacgaucacuauucuggcuccagcgacuacugggggcagggaacccucguuacagugucuuccgccagcaccaaaggcccgucugucuuuccccuggcuccuuccagcaaguccacaucugggggaaccgccgcucugggcugccucgugaaagauuacuuccccgagccuguuacggugagcuggaacuccggcgcccugaccagcgggguccauacauuucccgcggugcuucaaucuuccggacuguauagccucucuagcguggucaccguuccuuccucuagccugggcacacagaccuacaucuguaaugugaaucacaagccguccaacacgaagguggacaaaaaggucgaacccaaaagcugcgauaagacacauaccuguccucccugcccugcccccgagcuucucgggggaccgucuguguuccuguuuccucccaaaccuaaggacacacugaugauuucccgcacccccgagguuaccuguguggucguggauguuagccacgaagaccccgaggugaaguucaauugguaugucgauggcguggaaguccauaacgcuaaaacaaagccuagagaggagcaguacaauucuacguaucgggugguuuccgugcugaccguccuccaccaggacuggcugaacgggaaagaauacaagugcaaagugagcaauaaggcccuuccggcucccaucgagaaaacaauuuccaaggccaagggacaaccucgcgaaccccagguuuauacccugccucccucuagagaggaaaugaccaaaaaccaggugagccucacaugucuggucaagggcuuuuacccguccgauaucgcgguggagugggagucuaauggccagccugaaaacaacuacaaaacgacacccccugugcuugacagcgacggguccuucuuucuguauagcaagcucaccguugauaaaucucgguggcaacagggaaaugucuucuccugcagcgugaugcacgaggcccugcauaaccacuacacccagaagucucugucccucagccccggc

SEQ ID NO: 38275 - RNA, 657 nt, Artificial Sequence
  derived and/or modified sequence opt5 from Bapineuzumab_LightChain1
gacguggucaugacccagagcccccugucccucccuguuacaccgggcgagcccgccucuaucagcugcaaguccucucaaagccugcuugauuccgacgggaaaacguaccugaacuggcuccugcagaagccuggacagucuccccagagacuuauuuaucuggugagcaaacucgauuccggcgugccugaccgguucagcgggucuggauccggcaccgauuuuacacugaagaucagccgcgucgaagcugaggacguggggguuuacuauuguuggcaaggaacccacuuccccagaacauuuggccagggcaccaaaguggaaauuaagcggacagucgccgcgccuucuguguucaucuuuccgcccuccgaugagcagcucaagagcgggaccgcuucuguugugugccugcugaauaacuucuacccucgcgaagccaaaguccaguggaagguggacaaugcccuucaauccggaaacagccaggaguccgugacggagcaggauucuaaagacagcaccuauucccugagcucuacacucacccuguccaaggcugauuacgaaaaacauaaggucuaugccugugagguuacacaccagggccuuagcucucccgugaccaagagcuuuaauagaggggaaugc

SEQ ID NO: 38276 - RNA, 1338 nt, Artificial Sequence
  derived and/or modified sequence opt5 from Basiliximab_HeavyChain
cagcugcaacagagcggcaccgugcucgccagacccggggcuuccgucaagaugucuugcaaagccagcggauacuccuucacacgguauuggaugcacuggaucaagcagcgcccuggccaggggcuggaguggauuggagcgaucuacccgggcaacucugacacgagcuauaaucaaaaauuugaagggaaggcuaaacuuaccgccguuacauccgccucuaccgcuuacauggagcugagcucccucacacaugaagauagcgccguguauuacuguucuagagacuauggauacuacuucgauuuuuggggccagggcaccacacugaccguguccagcgcuucuacgaaggggcccuccgucuucccucuugcccccagcucuaaguccaccagcggaggcacagcggcccuggggugccucgugaaagacuauuuuccugagcccguuaccguguccuggaacucuggagcucugacaagcggcguccacaccuucccugccgugcugcaguccagcgggcucuacucucuguccagcguugugacggucccgucuagcucccuuggaacacagaccuauauuuguaaugugaaccauaagcccucuaauacaaaaguggauaagcgggucgaaccucccaaaagcugcgacaagacccacaccuguccucccugcccggcuccugagcugcucggcggccccuccguuuuucuguucccucccaagcccaaagauacacuuaugaucagccgcacgccugaggugaccuguguggucguggacguuucucaugaagauccggaggugaaguuuaacugguacgucgacgggguggaaguucacaaugccaaaacaaagcccagagaggagcaauauaacuccaccuaccggguggucagcgugcugacaguccuccaccaggauuggcugaauggaaaagaauauaagugcaaagugucuaacaaggcgcugccugcccccauugagaagaccaucuccaaagcuaagggccagccucgcgaaccccagguuuacacgcucccgccuagcagagacgagcugacaaagaaucaagugucccuuaccugucuggucaagggguucuaccccucugauaucgccguggaaugggagagcaacggacagccugagaauaacuauaaaaccacacccccuguucucgacuccgacggcagcuuuuuccuguacucuaaacuuaccguggauaagucccgguggcagcaagggaaugucuuuagcugcucugugaugcaugaagcucugcacaaccauuauacacagaaaucccucagccugucucccggaaag

SEQ ID NO: 38277 - RNA, 630 nt, Artificial Sequence
  derived and/or modified sequence opt5 from Basiliximab_LightChain
cagaucgugagcacccaaucccccgccauuaugucugcuagcccuggcgagaaggucacaaugacgugcuccgccucuagcuccagaucuuacaugcagugguaucagcagaaaccggggaccagccccaagcgguggaucuacgacacauccaaacuggcgagcggaguuccugcucgcuucucuggcuccgggagcggaaccucuuauucccucacaauuagcucuauggaagccgaggaugccgcuaccuacuauugucaccaaagauccagcuacacauuuggcgggggaaccaagcuggaaaucaaacggacgguggccgcucccuccguguucauuuuuccucccucugacgagcagcuuaagagcggcaccgccuccgucgugugccugcucaacaauuucuauccucgcgaagcgaagguucaguggaaaguggauaacgcccugcagagcggcaauucucaagaguccgucacagagcaggacagcaaggauucuaccuacagccuuuccucuacacugacccucagcaaagcugacuacgaaaagcauaaaguguaugccugugagguuacgcaccaggggcuguccagcccggugacaaagucuuuuaacagaggagaa

SEQ ID NO: 38278 - RNA, 1350 nt, Artificial Sequence
  derived and/or modified sequence opt5 from Bavituximab_HeavyChain
gaggugcagcugcaacagagcggccccgaacucgagaagccuggggccuccgucaaacugucuugcaaggcuagcggauacuccuucaccggcuauaacaugaauuggguuaaacagucucacgggaaaagccuugaauggaucggacauauugacccguacuauggcgauacauccuacaaccagaaauuuagagggaaggccacgcugaccguggacaagucuagcuccacagcguauaugcaacucaaaagccugaccucugaggauuccgcuguguacuauugugucaagggaggcuacuacggccacugguauuucgacguguggggagccggaacaaccguuacagugagcucugccuccaccaaaggccccagcgucuuuccucuugcucccucuuccaagagcacguccgggggaaccgccgcucugggcugccucgugaaagauuacuucccugaacccguuacagugucuuggaauagcggggcccugaccuccggaguccauacauuuccugcggugcugcagagcucuggccucuauucccugagcucuguggucaccguuccgagcuccucucuuggcacgcagacauacaucuguaacgugaaucacaagcccagcaacaccaagguggacaaaaaggucgagccuaaauccugcgauaagacacauaccugucccccuugccccgccccggagcugcucgggggaccuagcguguuccuguuucccccuaaacccaaggacacccuuaugauuucucggacacccgaaguuacguguguggucguggauguuucccacgaggacccugaagugaaauucaauugguaugucgauggcguggagguccacaacgcuaagaccaagccgcgcgaggaacaguacaauagcacauauagagugguuucugugcugaccguccuccaucaagacuggcugaacgggaaagaguacaagugcaaaguguccaauaaggcccugcccgcuccuaucgaaaagacaauuagcaaggccaagggacagccccgggagccucagguuuacacccuucccccgucccgcgaugaacugacgaaaaaccaggugucucuuacaugucuggucaagggcuuuuauccuagcgacaucgcgguggagugggaguccaaugggcaacccgaaaacaauuacaaaaccaccccucccgugcucgacucugaugggagcuucuuucuguauuccaagcucacaguugacaaaagcagauggcagcagggcaacgucuucucuugcuccgugaugcacgaggcccugcauaaccacuacacccaaaagagccucucucuguccccuggcaag

SEQ ID NO: 38279 - RNA, 642 nt, Artificial Sequence
  derived and/or modified sequence opt5 from Bavituximab_LightChain
gacauccagaugacccaaagccccuccucucugagcgccucccucggcgagagagugucucugacaugccgggcuagccaggauauuggguccucucuuaacuggcugcagcagggaccugacggcacgaucaagcgccucauuuacgccaccagcucccuggauagcggggucccgaaaagauucucuggaucccggagcggcucugacuauucccuuacaaucagcucucuggaauccgaggauuuuguugacuacuauugucuccaauacgugagcucucccccuaccuucggggcgggaacaaagcuggaacugaaacgcgcugaugccgcccccuccguguuuauuuucccucccagcgacgagcagcucaaguccggcaccgcuagcgucgugugccugcuuaauaacuuuuauccuagagaagccaaaguucaguggaagguggauaaugcucugcagucuggcaacucccaagagagcgucacagagcaggacucuaaggauagcaccuacucccucucuagcacgcugacccuuuccaaagccgacuaugaaaagcacaaaguguacgcgugugagguuacacaucaggggcugagcucuccggugaccaaguccuucaaucggggagaaugc

SEQ ID NO: 38280 - RNA, 624 nt, Artificial Sequence
  derived and/or modified sequence opt5 from Bavituximab_LightChain_variant_8734_L
gacauccagaugacccaaagccccuccucucugagcgccucccucggcgagagagugucucugacaugccgggcuagccaggauauuggguccucucuuaacuggcugcagcagggaccugacggcacgaucaagcgccucauuuacgccaccagcucccuggauagcggggucccgaaaagauucucuggaucccggagcggcucugacuauucccuuacaaucagcucucuggaauccgaggauuuuguugacuacuauugucuccaauacgugagcucucccccuaccuucggggcgggaacaaagcuggaacugaaacgcgcugaugccgcccccuccguguuuauuuucccucccagcgacgagcagcucaaguccggcaccgcuagcgucgugugccugcuuaauaacuuuuauccuagagaagccaaaguucaguggaagguggauaaugcucugcagucuggcaacucccaagagagcgucacagagcaggacucuaaggauagcaccuacucccucucuaaagccgacuaugaaaagcacaaaguguacgcgugugagguuacgcaucaggggcugagcuccccggugaccaagagcuucaaucggggagaaugc

SEQ ID NO: 38281 - RNA, 1368 nt, Artificial Sequence
  derived and/or modified sequence opt5 from Begelomab_HeavyChain1
caggugcaacugcagcagagcggcgccgagcucgucaagcccggggcuuccguuaaacugucuugcaaggccagcggauacaccuucagauccuaugacaucaacugggugcggcagcgcccugaacaaggccuugaguggauuggguggaucuuuccgggagauggcucuacaaaauacaaugaaaaguucaaagggaaggcgacgcugaccacagacaagagcuccucuaccgcuuauaugcagcucagcagacugacauccgaggauagcgccguguacuuuugugcccgguggaccgucgugggacccggcuauuucgacguuuggggcgcugggacaaccgugacggucucuuccgccaaaaccacaccucccagcguguacccucuugcucccggaugcggcgauaccacagggucuuccguuacccugggaugucucgugaagggcuauuuuccugaaagcgucacggugacauggaacucugggucccugagcuccucugugcacaccuucccggcccugcuccagagcggacuguacacaauguccagcucugucaccguucccuccagcaccuggccuucucagacagugacgugcagcguggcgcaucccgccuccucuaccacagucgacaaaaagcuggagccuagcggccccauuuccaccaucaauccguguccucccugcaaagagugucacaagugcccugcucccaaccuugaaggcgggcccagcguguuuauuuucccuccgaauaucaaggauguucucaugaucucucugacacccaaagugaccugugucgugguugacguguccgaggaugacccugauguccaaauuagcugguuugugaacaaugucgaagugcauacggcccagacacagacccaccgcgaggacuacaacucuaccaucagaguuguguccacacuucccauucagcaucaagauuggaugagcggaaaggaguucaaaugcaaggucaauaacaaagaccugccuucccccaucgaacggaccauuucuaagaucaaaggccucgugcgcgcuccgcagguuuauauucugccucccccugccgagcagcugagcagaaaggacgugucccucacaugucuggucgugggguuuaaucccggagauaucucuguggaauggacgagcaacggccacaccgaggaaaauuacaaggacacagcgccuguucuugauuccgacgggagcuauuucaucuacucuaaacugaacaugaagaccuccaaaugggagaagacagauagcuuuucuugcaauguccggcacgagggacucaaaaacuauuaccugaagaagaccauuucccgcagccccggcaaa

SEQ ID NO: 38282 - RNA, 639 nt, Artificial Sequence; identical to SEQ ID NO: 38220
  derived and/or modified sequence opt5 from Begelomab_LightChain1

SEQ ID NO: 38283 - RNA, 1353 nt, Artificial Sequence
  derived and/or modified sequence opt5 from Benralizumab_HeavyChain1
gaggugcagcugguccaaagcggcgccgaaguuaagaaacccggggcuuccgugaaggugucuugcaaagccagcggauacaccuucacauccuaugucauccacugggugagacagcggccuggccaggggcucgcguggaugggauacauuaacccguauaaugacggcacgaaguacaacgagcgcuuuaaagggaagguuaccaucacaucugauagaagcaccuccacaguguauauggaacugucuagccuucgguccgaggacaccgcugucuaccuguguggacgcgaaggcauuagauauuacggccuccugggggauuacuggggacagggcacacuugugaccguuagcucugccuccacgaaggggcccagcguguucccucuggcccccucuuccaaaagcaccucuggaggcacagcugcccucgggugccuggucaaggacuauuuuccugagcccgugaccguguccuggaauagcggagcucugacauccggcguccauaccuucccugccguucuccaaucuagcggccuguacucccuuagcucuguggugacggucccguccagcucucuggggacacagaccuauaucuguaacgugaaucacaaacccagcaacacaaagguugauaaaaagguggagccuaaguccugcgacaaaacccauaccugucccccuugccccgcgccggaacuccugggaggcccuucugucuuucuuuuucccccuaagcccaaagauacacugaugauuagccggacgcccgaggugaccuguguuguggucgacgugucccacgaagauccugaggucaaguucaauugguacguggacgggguugaggugcauaacgccaaaacaaagccgcgcgaggaacaguauaauagcaccuacagagucgugucuguucucacagugcugcaccaggauuggcugaacggaaaagaauauaagugcaaggucuccaauaaagcucuccccgccccuaucgagaagaccaucagcaaagcuaagggccaaccccgggaaccucagguguacacgcugcccccgucucgcgacgagcuuaccaaaaaccaggugucccugacaugucucguuaagggguucuacccuagcgauauugccgucgagugggaauccaauggacagcccgagaacaauuauaagaccacaccucccgugcuggacucugacggcagcuuuuuccuuuacuccaaacugaccguggauaagucuagauggcaacagggcaacgucuuuagcugcuccgugaugcacgaagcgcuccauaaccacuauacacagaaaagccugucucuguccccugggaag

SEQ ID NO: 38284 - RNA, 642 nt, Artificial Sequence
  derived and/or modified sequence opt5 from Benralizumab_LightChain1
gacauccagaugacccaaagccccuccucucugagcgccuccgugggcgauagagucacaauuacgugcgggaccucugaggacaucauuaacuaccucaauugguaucagcagaagccuggaaaagcuccgaagcugcuuaucuaccacacaagccggcugcaguccggcguucccucucgcuucagcggguccggaagcggcaccgauuuuacacucaccauuucuucccugcaaccugaagacuucgccacauauuacugucagcagggguauacccuucccuacacguuuggacagggcaccaaaguggagaucaagagaacaguggcggcuccuagcgucuucaucuuucccccuucugaugaacaacugaaauccggcaccgccagcgugguuugccuccugaacaauuucuauccgcgggaggccaaggugcaguggaaggucgacaacgcucugcagucuggaaauucccaggaaagcgugacagagcaagauuccaaagacucuaccuacagccucuccagcacgcugacacuuucuaaggccgauuacgagaaacauaagguuuaugcuugugaagugacccaccaggggcuguccagccccgucacaaaaucuuuuaaccgcggcgagugc

SEQ ID NO: 38285 - RNA, 1329 nt, Artificial Sequence
  derived and/or modified sequence opt5 from Betalutin_HeavyChain1
gaaauccagcugcaacagagcggccccgaacucgugaagccuggggccuccgucaaaguuucuugcaaggcuagcggauacuccuucaccgacuauaacauguacugggugaaacagucucacggcaagagccuggaguggauuggguauaucgauccguacaauggagacacaacguauaaccagaaauuuaagggcaaggccacccuuacaguggauaaauccucuagcaccgcguucauucaucugaauagccucacaagcgaagacucugcugucuacuauugugccagaucccccuacgggcacuacgccauggauuauuggggacaaggcaccagcgugacaguuucuuccgcuaagaccacgccucccagcguguacccucuggcccccggcucugcugcccagaccaacuccauggucacacuugggugccuggugaaaggauauuuuccugagccgguuaccgugacauggaauagcggcucccucucuagcgggguccauaccuuccccgcggugcugcaguccgaccuguacacgcucuccucuuccgugacagucccuagcucuaccuggcccagcgaaacaguuaccuguaacguggcccacccugcuuccucuaccaagguggauaaaaagaucgucccccgggacugcggauguaagccgugcauuuguacagugccugagguuagcuccguguuuaucuuucccccuaaacccaaggauguccugacgaucacccuuacacccaaagugaccugcguuguggucgacauuagcaaggaugacccugaggugcaguucucuugguucgucgaugacguggaaguucauacagcccaaacccagccgcgcgaggaacaguuuaauuccacguucagaagcgugucugagcugcccaucaugcaccaggacuggcucaacggcaaagaguuuaagugucgggucaauuccgcugccuucccugcgcccauugaaaagacaaucagcaagaccaaggggcgcccuaaagcuccccaaguguauaccauuccgccucccaaggagcagauggccaaagauaagguuucccugacaugcaugaucaccgacuuuuucccugaagauauuacaguggaguggcaguggaacggacaacccgccgaaaauuacaaaaacacgcagccuaucauggacaccgauggcucuuauuucgucuacagcaaacuuaaugugcagaaguccaacugggaggcuggcaauacauuuaccuguucugugcugcacgaggggcuccauaaccaccauacagagaaaagccugucccacagccccggaaag

SEQ ID NO: 38286 - RNA, 642 nt, Artificial Sequence
  derived and/or modified sequence opt5 from Betalutin_LightChain1
gacaucgugaugacccagagccacaagcugcucuccacaucugucggcgauagaguuagcauuacgugcaaagccucccaagacgugucuaccgcuguggauugguaccagcagaagcccgggcagagcccuaaacugcuuaucaacugggccuccacacggcauaccggagucccggaccgcuucacaggcucugggagcggaaccgauuauacacugaccauuuccagcaugcaagcggaggaccucgcucuguacuauuguagacagcacuacucuacgcccuuuaccuucggcuccgggacaaaacuugaaaucaagcgggccgaugccgcuccuaccgugagcauuuuucccccuucuuccgagcagcugacaagcggaggcgccucuguugugugcuuccucaauaacuuuuaucccaaggacaucaaugucaaguggaaaaucgauggcuccgaacgccagaacggggugcugaauagcuggaccgaccaagauuccaaggacucuacguacagcauguccagcacacugacccucacaaaagaugaguaugaaagacauaacucuuacaccugugaggcuacccacaagacauccacgagcccuauuguuaaaucuuucaaucggaacgagugc

SEQ ID NO: 38287 - RNA, 1344 nt, Artificial Sequence
  derived and/or modified sequence opt5 from Bevacituzuab_HeavyChain1
gaggugcagcuggucgaaagcggcgggggacucguucaacccggcgggucccugagacuuucuugcgccgcuagcggauacaccuucacaaacuauggcaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcaaaauucccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaguccucuggccuuuauagccuguccagcguggucacaguucccucuuccagccucgggacccagacauacauuuguaaugugaaccauaagccuucuaauaccaaaguggauaagaaagucgagcccaagagcugcgacaaaacccacacauguccucccugcccggcuccugagcugcuuggaggccccuccguguuccuguuuccucccaagcccaaggauacgcucaucucucgcaccccugaaguuacauguguggucguggacguuagccaugaggauccggaagugaaauucaacugguaugucgacgggguggagguccacaaugccaagaccaaacccagagaggaacaguacaacuccacauaucgggugguuagcgugcugaccguccugcaccaggauuggcucaauggaaaggaguacaaaugcaaggugucuaacaaagcgcugccugcccccauugaaaagacgaucuccaaggcuaaaggccaaccucgcgagccccagguuuacacacuuccgccuagcagagaagagaccaagaaucaggugucucugaccugucucgucaaaggguuuuaucccuccgacauugccguggagugggaaagcaacggacagccugagaauaacuacaagacaacacccccugugcuggauuccgacggcucuuucuuucuuuauagcaaacugaccguugacaagucccgguggcaacagggcaacgucuucucuugcagcgugcaugaagcucuccacaaucauuacacgcagaagucccugagccugucucccgggaaa

SEQ ID NO: 38288 - RNA, 639 nt, Artificial Sequence
  derived and/or modified sequence opt5 from Bevacituzuab_LightChain1
gacauccagacccaaagccccuccucucugagcgccuccgugggcgaucgggucacaauuacgugcucugcuagccaggacaucuccaacuaccucaauugguaucagcagaaaccugggaaagccccgaagguucugauuuacuucaccucuagccuucacuccggagugcccagccgguuuucuggcuccgggagcggaacagauuucacccugacaaucucuucccuccaaccugaggacuuugcgaccuauuacugucagcaguauagcacagugcccuggaccuucggccaggggacgaaagucgaaauuaagcgcaccguggcugccccuucuguuuuuaucuuucccccuuccgaugagcaacugaaaagcggaacagccuccguggucugccuucugaacaauuucuacccgagagaagcuaaggugcaguggaagguugacaacgcccuccagucuggcaauagccaggaguccgugaccgaacaagauagcaaagacucuacauauucccugagcucuacccugacgcucagcaaggcugauuacgagaaacauaaggucuacgccugugaggugacacaccagggccuguccucucccgugaccaagagcuucaacagaggggaaugc

SEQ ID NO: 38289 - RNA, 639 nt, Artificial Sequence
  derived and/or modified sequence opt5 from Bevacizumab_154-aspartic_acid_LightChain
gacauccagaugacccaaagccccuccucucugagcgccuccgugggcgaucgggucacaauuacgugcucugcuagccaggacaucuccaacuaccucaauugguaucagcagaaaccugggaaagccccgaagguucugauuuacuucaccucuagccuucacuccggagugcccagccgguuuucuggcuccgggagcggaacagauuucacccugacaaucucuucccuccaaccugaggacuuugcgaccuauuacugucagcaguauagcacagugcccuggaccuucggccaggggacgaaagucgaaauuaagcgcaccguggcugccccuucuguuuuuaucuuucccccuuccgaugagcaacugaaaagcggaacagccuccguggucugccuucugaacaauuucuacccgagagaagcuaaggugcaguggaagguugacaacgccgaucagucuggcaauagccaggaguccgugaccgaacaagacagcaaagauucuacauauucccucagcucuacccugacgcugagcaaggcugacuacgagaaacauaaggucuacgccugugaggugacacaccagggccucuccucucccgugaccaagagcuucaacagaggggaa

SEQ ID NO: 38290 - RNA, 639 nt, Artificial Sequence; identical to SEQ ID NO: 38289
  derived and/or modified sequence opt5 from Bevacizumab_154-substitution_deriv_LightChain

SEQ ID NO: 38291 - RNA, 672 nt, Artificial Sequence
  derived and/or modified sequence opt5 from Bevacizumab_180-serine_HeavyChain
gaggugcagcuggucgaaagcggcgggggacucguucaacccggcgggucccugagacuuucuugcgccgcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaacucccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugucccaaucuagcggccuguauucccuuagcucuguggucacaguucccuccagcucucuggggacccagacauacauuuguaaugugaaucauaagccuagcaauaccaaaguggauaagaaagucgagcccaag

SEQ ID NO: 38292 - RNA, 672 nt, Artificial Sequence; identical to SEQ ID NO: 38291
  derived and/or modified sequence opt5 from Bevacizumab_180-substitution_deriv_HeavyCahin

SEQ ID NO: 38293 - RNA, 1359 nt, Artificial Sequence
  derived and/or modified sequence opt5 from Bevacizumab_beta_HeavyChain1
gaggugcagcuggucgaaagcggcgggggacucguucaacccggcgggucccugagacuuucuugcgccgcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaacucccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaauccucuggccuuuauagccuguccagcguggucacaguucccucuuccagccucgggacccagacauacauuuguaaugugaaucauaagccuucuaauaccaaaguggauaagaaagucgagcccaagagcugcgacaaaacccacacauguccucccugcccggcuccugagcugcuuggaggccccuccguguuccuguuuccucccaagcccaaggauacgcucaugaucucucgcaccccugaaguuacauguguggucguggacguuagccaugaggauccggaagugaaauucaacugguaugucgacgggguggagguccacaaugccaagaccaaacccagagaggaacaguacaacuccacauaucgggugguuagcgugcugaccguccugcaccaggauuggcucaauggaaaggaguacaaaugcaaggugucuaacaaagcgcugccugcccccauugaaaagacgaucuccaaggcuaaaggccaaccucgcgagccccagguuuacacacuuccgccuagcagagaagagaugaccaagaaucaggugucucugaccugucucgucaaaggguuuuaucccuccgacauugccguggagugggaaagcaacggacagccugagaauaacuacaagacaacacccccugugcuggauuccgacggcucuuucuuucuuuauagcaaacugaccguugacaagucccgguggcaacagggcaacgucuucucuugcagcgugaugcaugaagcucuccacaaucauuacacgcagaagucccugagccugucucccgggaaa

SEQ ID NO: 38294 - RNA, 642 nt, Artificial Sequence
  derived and/or modified sequence opt5 from Bevacizumab_beta_LightChain1
gacauccagaugacccaaagccccuccucucugagcgccuccgugggcgaucgggucacaauuacgugcucugcuagccaggacaucuccaacuaccucaauugguaucagcagaaaccugggaaagccccgaagguucugauuuacuucaccucuagccuucacuccggagugcccagccgguuuucuggcuccgggagcggaacagauuucacccugacaaucucuucccuccaaccugaggacuuugcgaccuauuacugucagcaguauagcacagugcccuggaccuucggccaggggacgaaagucgaaauuaagcgcaccguggcugccccuucuguuuuuaucuuucccccuuccgaugagcaacugaaaagcggaacagccuccguggucugccuucugaacaauuucuacccgagagaagcuaaggugcaguggaagguugacaacgcccuccagucuggcaauagccaggaguccgugaccgaacaagauagcaaagacucuacauauucccugagcucuacccugacgcucagcaaggcugauuacgagaaacauaaggucuacgccugugaggugacacaccagggccuguccucucccgugaccaagagcuucaacagaggggaaugc

SEQ ID NO: 38295 - RNA, 687 nt, Artificial Sequence
  derived and/or modified sequence opt5 from Bevacizumab_FcDomain
agcugcgacaagacccacacaugucccccuugcccggcccccgagcugcucggcgggccuuccguguuccuguuucccccuaaacccaaggauacgcuuaugaucucuagaaccccugaagucacauguguugugguggacgucagccaugaggauccggaagugaaauucaacugguacguugacggaguggagguccacaaugcuaagaccaaaccccgggaggaacaguauaacuccacauaccgcgugguuucugugcugaccguccuccaucaagauuggcugaauggcaaggaguauaagugcaaagugagcaacaaggcccuuccugcgcccauugaaaagacaaucuccaaggcuaaagggcagccuagagagccccagguguacacccugccgccuucucgggacgaacucacgaagaaucaggucagccugaccugucugguuaagggauuuuaucccuccgauauugccguggagugggagagcaacggccaaccugaaaauaacuacaaaacaaccccucccgugcucgacucugauggguccuucuuucuguauagcaaacuuacagucgacaaaucucgcuggcagcagggaaauguguucuccugcagcguuaugcacgaggcccugcauaaccacuacacccagaagucucucucccugagccccggcaaa

SEQ ID NO: 38296 - RNA, 672 nt, Artificial Sequence
  derived and/or modified sequence opt5 from Bevacizumab_HeavyChain
gaggugcagcuggucgaaagcggcgggggacucguucaacccggcgggucccugagacuuucuugcgccgcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaacucccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaauccucuggccuuuauagccuguccagcguggucacaguucccucuuccagccucgggacccagacauacauuuguaaugugaaucauaagccuucuaauaccaaaguggauaagaaagucgagcccaag

SEQ ID NO: 38297 - RNA, 1428 nt, Artificial Sequence
  derived and/or modified sequence opt5 from Bevacizumab_HeavyChain_variant1
gccagcgcuaccaugggcugguccugcaucauucuguuccucguggccacagcgacggggguccacucugagguucagcugguggaaagcggaggcgggcuugugcaacccggaggcucccugagacucucuugugcugccagcggguacaccuuuacaaacuauggaaugaauuggguccggcaggccccuggcaagggccuggagugggugggguggaucaacaccuacacaggagaaccgaccuaugcugccgacuucaaacgcagauuuacauucucccuugauaccucuaagagcacggcuuaccugcagaugaauagccuccgggccgaggacaccgcgguuuauuacugcgccaaauauccccauuacuacggcuccucucacugguauuuugaugugugggggcagggaacacuggucaccguguccagcgcuucuacaaagggcccuuccguuuucccccuggccccuagcucuaaauccaccagcgggggaacggcugcccucggcugucuggugaaggacuacuuucccgaaccugucacaguguccuggaacucuggcgcgcuuaccagcggggugcauacauucccggccguccugcaauccagcggacucuauucucuguccagcguugugaccgugcccucuagcucccuuggcacccagacauacauuugcaaugucaaccacaagccuucuaauacgaaaguggauaagaaaguugagcccaagagcugugacaaaacccauacaugcccucccuguccggcuccugagcugcucgggggacccuccguguuucuguucccucccaagcccaaggauacccugaugaucagccgcacaccugaagugaccugcgucguuguggacgucucucacgaggauccggaagugaaauuuaacugguaugucgacggcguggagguucacaaugccaagacgaaacccagagaggaacaguacaacuccacauaucggguggucagcgugcucaccguucugcaucaggauuggcuuaaugggaaggaguacaaauguaaggugucuaacaaagcucugccugcccccauugaaaagaccaucuccaaggccaaaggacaaccucgcgagccccaggucuacacacucccgccuagcagagaagagaugaccaagaaucaggugucccugacaugccuugugaaaggcuucuaucccucugacaucgcuguugagugggaaagcaacggccagccugagaauaacuacaagacgacacccccuguccuggauuccgacgggucuuucuuucucuauagcaaacugaccguggacaagucccgguggcaacagggaaacguguucagcuguucugucaugcacgaagcgcugcauaaucacuacacccagaagucccucagccugucucccggcaaa

SEQ ID NO: 38298 - RNA, 369 nt, Artificial Sequence
  derived and/or modified sequence opt5 from Bevacizumab_HeavyChain_V-Region
gaggugcagcuggucgaaagcggcgggggacucguucaacccggcgggucccugagacuuucuugcgccgcuagcggauacaccuucacaaauuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaacucccuucgggccgaggacacagcugucuauuacugugccaaauauccccacuacuacgggucuagccauugguauuucgauguguggggacagggcacccugguuacgguguccagc

SEQ ID NO: 38299 - RNA, 717 nt, Artificial Sequence
  derived and/or modified sequence opt5 from Bevacizumab_LightChain1
gccagcaagcuggcuaccaugggcugguccugcaucauucucuuccugguggccacagcgacggggguccacucugacauccagaugacccaaagccccuccucucuuagcgcuuccguuggagauagagugacaauuaccugucgggccucucaggacaucagcuccuaccugaacugguaucagcagaaaccuggcaaggccccgaaacuccugauuuacuauacaagccgccuucauucuggggugcccuccagauuuagcggaucuggcuccgggaccgauuucacauuuaccaucagcucucugcaaccugaggacaucgcuacguacuauugccagcagggaaauacccuccccuacacauucggccagggcaccaaggucgaaauuaaacggacaguggccgcuccuuccguuuuuaucuuucccccuagcgaugagcaacugaaguccgggaccgccucuguggucugucugcucaacaauuucuauccgcgcgaagcgaaggugcaguggaaaguugacaacgcccugcagagcggaaauucccaggagagcgugacggaacaagauucuaaggacuccacauacagccuuucuagcacccugacacucuccaaagcugauuacgagaagcacaaagucuaugccugcgaggugacccaucagggccugucuagccccgugaccaaguccuucaacagaggggaaugu

SEQ ID NO: 38300 - RNA, 711 nt, Artificial Sequence
  derived and/or modified sequence opt5 from Bevacizumab_LightChain2
gccagcgcuaccaugggcugguccugcaucauucuguuccucguggccacagcgacggggguccacucugacauccagaugacccaaagccccuccucucugagcgcuuccguuggagauagagugacaauuaccuguucugccagccaggacaucuccaacuaccuuaauugguaucagcagaagccuggcaaagccccgaaggugcugauuuacuuuacaagcucucuccauuccgggguccccagccgguucucuggauccggcagcgggaccgauuuuacacugaccaucucuucccuucaaccugaggacuucgcuacguauuacugccagcaguauagcaccgugcccuggacauuuggacagggcaccaaaguugaaaucaagcgcacaguggccgcuccuuccgucuucauuuuucccccuucugaugagcaacugaaaagcggcaccgccuccgugguuugucuccugaacaauuucuacccgagagaagcgaaggugcaguggaaggucgacaacgcccugcagagcggaaauucucaggaguccgugacggaacaagauagcaaagacucuacauauagccucuccucuacccugacacuuagcaaggcugauuacgagaaacacaagguguacgccugcgaggucacccaucaggggcuguccagccccguuaccaaaucuuuuaaccggggcgaaugu

SEQ ID NO: 38301 - RNA, 642 nt, Artificial Sequence; identical to SEQ ID NO: 38294
  derived and/or modified sequence opt5 from Bevacizumab_LightChain

SEQ ID NO: 38302 - RNA, 324 nt, Artificial Sequence
  derived and/or modified sequence opt5 from Bevacizumab_LightChain_VJ-Region
gacauccagaugacccaaagccccuccucucugagcgccuccgugggcgauagagucacaauuacgugcucugcuagccaggacaucuccaacuaccucaauugguaucagcagaagccugggaaagccccgaagguucugauuuacuucaccucuagccuucacuccggagugcccagccgguuuucuggcuccgggagcggaacagauuucacccugacaaucucuucccuccaaccugaggacuuugcgaccuauuacugucagcaguauagcacagugcccuggaccuucggccaggggacgaaagucgaaauuaagcgc

SEQ ID NO: 38303 - RNA, 321 nt, Artificial Sequence
  derived and/or modified sequence opt5 from Bevacizumab_LightChain_V-Region
gacauccagaugacccaaagccccuccucucugagcgccuccgugggcgauagagucacaauuacgugcucugcuagccaggacaucuccaacuaccucaauugguaucagcagaagccugggaaagccccgaagguucugauuuacuucaccucuagccuucacuccggagugcccagccgguuuucuggcuccgggagcggaacagauuucacccugacaaucucuucccuccaaccugaggacuuugcgaccuauuacugucagcaguauagcacagugcccuggaccuucggccaggggacgaaagucgaaauuaag

SEQ ID NO: 38304 - RNA, 369 nt, Artificial Sequence; identical to SEQ ID NO: 38298
  derived and/or modified sequence opt5 from Bevacizumab-rhuMAb-VEGF_HeavyChain_gamma1-Chain_VDJ-Region

SEQ ID NO: 38305 - RNA, 321 nt, Artificial Sequence; identical to SEQ ID NO: 38303
  derived and/or modified sequence opt5 from Bevacizumab-rhuMAb-VEGF_LightChain_VJ-Region

SEQ ID NO: 38306 - RNA, 1341 nt, Artificial Sequence
  derived and/or modified sequence opt5 from Bevacizumab_gamma1-Chain
gaggugcagcuggucgaaagcggcgggggacucguucaacccggcgggucccugagacuuucuugcgcugcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaacucccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaauccucuggcagccuuuccagcguggucacaguucccucuuccagccuggggacccagacauauauuuguaaugugaaucauaagccuucuaauaccaaaguggauaagaaagucgagcccaagagcugcgacaaaacccacacauguccucccugcccggcuccugagcuccugggaggccccuccguguuccuuuuuccucccaagcccaaggauacgcugaugaucucucgcaccccugaaguuacauguguggucguggacguuagccaugaggauccggaagugaaauucaacugguacgucgacgggguggagguccacaaugccaagaccaaacccagagaggaacaguauaacuccuacgugguuagcgugcucacaguccugcaccaggauuggcugaauggaaaggaguauaaaugcaaggugucuaacaaagcgcucccugcccccauugaaaagaccaucuccaaggcuaaaggccaaccucgggagccccagguuuacacgcugccgccuagccgcgacgaacuuacaaagaaucaggugucucugaccugucucgucaaaggguuuuaccccuccgauauugccguggagugggagagcaacggacagccugaaaauaacuauaagaccacacccccugugcuggacuccgacggcucuuucuuuaaaaagcugaccguugauaagagcagauggcaacagggcaacgucuucuccugcucugugaugcaugaggcccuucacaaucauuacacacagaaaagccucucccugagccccgggaag

SEQ ID NO: 38307 - RNA, 1359 nt, Artificial Sequence
  derived and/or modified sequence opt5 from Bevacizumab_gamma1-Chain_CH3-Region_mutein
gaggugcagcuggucgaaagcggcgggggacucguucaacccggcgggucccugagacuuucuugcgccgcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaauagccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaauccucuggccuuuauagccuguccagcguggucacaguucccucuuccagccucgggacccagacauacauuuguaaugugaaccauaagccuucuaauaccaaaguggauaagaaagucgagcccaagagcugcgacaaaacccacacauguccucccugcccggcuccugagcugcuuggaggccccuccguguuccuguuuccucccaagcccaaggauacgcucaugaucucucgcaccccugaaguuacauguguggucguggacguuagccaugaggauccggaagugaaauucaacugguaugucgacgggguggagguccacaaugccaagaccaaacccagagaggaacaguacaacuccacauaucgggugguuagcgugcugaccguccugcaccaggauuggcucaauggaaaggaguacaaaugcaaggugucuaacaaagcgcugccugcccccauugaaaagacgaucuccaaggcuaaaggccaaccucgcgagccccagguuuguacacuuccgccuagcagagacgaacugaccaagaaucaggugucucucuccugcgccgucaaaggguuuuaccccagcgauauugcuguggagugggaguccaacggacagccugaaaauaacuauaagaccacacccccugugcuggacucugacggcagcuucuuucuuguuuccaaacugaccgucgauaagucucgguggcaacagggcaacguguucagcuguuccgugaugcaugaggcccuccacaaucauuacacacagaagucccugucucugucccccgggaaa

SEQ ID NO: 38308 - RNA, 1347 nt, Artificial Sequence; identical to SEQ ID NO: 38221
  derived and/or modified sequence opt5 from Bezlotoxumab_HeavyChain1

SEQ ID NO: 38309 - RNA, 645 nt, Artificial Sequence; identical to SEQ ID NO: 38222
  derived and/or modified sequence opt5 from Bezlotoxumab_LightChain1

SEQ ID NO: 38310 - RNA, 1335 nt, Artificial Sequence
  derived and/or modified sequence opt5 from Bimagrumab_HeavyChain1
caggugcaacugguccagagcggcgccgagguuaagaaacccggggcuuccgugaaggugucuugcaaagccagcggauacaccuucacauccucuuauaucaacugggucagacaggcgccuggccaggggcucgaauggaugggaacgauuaauccggugagcggcuccaccucuuacgcucaaaaguuucaggggcggguuacaaugacccgcgacacaagcaucuccaccgccuauauggagcugagcagacuucggucugaugacacagccguguacuauugugcucgcggaggcugguucgauuacuggggccaggggacccuggucacgguguccagcgccucuaccaaaggacccuccguuuuuccucucgcucccagcucuaaguccacaagcggcgggaccgccgcgcugggaugccuugugaaggacuauuucccugaacccgucacaguguccuggaacucuggcgcccugaccagcggggugcacacguuuccugcuguccuccaguccagcggacuguacucucuguccagcguugugacagugccgucuagcucccucggcacccaaacauacauuuguaaugucaaccauaaacccucuaauaccaagguggauaaaagaguugagccuaagagcugcgacaaaacccacacaugucccccuugccccgccccggaagcugccggcgggccuuccguguuccuguuucccccuaagcccaaggauacgcuuaugaucagccggacccccgaggucacaugugugguuguggacgucucucaugaggauccugaagugaaauucaacugguaugucgacggaguggagguucacaaugcgaagaccaaaccgcgcgaggaacaguacaacuccacauauagaguggucagcgugcugaccguucuccaucaggauuggcugaauggcaaggaguacaaaugcaaggugucuaacaaagcccuucccgcuccuauugaaaagacgaucuccaaggccaaagggcagccccgggagccucaagucuauacacugcccccgagccgcgaagagaugaccaagaaucaggugucccucaccugucuggugaaaggauuuuacccuucugacaucgcuguugaaugggagagcaacggccagcccgagaauaacuauaagacaaccccucccguccuggauuccgacgggucuuucuuucucuacagcaaacugacaguggacaaguccagauggcaacagggaaauguguucagcugcucugucaugcacgaagcccuucacaaccauuacacgcagaagucccugagccucucuccuggcaaa

SEQ ID NO: 38311 - RNA, 1332 nt, Artificial Sequence
  derived and/or modified sequence opt5 from Bimagrumab_HeavyChain
caggugcaacugguccagagcggcgccgagguuaagaaacccggggcuuccgugaaggugucuugcaaagccagcggauacaccuucacauccucuuauaucaacugggucagacaggcgccuggccaggggcucgaauggaugggaacgauuaauccggugagcggcuccaccucuuacgcucaaaaguuucaggggcggguuacaaugacccgcgacacaagcaucuccaccgccuauauggagcugagcagacuucggucugaugacacagccguguacuauugugcucgcggaggcugguucgauuacuggggccaggggacccuggucacgguguccagcgccucuaccaaaggacccuccguuuuuccucucgcucccagcucuaaguccacaagcggcgggaccgccgcgcugggaugccuugugaaggacuauuucccugaacccgucacaguguccuggaacucuggcgcccugaccagcggggugcacacguuuccugcuguccuccaguccagcggacuguacucucuguccagcguugugacagugccgucuagcucccucggcacccaaacauacauuuguaaugucaaccauaaacccucuaauaccaagguggauaaaagaguugagccuaagagcugcgacaaaacccacacaugucccccuugccccgccccggaagcugccggcgggccuuccguguuccuguuucccccuaagcccaaggauacgcuuaugaucagccggacccccgaggucacaugugugguuguggacgucucucaugaggauccugaagugaaauucaacugguaugucgacggaguggagguucacaaugcgaagaccaaaccgcgcgaggaacaguacaacuccacauauagaguggucagcgugcugaccguucuccaucaggauuggcugaauggcaaggaguacaaaugcaaggugucuaacaaagcccuucccgcuccuauugaaaagacgaucuccaaggccaaagggcagccccgggagccucaagucuauacacugcccccgagccgcgaagagaugaccaagaaucaggugucccucaccugucuggugaaaggauuuuacccuucugacaucgcuguugaaugggagagcaacggccagcccgagaauaacuauaagacaaccccucccguccuggauuccgacgggucuuucuuucucuacagcaaacugacaguggacaaguccagauggcaacagggaaauguguucagcugcucugucaugcacgaagcccuucacaaccauuacacgcagaagucccugagccucucuccuggc

SEQ ID NO: 38312 - RNA, 651 nt, Artificial Sequence
  derived and/or modified sequence opt5 from Bimagrumab_LightChain1
cagagcgcccugacccaacccgcuuccgugucuggcagcccugggcaguccaucacaauuucuugcacgggaaccagcuccgacgucggcucuuacaacuauguuaauugguaccagcagcacccggggaaggcccccaaacucaugaucuauggagugagcaagagaccuuccggcgugagcaaccgguucucuggguccaaaagcggaaauacagcgucucugaccauuuccggccuucaagcugaggaugaagccgacuacuauuguggcacauuugccgggggaagcuacuauggcgucuucgggggaggcaccaagcugacagugcucgggcagcccaaagcugccccuucuguuacccuguuucccccuuccagcgaggaacuucaggcuaacaaggccacgcuggugugccucaucuccgauuucuacccgggagcggucaccguggccuggaaggcugacucuagccccguuaaagccggcguggagacaaccacaccuuccaagcagagcaauaacaaauacgcugccucuuccuaucugagccugacccccgaacaauggaagucucaucgcagcuacuccugucaggucacgcacgagggcucuacaguggagaaaaccguggcgccuacagaaugcagc

SEQ ID NO: 38313 - RNA, 1365 nt, Artificial Sequence
  derived and/or modified sequence opt5 from Bimekizumab_HeavyChain1
gaggugcagcuggucgaaagcggcgggggacucguucaacccggcgggucccugagacuuucuugcgccgcuagcggauucaccuuuuccgacuacaacauggccugggugcggcaggcgccuggcaaggggcuggaguggguggcuacaaucacguaugaaggacgcaauaccuacuauagagauucugucaaaggccgguucacaauuagccgcgacaacgccaaaaauucccucuaccugcagaugaacucucuuagagccgaggauaccgcuguguauuacugugccagcccgccccaguauuacgaaggcuccaucuaccggcugugguuugcucacugggggcaaggaacacucguuaccgugagcucugccuccacaaagggcccuagcgucuucccccuggcgccuucuuccaagagcaccucugggggaacggccgcucugggcugccucgugaaagacuauuuucccgagccuguuaccguguccuggaauagcggggcccugacauccggaguccauaccuucccggcugugcuucagucuagcggccuguacucccucagcucuguggucacaguucccuccagcucucugggcacccagacguauauuuguaacgugaaucacaagccuagcaacacaaagguggauaaaaaggucgagcccaaauccugcgacaagacccauacauguccucccugcccggccccugaacuucugggaggacccucuguguuucucuucccucccaaacccaaggauacccugaugaucagccgcaccccugagguuacauguguggucguggacguuucccacgaagauccggaggugaaguuuaauugguacgucgacggcguggagguccauaacgcgaaaacgaagcccagagaggaacaguauaauagcaccuaccgggugguuucugugcugacaguccuccaccaagauuggcugaacgggaaagaauauaagugcaaaguguccaauaaggcccuuccugcucccauugagaaaaccaucagcaaggccaagggacagccucgcgaaccccagguuuacacacugccgccuucuagagacgagcucaccaaaaaccaggugucccugacgugucuugucaagggcuucuaccccagcgauaucgcuguggagugggaauccaaugggcaaccugagaacaacuauaaaacaacacccccugugcuggacucugacgggagcuuuuuccucuacuccaagcugaccguugauaaaucucgguggcagcagggcaaugucuuuagcugcuccgugaugcacgaagcccugcauaaccacuauacccaaaagagccucucucugucccccggcaag

SEQ ID NO: 38314 - RNA, 642 nt, Artificial Sequence
  derived and/or modified sequence opt5 from Bimekizumab_LightChain1
gccauccagcugacccaaagccccuccucucucagcgcuuccgugggcgaccgggucacaauuacgugccgggccgaugagucuguucgcacccugaugcacugguaccagcagaagccugggaaagcgccgaaacuucugaucuaucucgugagcaacuccgaaauuggagugcccgacagauucucuggcagcggguccggaacagauuuucggcugaccaucagcucucuucagccugaggacuucgcuacauacuauugucaacagaccugguccgaucccuggacauuuggccaggggaccaaggucgaaauuaagcgcacgguggccgccccuagcguuuucaucuuucccccuucugacgagcagcugaaauccggaaccgcuagcguggucugccuccugaauaacuucuacccgagagaagccaaggugcaauggaagguugauaaugcucugcagucuggcaacucccaggagagcgugacagagcaggacuccaaagauucuaccuauagccucuccagcacacugacccuuucuaaggccgacuacgaaaaacauaaggucuaugcgugugaggugacgcaccaaggccuguccagccccgugacaaaaucuuuuaauagaggggaaugc

SEQ ID NO: 38315 - RNA, 1344 nt, Artificial Sequence
  derived and/or modified sequence opt5 from Bleselumab_HeavyChain1
cagcugcaacuccaggagagcggccccgggcugcuuaagccuuccgaaacccugucucucacaugcacggugagcggaggcuccaucucuagcccgggguacuauggaggcuggauuagacagcccccugggaaaggacuggaguggaucggcuccauuuacaagucuggcagcaccuaucacaaccccucccuuaaaagccgggucacaaucucuguugacaccuccaagaaucaguucagccugaaacucucuuccgugacagccgcugauaccgccguguacuauuguacacgcccugucgugagauacuuugggugguucgaccccuggggacaaggcacccugguuacggugagcucugcguccaccaaggggccuagcgucuuuccgcuggcucccugcucccggucuacaagcgaauccaccgccgcccucggaugucuggugaaggauuauuucccugagcccguuacagugagcuggaacucuggcgcucuuaccuccgggguccauacguuuccugccgugcugcagagcucuggacucuacagccuguccucuguggucacaguucccagcuccagccuuggcaccaaaacauacacaugcaauguggaccacaagccgucuaacaccaaaguggauaagcgcgucgaauccaaauauggcccucccuguccucccugccccgcuccugaguucgaagggggaccgagcguguuucuguuucccccuaagcccaaggacacacucaugauuucuagaacgccugaaguuaccuguguggucguggauguuucccaggaggaccccgaagugcaguucaauugguacgucgauggcguggagguccauaacgccaaaacaaagccgcgggaggaacaauucaauagcaccuaucgcgugguuuccgugcugacaguccugcaccaggacuggcucaacgggaaagaguacaagugcaaagugucuaauaagggacugccuagcuccaucgagaaaaccaucucuaaggcgaagggccagcccagagagccucagguuuauacgcuucccccuagccaagaagagaugaccaaaaaccaggugucccugaccugucucgucaagggguuuuaccccagcgauauugccguggagugggaaucuaauggacagccggagaacaauuauaaaaccacaccucccgugcuggacuccgauggcagcuucuuucuuuacucucggcugaccguugacaagucccgcuggcaagaaggcaacgucuucagcugcucugugaugcaugaggcucuccacaaucacuacacacagaaaagccugucccugagccucgggaag

SEQ ID NO: 38316 - RNA, 639 nt, Artificial Sequence
  derived and/or modified sequence opt5 from Bleselumab_LightChain1
gccauccagcugacccaaagccccuccucucucagcgcuuccgugggcgacagagucacaauuacgugccgggccucucaggggaucagcuccgcgcuggcuugguaccagcagaagccuggaaaagccccgaaacuucugauuuaugaugccucuaaccucgagagcggcguucccucccgcuucagcgggucuggauccggcaccgacuuuacacugaccaucagcucucuucaaccugaagauuucgcuacauacuauugucagcaguuuaauuccuaccccaccuucgggcagggaacaaagguggagauuaagagaaccguggccgcuccuagcgucuuuaucuuucccccuucugacgaacaacugaaauccggcacggccagcgugguuugccuccugaacaauuucuauccgcgggaggcgaaggugcaguggaaggucgauaacgcccugcaguccggcaauucucaggaaagcgugaccgagcaagacuccaaagauagcacauacucucucuccagcacccugacacuuucuaaggcugacuaugagaaacacaagguuuacgccugugaagugacccaucaggggcugagcucccccgucacgaaaucuuucaaccgcggagagugc

SEQ ID NO: 38317 - RNA, 1512 nt, Artificial Sequence
  derived and/or modified sequence opt5 from Blinatumomab_HeavyChain1
gacauccagcugacccaaagccccgccucccucgcugugucucugggccagagagccacaauuagcugcaaggcgucccagucugucgauuacgacggggauagcuaucuuaacugguaccagcaaaucccuggacagccgcccaaacugcucauuuaugacgcuuccaaucugguuucuggcaucccuccccgguucagcggguccggaagcggcacggauuuuacccuuaacauucacccuguggagaagguggacgccgccacauaccauugucagcagucuaccgaagaucccuggacauucgggggaggcaccaaacuggagaucaagggcgggggaggcuccgggggaggcgggagcggaggcggcgggucucaaguccagcuccagcaguccggagcugaacuggugcgcccuggcagcucuguuaaaaucuccugcaaggccagcggguaugcuuuuuccucuuacuggaugaauugggugaagcaaagaccgggacagggccuggaguggauugggcagaucuggcccggagacggcgauacaaacuauaauggcaaauucaaggggaaagccacccucacggcggacgaaagcuccagcaccgccuacaugcaacugucuucccuugcuagcgaggauucugccgucuacuuuugugcucggcgcgagacaaccacagugggaagauauuacuaugccauggacuacuggggccaggggaccacgguuacagugagcuccggaggcgggggcucugauauuaagcugcagcagagcggagcggaacucgcccggccuggcgcuuccgucaaaaugagcugcaagaccucuggguauacauucacccgcuacaccaugcacugggugaagcaaagacccggacagggccuggaguggaucggguauauuaacccuucccggggauacacaaauuacaaccagaaauuuaaggacaaagccacgcuuaccacagacaagucuagcuccaccgcuuauaugcagcugagcucccucacaucugaagauagcgccguguacuauugugcccgcuacuaugacgaucauuacugccuggacuauuggggccaagggaccacgcugacagucuccucuguugagggcggaagcggcggguccggaggcagcgggggaucuggcgggguggaugacauccagcucacccagucccccgcuauuaugagcgcgucuccgggcgagaaagugaccaugacauguagagccuccagcucugucagcuacaugaauugguaccagcaaaaguccggaaccagcccuaaacgguggaucuaugauacaucuaagguggcuuccggcguucccuaccgcuucagcggguccggaucuggcacgagcuauucccugaccaucucuagcauggaagccgaggacgccgcuacauacuauugccagcagugguccucuaacccucuuaccuuuggggccggaacaaagcuggaacucaaacaccaucaccaccaucac

SEQ ID NO: 38318 - RNA, 1512 nt, Artificial Sequence; identical to SEQ ID NO: 38317
  derived and/or modified sequence opt5 from Blinatumomab_SingleChain

SEQ ID NO: 38319 - RNA, 1512 nt, Artificial Sequence; identical to SEQ ID NO: 38317
  derived and/or modified sequence opt5 from Blinatumumab_SingleChain_variable_fragment_fusion_protein_(bite)

SEQ ID NO: 38320 - RNA, 1344 nt, Artificial Sequence
  derived and/or modified sequence opt5 from Blontuvetmab_HeavyChain
caggugcaacugcagcagagcagagccgagcucguccggcccggcgcuuccguuacccugucuugcaagccuagcggguacacauucacggacuaugaagugcacugggugaaacagaccccgguccauggacuugaguggaucggcgccauugaucccgaaacagggggaaccgcggacaaccaaaaguuuaaaggcaaggcuauccugacagccgauaaauccucuagcaccgccuacauggagcuccgcucccugacaucugaagacagcgcuguguauuacuguaccaauuucguugaugugugggggacgggaaccacagucaccguguccagcgccucuacaaccgcuccuuccguuuuuccccuugccccuagcugcggcucucaguccggcagcacgguggcgcuggccugucucgucucuggguauuuccccgagccugugacaguguccuggaacagcggaucccugaccucuggcguccacacauuuccgagcguucugcaguccagcgggcucuacucucuguccagcauggugaccgugcccucuagcagauggccuuccgagaccuucacaugcaaugucgcucaucccgccucuaagacgaagguggacaaaccuguucccaagcgggaaaacggacgcgugccgagaccucccgauuguccuaaaugccccgcucccgagaugcuuggcgggccuagcgucuuuauuuucccgcccaagccuaaagacacccugcucaucgcccggacacccgaagugaccuguguuguggucgaucuggacccugaggaucccgaggugcagauuuccugguuugucgacggaaagcaaaugcagacagcgaagacccagccgcgcgaggaacaguucaauggcacguauagagugguuagcgugcuuccuaucggccaccaagauuggcugaaagggaagcaguuuacaugcaaagucaacaauaaggcccuccccucuccuaucgaacggaccauuuccaaagcucgcggacaggcccaucaacccagcguguacguucugccucccucuagagaggaacuguccaagaacaccgugagccucacaugucugaucaaagacuucuuuccgccugacauugaugucgaguggcaguccaauggccagcaggagcccgaaucuaaguaccggaccacacccccucaacuugacgaggaugggagcuauuuccuguacuccaagcucucuguggacaaaagccgcuggcagagaggagauacguucaucugcgcugugaugcacgaagcccugcacaaccauuauacccagaagucccuuagccacucuccgggcaaa

SEQ ID NO: 38321 - RNA, 657 nt, Artificial Sequence
  derived and/or modified sequence opt5 from Blontuvetmab_LightChain
gacguggucaugagccagucccccucuagccuggccguuuccgugggcgagaaggugaccaugucuugcaaaagcucccaaucucuccuguacagcgggaaccagaagaauuaucuugcuugguaccagcagaaaccuggacaauccccgagacugcucaucuauugggccagcacacgggaaucuggcguccccgaucgcuucacgggguccggaagcggcaccgacuuuacacugaccauuucuuccgugaaggcggaggaucuugcuguuuucuacugucagcaguauuacaacuauccucugacauuugggggaggcacccaccucacagugcugggccagcccaaagccagcccuucugucacccuguuucccccuuccagcgaggaacucggggccaauaaggcuacgcuggugugccuuaucuccgacuucuacccgucuggaguuaccguggccuggaaggcugauggcagccccauuacacaaggggucgaaaccacaaaaccuuccaagcagagcaacaauaaauacgccgcgucuuccuaucugagccucacccccgacaaguggaaaucucauagcuccuucucuugucuggugacgcacgagggaagcacaguggagaagaaggucgccccugcugaaugcucc

SEQ ID NO: 38322 - RNA, 1332 nt, Artificial Sequence
  derived and/or modified sequence opt5 from Blosozumab_HeavyChain1
caggugcaacugguccagagcggcgccgagguuaagaaacccggggcuuccgugaaggugucuugcaaagucagcggauucccuaucaaggacaccuuucagcacugggugagacaggccccgggcaaagggcucgaauggaugggaugguccgaucccgagauuggcgacacagaauacgcgucuaaguuccaagggcggguuacgaugaccgaggauacaagcaccgacacagcuuauauggaacuguccucucuucgcagcgaggauaccgccguguacuauugugccacaggagacaccacguacaaguuugauuucuggggccagggcaccacagucaccguguccagcgcuucuacaaaagggccuuccguuuuuccccuggccccuugcagcagaucuaccuccgagagcacggcugcccucggaugucuggugaaggacuauuuccccgaaccugucacagugucuuggaacuccggcgcgcuuaccagcggggugcauacauuuccggccguccugcaguccucuggacucuacagccuguccagcguugugaccgugcccucuuccagccugggcaccaaaacauauacgugcaaugucgaucacaagccuucuaacaccaaaguggacaagcggguugagagcaaguacgggcccccuugucccccgugcccugcucccgaguuccucggaggcccuuccguguuucuguucccucccaaacccaaggauacacuuaugaucucucgcaccccggaggucacaugugugguuguggacgucagccaggaggaucccgaagugcaauuuaauugguacgucgacggcguggagguucauaacgccaaaaccaagccuagagaagaacaguucaauuccacguaucggguggucagcgugcugacaguucuccaccaggacuggcugaacgggaaagaauacaagugcaaagugucuaauaagggacuucccuccagcauugagaagaccaucucuaaagcuaagggccagccucgcgagccccaagucuauacccugccgccuucccaggaagagaugaccaaaaaccaggugagccucacaugucuggugaagggguuuuaccccuccgauauugccguugaaugggagucuaauggacaaccugaaaacaauuauaaaacaacgcccccuguccuggacagcgauggcuccuucuuccucuacucuagacugaccguggacaagagccgguggcaggaggggaacguguuuuccugcagcgucaugcaugaggcgcuucacaaucacuauacacagaagucucugucccucagccuggga

SEQ ID NO: 38323 - RNA, 642 nt, Artificial Sequence
  derived and/or modified sequence opt5 from Blosozumab_LightChain1
gacauccagaugacccaaagccccuccucucugagcgccuccgugggcgauagagucacaauuacgugcaaggcuucucaggacguucacaccgccguggcgugguaccagcagaaaccugggaaggcuccgaaacuccugaucuauugggccagcacacgguggaccggagugcccucccgcuucucuggcagcggguccggaacagauuuuacccuuacaauuagcucucugcaaccugaggacuucgccaccuacuauugucagcaguacuccgauuaucccuggacguuuggcgggggaaccaaggucgaaaucaaaagaacaguggcugccccuagcguuuucauuuuucccccuucugacgagcagcucaaguccggcaccgcuagcguggucugccugcuuaacaauuucuacccgcgggaagccaaggugcaauggaaaguugauaacgcgcugcagucuggcaauucccaggagagcgugacagaacaggacuccaaggauucuaccuauagccucuccagcacgcugacacugucuaaagccgacuacgagaagcauaaagucuacgcuugugaggugacccaccaagggcucuccagccccgugacaaagucuuuuaaccgcggagaaugc

SEQ ID NO: 38324 - RNA, 1332 nt, Artificial Sequence
  derived and/or modified sequence opt5 from Bococizumab_HeavyChain1
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaugggagagaucucuccguuuggcgggcggacgaacuauaaugaaaaguucaaaagccgcgugaccaugacaagagacaccuccacaucuaccguuuacauggagcugagcucccuucggagcgaagauacagcuguguauuacugugcccgcgagagaccccuguaugccucugaccucuggggacaaggcaccacggucaccguguccagcgcuucuacaaagggcccuuccguuuuuccccuggccccuugcagccggucuaccuccgagagcacagcugcccuugggugucuggugaaggauuacuuccccgaaccugucaccguguccuggaacucuggagcgcucacgagcggcgugcauacauuuccggccguccugcaguccagcgggcuguacucucucuccagcguugugaccgugcccucuagcaauuucggaacacagaccuauaccugcaacgucgaccacaaaccuuccaauacaaagguggauaaaacgguugagcgcaaguguugcguggaaugucccccuugccccgcuccgccugucgccggccccucuguguuucuguucccucccaaacccaaggacacccuuaugauuagcagaacaccugagguuaccuguguggucguggaugucucccaugaggacccggaagugcaguuuaacugguacguugaugggguggagguccacaaugcuaagacaaaaccccgggaggaacaauucaacagcaccuuucgcgugguuucugugcugacggucgugcaucaggacuggcucaauggaaaggaauauaaaugcaagguguccaacaaaggccugccuagcucuaucgagaagacaauuuccaaaaccaagggccagcccagagagccucagguuuacacccuucccccgagccgggaagagaugacaaagaaucaagucucccugaccugucucgugaaaggguucuauccuucugauaucgccguggaaugggagagcaacggacagcccgaaaauaacuacaagacaacgccucccaugcuggacuccgauggcagcuuuuuccuguauucuaaacucaccgucgacaagucccgcuggcagcaagggaauguguucagcugcucuguuaugcacgaggcgcugcacaaccauuacacacagaaaucccuuagccugucuccuggaaag

SEQ ID NO: 38325 - RNA, 642 nt, Artificial Sequence
  derived and/or modified sequence opt5 from Bococizumab_LightChain1
gacauccagaugacccaaagccccuccucucugagcgccuccgugggcgauagagucacaauuacgugccgggcuucucaggggaucagcuccgcccucgcgugguaccagcagaagccuggaaaagcuccgaagcugcuuauuuauucugccagcuaccgcuauaccggcguucccuccagauucagcgggucuggauccggcacagacuuuaccuucacaaucagcucucugcaaccugaggauauugccaccuacuauugucagcagcgguacucccucuggcgcacauuugggcagggaaccaaacuggaaaucaagagaacgguggcugcccccagcguguucaucuuuccucccucugacgagcaacuuaaauccggcaccgcuagcgucgugugccugcucaacaauuucuauccucgggaagccaagguucaguggaagguggauaacgcgcugcaguccggcaauucucaggagagcgucacagaacaagacuccaaagauagcaccuacucucuguccagcacacucacccugucuaaggccgacuacgagaaacacaagguguaugcuugugagguuacgcaucaggggcuuagcuccccggugacaaaaucuuuuaaccgcggagaaugc

SEQ ID NO: 38326 - RNA, 1338 nt, Artificial Sequence
  derived and/or modified sequence opt5 from Brentuximab_vedotin_HeavyChain1
cagauccaacugcagcagagcggccccgagguggucaagccuggggccuccguuaaaauuucuugcaaggcuagcggauacaccuucacagacuauuacaucacgugggugaaacagaagccgggccaagggcucgaauggauuggauggaucuaucccggcuccgggaacaccaaauacaaugagaaguuuaagggaaaagccacacugaccguggauacaucuagcuccaccgcguucaugcagcuuucuagccugacauccgaagacaccgcugucuauuuuugugccaacuacggcaauuauugguucgccuacuggggccaggggacccaggugacgguuagcgcugccucuacaaagggaccuuccguguuuccccucgcuccuagcucuaaauccaccagcggcgggacagccgcgcugggaugccuugucaaggauuacuuccccgagccugugaccguuucuuggaacuccggcgcccugacgagcggggugcacacauuuccggcuguccuccaauccucuggacuguauagccuguccagcguggugaccguccccucuuccagccucggcacacagaccuacauuuguaauguuaaccauaaaccuucuaauaccaagguggacaagaaaguggaacccaagagcugcgauaaaacacacacguguccucccugcccggccccugagcugcuuggcgggcccuccgucuuccuguuuccucccaagcccaaagacacccucaugaucucuagaacaccugaggugaccuguguuguggucgaugugagccaugaagacccggagguuaaguucaacugguauguggauggagucgaagugcacaaugcuaaaacaaagccccgggaggagcaguacaacuccaccuaucgcgucgugagcguucugacggugcuucaucaggacuggcugaauggcaaggaauacaaaugcaaggucucuaacaaagcccucccugcgcccaucgagaagacaauuuccaaagccaaggggcaaccuagagaaccccagguguauacccugccgccuagccgggaugagcugaccaagaaucagguuucucucacaugucuggugaaaggauuuuaccccuccgacaucgcugucgaaugggagagcaacggccaaccugagaauaacuacaagaccacacccccugugcuugauuccgacgggucuuucuuucuguauagcaaacucacgguggacaagucccgcuggcagcagggaaacguuuucucuugcagcgucaugcacgaagcccugcacaaucauuacacccagaaaucccuuagccugucucccggc

SEQ ID NO: 38327 - RNA, 654 nt, Artificial Sequence
  derived and/or modified sequence opt5 from Brentuximab_vedotin_LightChain1
gacaucgugcugacccagagccccgccucccucgcugucucucugggccaaagagccacaauuagcugcaaggcgucccagucuguugauuucgacggggauagcuacaugaacugguaucagcagaaaccuggacaaccgcccaaggugcuuaucuacgcugccuccaaucuggagucuggcauuccugcccgguuuagcggguccggaagcggcacggacuucacccucaacauccaccccguggaagaggaagaugcugccacauauuacugucagcagucuaaugaggacccuuggaccuuugggggaggcacaaaacuggaaauuaagcgcaccgucgcugcccccuccguguucaucuuuccuccgagcgaugagcagcuuaaaucuggcacagcguccguugugugccugcucaacaauuucuaucccagagaggccaagguccaauggaagguggacaacgcucugcagagcgggaauagccaggaauccguuaccgagcaggauagcaaagacuccacguacucucugagcuccacccucacacugagcaaggccgauuaugaaaaacauaagguguacgcuugugaggucacccaccaaggacuuucuuccccugugacaaaaucuuuuaaccggggcgagugc

SEQ ID NO: 38328 - RNA, 1335 nt, Artificial Sequence
  derived and/or modified sequence opt5 from Briakinumab_HeavyChain1
caggugcaacuggucgagagcggcgggggaguugugcagcccggcagaucccuccggcugucuugcgcugcuagcggguucaccuuuuccucuuacggaaugcacugggugcgccaggccccuggcaaggggcuugaaugggucgcguucaucagauaugacggaagcaacaaauacuaugcugauuccgugaagggccgguuuacaauuucucgcgacaauagcaaaaacacgcuguaccuccagaugaacucccugagagccgaggauaccgccguuuauuacuguaagacacauggcagccacgacaauugggggcaaggaaccauggugacagucucuuccgcuagcaccaaaggcccgucuguguucccccuugccccuuccagcaagucuacauccgggggaaccgcugcccugggcugccucguuaaggauuauuuucccgaaccugugacggucagcuggaacuccggggcgcugaccucuggagugcauacauuccccgccgugcugcagagcuccggccucuacagccugucuuccgucguuaccgugccuagcucuagccuuggcacacagaccuacaucuguaaugugaaucacaaaccguccaacacgaaggucgacaaaaagguggagcccaaaucuugcgauaagacacauaccuguccucccugcccugcucccgaacugcucgggggaccgagcguuuuucuguucccucccaagccuaaagacacacuuaugauuucccggacccccgaggugaccugugucgugguugaugugagccacgaggaccccgaagucaaguuuaauugguauguggauggcgucgaggugcacaacgccaaaacaaagccucgcgaggaacaguacaauucuacguauagaguuguguccguccugaccgugcuccaucaagacuggcugaacgggaaagaguacaagugcaaaguuagcaauaaggcucugccggcccccaucgaaaagacaauuucuaaagcgaagggacagccucgggagccccagguguauacccucccucccucccgcgaagagaugaccaaaaaccaggucagccugacaugucuugugaagggcuucuacccguccgauaucgccguggaaugggagucuaaugggcaaccugagaacaacuauaaaacgacacccccuguucuggacagcgacggauccuuuuuccucuacucuaagcugaccgucgauaagagcagauggcagcagggcaauguguuuuccugcagcgugaugcacgaagcccuucauaaccacuacacccaaaaaucucugucccucagccccggcaag

SEQ ID NO: 38329 - RNA, 651 nt, Artificial Sequence
  derived and/or modified sequence opt5 from Briakinumab_LightChain1
cagagcgugcugacccaacccccuuccgucucuggcgccccggggcagagaguuacaaucagcugcuccggaucucggagcaacauuggcuccaauacggugaagugguaccagcagcuccccgggaccgcuccuaaacugcuuaucuauuacaacgaccaacgccccucuggagugccugauagauucagcggcuccaagagcgggacaucugccucccuggcgauuaccggacuccaggcugaggacgaagccgauuauuacugucagagcuaugaccgguacacacaccccgcccugcuuuuuggcaccggcacaaaagucaccgugcuggggcagccuaaggcugccccgucuguuacgcucuuucccccuuccagcgaggaacugcaagcuaauaaagccacccuggugugccucaucucugauuucuaucccggagcggucacaguggccuggaaggcugacuccagcccuguuaaggccggcguggagaccacaacccccuccaaacagucuaacaauaaguacgcugccagcuccuaccugagccuuacgccggaacaguggaaaucucaucgcuccuauagcugucaggucacacacgaggggucuaccguggagaagacaguggcgccuaccgaaugcagc

SEQ ID NO: 38330 - RNA, 1326 nt, Artificial Sequence
  derived and/or modified sequence opt5 from Brodalumab_HeavyChain1
caggugcaacugguccagagcggcgcugagguuaagaaacccggggcuuccgugaaggugucuugcaaagccagcggauacaccuucacaagauauggcaucuccuggguccggcaggcgccugggcagggacucgaauggaugggcuggauuucuacguacagcgggaacaccaauuaugcucaaaagcugcagggacgcgugacaaugaccacagacaccuccacaucuaccgccuacauggagcuuagaagccugcgguccgaugacacggccguuuauuacugugcucgcagacagcucuauuuugauuacuggggccagggcacccuggugacagucagcucugccuccaccaaagggccgagcguguucccccuugcuccuugcucucgguccacaagcgaaucuaccgccgcgcugggaugucucguuaaggacuacuuucccgagccugugacggucuccuggaacagcggcgcccugacauccggggugcacaccuuccccgcugugcugcaaucuagcggacucuauucccugagcucugucguuacagugccuuccagcaauuuuggcacccagaccuacacaugcaacguggaucauaagccgucuaauacgaaagucgacaagaccguggaacgcaaauguugcguugagugucccccuugccccgccccucccguggcugggccgagcgucuuccuuuuuccucccaagccuaaagauacacugaugaucuccagaacccccgaggugacauguguuguggucgacgugucucacgaagaucccgagguccaguucaacugguauguggacggaguugaagugcauaaugccaagaccaagccucgggaggagcaguuuaacagcacguuccgcgucguguccguucucacagugguccaccaagauuggcugaauggcaaagaauacaagugcaaagugagcaacaagggccuuccggcgcccauugagaaaaccaucucuaagaccaaagggcagccuagagaaccccagguguauacacugccucccucccgggaggaaaugaccaagaaucaaguuagccucacaugucuggucaagggauuuuacccgucugacauugccguggagugggaguccaacggccagccugaaaauaacuauaaaacgacacccccuaugcuggauagcgacggguccuucuuucucuacucuaagcugaccguggacaaaagccgcuggcagcagggaaaugucuucuccugcucugugaugcaugaggcccuucacaaccacuacacccaaaagagccugucccucagccccggcaaa

SEQ ID NO: 38331 - RNA, 642 nt, Artificial Sequence
  derived and/or modified sequence opt5 from Brodalumab_LightChain1
gagaucgugaugacccagagccccgccacacuguccgucucuccuggcgaaagagcuacgcucagcugccgggccucccaaucuguuagcuccaaccuggcgugguuccagcagaaaccggggcaggcuccccgcccucuuauuuacgacgccucuaccagagccacaggagugcccgcucgguuuagcggcuccgggagcggaaccgauuucacacugaccaucucuucccuccaaagcgaggacuuugccguguauuacugucagcaguaugauaauuggccucugacauucggcgggggaaccaaagucgaaauuaagcgcacgguggcugcccccucuguuuuuaucuucccuccguccgacgagcagcuuaaaagcggcaccgcgucuguggucugccugcucaacaauuuuuaccccagagaagccaaggugcaauggaaaguugauaacgcucugcaguccggcaauagccaggaguccgugacagagcaggacucuaaggauagcaccuauucccugagcucuacacucacccuguccaaggccgacuacgaaaaacacaaggucuaugcuugugaggugacgcaucaagggcuuagcucuccugugacaaagagcuucaaccggggagaaugc

SEQ ID NO: 38332 - RNA, 756 nt, Artificial Sequence
  derived and/or modified sequence opt5 from Brolucizumab_HeavyChain1
auggagaucgugaugacccagagccccuccacacugucugccagcgucggcgacagaguuauuaucacgugccaggcuuccgaaauuauccacucuuggcucgccugguaccaacagaagccugggaaagcgccgaagcugcuuauuuaucuggcuagcacccucgccuccggagugcccucucgguucagcggcuccgggagcggagccgaguuuacacugaccaucucuucccuucagccugaugacuucgcuacauacuauugucaaaacguguaccuggccagcaccaauggcgcuaacuuugggcagggaacaaaacucaccguccugggcggcgggggaggcucugggggaggcggguccggaggcggcgggagcggaggcgggggaucugaagugcagcugguugaguccggcgggggacucgugcagcccggcggcagccugcgccuuuccugcacggccucuggguucagccugaccgauuauuacuauaugacaugggucagacaagcgccuggaaagggccucgaaugggugggguuuaucgaccccgaugacgauccuuacuacgccaccugggcuaaaggacgguucacaauuucccgcgacaauagcaagaacacccuguaucuucagaugaacucucugagagccgaggauacggcuguuuacuauugugccggcggggaccauaauuccggcuggggacucgauaucuggggccaggggacacuggugaccgucagcucu

SEQ ID NO: 38333 - RNA, 756 nt, Artificial Sequence; identical to SEQ ID NO: 38332
  derived and/or modified sequence opt5 from Brolucizumab_scFv_fragment

SEQ ID NO: 38334 - RNA, 1341 nt, Artificial Sequence
  derived and/or modified sequence opt5 from Brontictuzumab_HeavyChain1
caggugcaacugguccagagcggcgccgagguuaagaaacccggggcuuccgugaagaucucuugcaaagugagcggauacacccucagaggcuauuggauugaauggguccggcaggccccugggaagggacuggaguggaucggccagauucuuccggggacaggacgcacgaacuacaaugaaaaauucaagggcagagugaccaugacagcggacaccuccacagauaccgcuuauauggagcugucuagccuccgguccgaagacacagccguuuacuauugugcccgcuuugauggcaacuacggguauuacgcuauggacuacuggggacaaggcaccacggugaccgucucuagcgccuccacaaaggggcccagcguguucccucuggcucccugcucuagauccaccagcgagucuacagccgcgcuuggaugucugguuaaagauuauuuuccugagcccgugaccgucuccuggaauagcggcgcccucacgucuggggugcacacauucccugcugugcugcaguccagcggacuguacucccucucuagcgucguuaccgugccguccagcaacuuuggcacacagaccuauaccugcaauguggaccauaagcccucuaacacaaaagucgauaagacgguggaacggaaauguugcguugaguguccucccugcccugcucccccgguggccggcccuuccgucuuccuguuucccccuaagcccaaggacacccuuaugaucagccgcacacccgaagugaccuguguuguggucgaugugucucacgaggacccugagguccaguucaauugguacguggaugggguugaagugcauaacgccaaaacaaagccgagagaggaacaauuuaauagcaccuuccgggucguguccguucugacggugguccaccaggacuggcucaacggaaaagaguauaagugcaaagugucuaauaagggccugcccgcgccuauugaaaagacaaucagcaagaccaaggggcagccccgcgagccucagguguacacccuucccccguccagagaggaaaugaccaaaaaccaaguuagccugacaugucucgucaagggauuuuauccuucugauaucgccguggagugggaauccaauggccagcccgagaacaauuacaaaacaacgccucccaugcuggacagcgacgggucuuucuuucuguacuccaagcucaccguggauaaaagccgguggcagcaaggaaacgucuucuccugcucugugaugcaugaagcucugcacaaccacuauacacagaaaagccuuucccugucuccuggcaag

SEQ ID NO: 38335 - RNA, 645 nt, Artificial Sequence
  derived and/or modified sequence opt5 from Brontictuzumab_LightChain1
caggccguggucacccaagagcccagccugacaguuuccccuggcgggacggugacccucacaugcagaucuagcaccggagcugugacaaccuccaacuacgccaauugguuccagcagaagccgggccaggcgccccggacacugaucgggggaaccaacaaucgcgcuccuggcguccccgccagauuuucugggagccuucugggaggcaaagccgcucucacgcuguccggcgcccaaccugaagacgaggcugaauauuacugugcccuuugguauucuaaccacuggguguucgggggaggcaccaagcugacaguucucgggcagcccaaagcggccccuagcgugacccuguuuccgcccuccagcgaggaacugcaggcuaauaaggccacacucgucugccuggugucugauuucuacccuggagcuguuaccguggccuggaaagcggacggcucccccgucaagguggggguggagacgacaaagccuagcaaacagucuaacaauaaguaugccgcuuccagcuaccuuucucugacccccgagcaauggaaaucccaucggagcuauuccugucgcgucacacacgaaggaucuaccguugagaagaccguggccccggcugaaugcagc

SEQ ID NO: 38336 - RNA, 1332 nt, Artificial Sequence
  derived and/or modified sequence opt5 from BTT-1023_HeavyChain1
caggugcaacuggucgagagcggcgggggaguugugcagcccggcagaucccuccggcugucuugcgccgcuagcggguucaccuuuuucuccuacgccaugcacugggugcgccagacaccuggaaagggccuugaaugggucgcggugaucugguuugacgggucuaacgagaauuauguugauagcgugaaaggaagauucacgauuucccgggacaacucuaagaauacccuguaccuccagaugaacacacugcgcgcugaagauaccgccgucuauuacugugccagagacgcuuggagcuauuuugauuacuggggccaaggcacacuugugaccguuuccagcgccucuacaaaagggccguccguguucccccuggcuccuugcagccggucuaccuccgagagcacggccgcgcucggaugucuggucaaggacuauuuucccgaaccugugaccgugucuuggaacuccggcgcccugacaagcgggguccauaccuuccccgcuguucuccaguccucuggacuguacagccuuuccagcguggugacagucccuucuuccagccugggcaccaaaacguacacaugcaauguggaucacaagccgucuaauaccaagguugacaaacgcguggagagcaaguaugggcccccuugucccccuugccccgccccggaguuugcuggaggcccuuccgucuuccucuuucccccuaaacccaaggauacacugaugaucucuagaacccccgaagugaccuguguuguggucgacgugagccaggaggauccugaaguccaguucaacugguacguggacggcguugaggugcauaaugccaaaacaaagccgcgggaggaacaauuuaacuccacguaucgcgucgugagcguucuuaccgugcugcaccaggauuggcucaaugggaaggaguacaaaugcaaggucucuaacaaaggacugcccuccagcauugaaaagacaaucucuaaagcgaagggccagccuagagagccccagguguauacccugccucccucccaagaagagaugaccaaaaaucaggugagccucacaugucugguuaagggguucuacccguccgacauugccgucgagugggaaucuaacggacagccugagaauaacuauaagacgacacccccugugcuugacagcgauggcuccuucuuucuguacucucggcucaccguggacaaaagccgcuggcaagaagggaacgucuucuccugcagcgugaugcaugaggcucugcacaaucacuacacccagaagucucuuucccugagccucggaaaa

SEQ ID NO: 38337 - RNA, 642 nt, Artificial Sequence
  derived and/or modified sequence opt5 from BTT-1023_LightChain1
gugauccagcugacccaaagccccuccucucucagcgccuccgucggcgacagaguuacaauuacgugccgggcuucucaggggaucagccgcgcccuggcgugguaccagcagaagccuggaaaaggcccgaaacuucugauuuaugaugcuuccucucucgagagcggggugcccuccagauucagcggaucuggcuccgggaccgacuuuacacugaccaucagcucucuucaaccugaagauuucgccacauacuauugucagcaguuuaacuccuacccccugaccuucggaggcggcacaaagguggagauuaagcggaccgucgccgcuccuagcguguuuaucuuucccccuucugacgaacagcucaaauccgggacggccagcguugugugccugcugaauaacuucuauccgcgcgaggcuaagguccaauggaagguggauaaugcccuccaguccggaaacucucaggaaagcguuaccgagcaggacuccaaagauagcacauacucucuguccagcacccuuacacugucuaaggcggacuaugagaaacacaagguguacgccugugaagucacccaucaaggccucagcucccccgugacgaaaucuuucaauagaggggagugc

SEQ ID NO: 38338 - RNA, 1341 nt, Artificial Sequence
  derived and/or modified sequence opt5 from Burosumab_HeavyChain1
caggugcaacugguccagagcggcgccgagguuaagaaacccggggcuuccgugaaggugucuugcaaagccagcggauacaccuucacaaaccacuauaugcauugggucagacaggcgccuggccaggggcucgaauggaugggaaucauuaauccgaucuccggcucuacgagcaacgcucaaaaguuucaggggcgggugaccaugacacgcgacaccuccacaucuaccguuuacauggagcugagcucccuuagaagcgaagauacagccguguauuacugugcccgggacauugucgaugcuuucgacuuuuggggacagggcaccauggugacgguuucuuccgccagcaccaaaggccccucuguguucccucuggcucccuccagcaagucuacauccgggggaaccgccgcgcucggcugccuggucaaggauuauuuuccugagcccgugacagugagcuggaacuccggggcccuuaccucuggaguccacacguucccugcuguucugcagagcuccggccucuacagccugucuuccguggugacagucccgagcucuagccuggggacccaaacauauaucuguaaugugaaucauaaacccuccaacaccaagguugacaaaaagguggaaccuaaaucuugcgauaagacccacacaugucccccuugccccgccccggagcuccugggaggcccuagcgucuuucuuuuucccccuaagcccaaagacacgcugaugauuucccgcacccccgaggugacauguguuguggucgaugugagccaugaagacccugaggucaaguucaauugguacguggauggcguugaagugcacaacgcuaaaaccaagccgagagaggagcaguacaauucuacauaucgggucguguccguucucaccgugcugcaccaggacuggcuuaacgggaaagaauacaagugcaaagucagcaauaaggcccugcccgcgccuaucgagaagacgaucucuaaagccaagggacagccccgcgaaccucaaguguauacacugcccccguccagagaugagcucaccaaaaaccaggugagccugaccugucucguuaagggcuucuacccuuccgacauugcugucgaaugggagucuaaugggcagcccgagaacaauuauaaaacaaccccucccgugcuggacagcgauggauccuuuuuccuuuacucuaagcugacaguggacaagagccgguggcaacagggcaacgucuuuuccugcagcgugaugcaugaagcccuccacaaccauuauacgcagaaaucucugucccuuagcccugggaag

SEQ ID NO: 38339 - RNA, 639 nt, Artificial Sequence
  derived and/or modified sequence opt5 from Burosumab_LightChain1
gccauccagcugacccaaagccccuccucucucagcgcuuccgugggcgacagagucacaauuacgugccgggccucucaggggaucagcuccgcgcugguuugguaccagcagaagccuggaaaagcuccgaaacuucugauuuaugaugccucuagccucgaguccggcgugcccagccgcuucucuggguccggaagcggcaccgacuuuacacugaccaucucuucccuucaaccugaagauuucgccacauacuauugucagcaguuuaacgacuacuucaccuuugggcccggaacaaagguggauauuaagagaaccgucgcugccccuagcguguucaucuuucccccuucugacgagcagcugaaauccggcacggcuagcguugugugccuccugaauaacuucuauccgcgggaagccaagguccaauggaagguggauaaugcgcugcaguccggcaacucucaggagagcguuaccgaacaggacuccaaagauagcacauacucucucuccagcacccugacacuuucuaaggccgacuaugagaaacacaagguguacgcuugugaggucacccaucaagggcugagcucccccgugacgaaaucuuuuaaucgcggagaaugc

SEQ ID NO: 38340 - RNA, 1344 nt, Artificial Sequence
  derived and/or modified sequence opt5 from Canakinumab_HeavyChain1
caggugcaacuggucgagagcggcgggggaguugugcagcccggcagaucccuccggcugucuugcgccgcuagcggguucaccuuuuccguguacggaaugaacuggguccgccaggccccuggcaaggggcuugaauggguggcgaucauuugguaugacggagauaaucaguacuaugcugacucuguuaaaggcagauucacaaucagccgggauaacuccaagaauacgcuguaccuccaaaugaacggccugcgcgccgaggacaccgccguguauuacugugcuagagaucuucggacagggccguuugacuauuggggacagggcacccuggucacagugucuagcgccuccaccaaagggcccagcguuuucccucucgcucccucuuccaagagcacaucuggaggcaccgccgcgcuggggugccuggugaaagauuacuuuccugaacccgucacgguguccuggaauagcggagcccucaccucuggcgugcacacauucccugcuguccugcaguccagcggccuuuacucccugucuagcguugugaccgugccguccagcucucucgggacacagaccuauauuuguaacgucaaucauaagcccuccaacacgaagguggacaaacgcguugagccuaagagcugcgauaaaacacacaccugucccccuugccccgccccggaacugcuuggaggcccuucuguguuucuguuucccccuaagcccaaagacacacucaugaucagcagaacccccgaggucaccugugugguuguggaugucucccaugaggacccugaagugaaguucaauugguacgucgaugggguggagguucacaacgcuaagacaaaaccgcgggaggaacaauauaauucuacguaccgcguggucagcgugcugaccguucugcaucaggacuggcucaacggaaaggaguauaaaugcaagguguccaauaaagcccugcccgcgccuauugaaaagacaaucagcaaagccaagggccagcccagagagccucaggucuacacccuucccccgucucgggaagagaugacaaagaaccaagugucccugaccugucucgugaaaggguucuauccuagcgacaucgcuguugaaugggagucuaauggacagcccgagaacaacuacaagacgacaccucccguccuggauuccgacggcagcuuuuuccuuuacuccaaacugaccguggauaagucucgcuggcagcaaggcaauguguuuagcugcuccgucaugcacgaagcccuccacaaccauuauacccagaaaucucugagccuguccccugggaag

SEQ ID NO: 38341 - RNA, 1344 nt, Artificial Sequence; identical to SEQ ID NO: 38340
  derived and/or modified sequence opt5 from Canakinumab_HeavyChain

SEQ ID NO: 38342 - RNA, 642 nt, Artificial Sequence
  derived and/or modified sequence opt5 from Canakinumab_LightChain1
gagaucgugcugacgcagagccccgacuuccaauccgucacaccuaaggaaaaaguuacgauuaccugcagagccucucagagcaucggcuccucucuccacugguaccagcagaagccggaucaaagccccaaacugcuuauuaaguaugcuucccagucuuuuagcggggugccuucccgguucagcggaucuggcuccgggacagacuuuacccugacaaucaacagccucgaggccgaagaugcggcugccuacuauugucaucagucuuccagccugcccuucaccuuuggaccuggcacaaaaguggacauuaagcgcaccgucgccgcucccucuguguucaucuuuccuccguccgaugagcagcuuaagagcgggacggccuccguugugugccugcucaauaacuucuaccccagagaagcuaaaguccaauggaagguggacaaugcccugcagucuggaaacagccaggaguccguuaccgagcaggauagcaaagacucuacauauucccugagcucuacccucacacugagcaaggcggauuacgaaaaacacaagguguaugccugugaggucacccaucaaggccuuuccucuccugugaccaagagcuuuaaucggggcgaaugc

SEQ ID NO: 38343 - RNA, 642 nt, Artificial Sequence; identical to SEQ ID NO: 38342
  derived and/or modified sequence opt5 from Canakinumab_LightChain

SEQ ID NO: 38344 - RNA, 1182 nt, Artificial Sequence
  derived and/or modified sequence opt5 from Canakinumab_LightChain_variant_8836_L
caggugcaacuggucgagagcggcgggggaguugugcagcccggcagaucccuccggcugucuugcgccgcuagcggguucaccuuuuccguguacggaaugaacuggguccgccaggccccuggcaaggggcuugaauggguggcgaucauuugguaugacggagauaaucaguacuaugcugacucuguuaaaggcagauucacaaucagccgggauaacuccaagaauacgcuguaccuccaaaugaacggccugcgcgccgaggacaccgccguguauuacugugcuagagaucuucggacagggccguuugacuauuggggacagggcacccuggucacagugucuagcgccuccaccaaagggcccagcguuuucccucucgcucccucuuccaagagcacaucuggaggcaccgccgcgcuggggugccuggugaaagauuacuuuccugaacccgucacgguguccuggaauagcggagcccucaccucuggcgugcacacauucccugcuguccugcaguccagcggccuugagauuguucugacccaguccccggacuuucaaucugugacacccaaggaaaaggugaccaucacgugucgcgccagccaguccauugggagcucucuccauugguaccagcagaaaccugaucaaucccccaagcugcuuaucaaauaugcuagccagucuuucagcggagucccuuccagauuuucuggcagcggguccggaacagacuucacccugacaaucaacagccucgaggccgaggaugcggccgcuuacuauugccaccagucuuccagccugcccuuuaccuucggcccggggaccaagguggacauuaaacggacaguugccgcuccuucuguguuuaucuuucccccuuccgaugaacaacuuaagagcggaacggccuccgucgugugucuccugaauaacuucuacccccgcgaggccaagguucaguggaaaguggacaaugcucugcagucuggcaacagccaggaauccgucaccgagcaagacucuaaggauagcacauauucccugagcucuacccucacacuguccaaagcggacuacgagaagcauaaaguguaugccugcgaagucacccaccagggccuuagcucucccgugacgaaguccuucaauagaggggagugu

SEQ ID NO: 38345 - RNA, 1197 nt, Artificial Sequence
  derived and/or modified sequence opt5 from Cantuzumab_HeavyChain1
aucgacaccacaacgggcgagcccaccuacgcccagaaguuccaagggagaauugcuuuuagccuggaaacauccgccucuaccgcguaucuccagaucaaaagccugaaguccgaggauacagcuaccuacuucugcgcccggcgcggaccuuauaacugguacuuugacguguggggccaggggacaaccgucacgguuucuagcgccuccaccaaaggaccgucuguguucccccuugcuccuagcuccaagagcacaucuggcgggaccgccgcucugggaugucucgugaaagauuauuuucccgaaccugucacaguguccuggaauagcggcgcccugaccucuggcguucacacguuccccgcggugcuucaguccagcgggcuguacucucucuccagcgucgugacaguuccuuccucuagccugggaacccaaacauauauuugcaacgugaaucauaagccguccaacaccaaggucgacaaaaagguggagcccaaaagcugugauaagacccacacaugcccucccuguccugcccccgaacugcucggcgggccgucuguguuucuguucccucccaaaccuaaggacacgcuuaugaucuccagaacccccgaggucacaugcguugugguggaugucagccaugaggaccccgaagugaaguuuaauugguacguugauggaguggagguccacaacgcuaaaaccaagccucgggaggaacaguacaauucuacauaucgcgugguuagcgugcugaccguccuccaucaggacuggcugaacggcaaagaguacaaguguaaaguguccaauaaggcccuuccggcucccauugaaaagacgaucucuaaggccaaggggcagccuagagagccccaagucuauacacugccucccagccgggaugaacucaccaaaaaccaggugucccugaccugccugguuaagggauucuacccgagcgacaucgcgguggagugggaaucuaauggccagccugagaacaauuauaaaacaacacccccuguccucgauuccgacggcagcuuuuuccuguacucuaaacuuaccguggacaaaucccgcuggcagcaagggaacguuuuuagcuguuccgugaugcacgaggcccugcacaaucauuauacgcagaagucucucagccugucccccggaaag

SEQ ID NO: 38346 - RNA, 1347 nt, Artificial Sequence
  derived and/or modified sequence opt5 from Cantuzumab_HeavyChain
caggugcaacugguccagagcggcgccgagguuaagaaacccggggaaaccgugaagaucuccugcaaggcuucugacuacacauucacguauuacggaaugaacugggugaaacaggccccuggccaggggcucaaauggaugggauggauugauaccacaaccggcgagccgacauaugcgcaaaaguuucaggggagaaucgcuuucagccuggaaaccuccgccucuacagccuaccuucagauuaagagccugaaauccgaggacaccgcuacguauuuuugugcccggcgcggacccuacaauugguauuucgaugucuggggccagggcaccacagugaccguuucuagcgcuuccacaaaggggccuagcguguuuccccucgccccuucuuccaaaagcaccucuggaggcacggcggcccuggggugccuugucaaggacuacuuccccgaaccugugacaguuuccuggaacagcggagcucugaccucuggcgugcacacauuuccggccguccuccaauccagcgggcuguacucccugucuagcguggugaccguccccuccagcucucucggaacccagacauauaucuguaauguuaaccauaaaccuuccaauacgaagguggauaagaaaguggagcccaagagcugcgacaaaacccacacauguccucccugcccggcuccugagcugcuuggcggccccucugucuuccuguuuccucccaagcccaaagauacccucaugauuagcagaacaccugaagugaccuguguuguggucgacgugucccaugaggauccggaaguuaaguucaacugguacguggacggggucgaggugcacaaugccaaaacgaagccccgggaggaacaguauaacucuacauaccgcgucgugagcguucugaccgugcuucaucaggauuggcugaauggaaaggaguauaaaugcaaggucuccaacaaagcgcucccugcccccaucgaaaagaccaucagcaaagcuaagggccaaccuagagagccccagguguacacacugccgccuucucgggacgaacugaccaagaaucagguuucccucacaugucuggugaaaggguuuuaucccagcgauauugccgucgagugggagucuaacggacaaccugaaaauaacuacaagacgacacccccugugcuugacuccgacggcagcuucuuucuguacuccaaacucaccguggauaagucucgcuggcagcaggggaauguuuucagcugcuccgucaugcacgaggcucugcacaaccauuauacccagaaaucucuuagccugucccccggaaag

SEQ ID NO: 38347 - RNA, 657 nt, Artificial Sequence
  derived and/or modified sequence opt5 from Cantuzumab_LightChain1
gacaucgugaugacccagagcccccuguccgucccuguuacaccgggcgagcccgugucuauuagcugcagauccucuaaaagccuccugcacuccaacgggaauacguaccuuuauugguuccugcaacggccuggacagucuccccagcuccugaucuaccgcaugagcaaccuuguguccggcgucccugauagauuuagcgggucuggauccggcaccgccuucacacugcggauuagccgcguggaagcugaggacguugggguguauuacugucuccagcaucuggaauaucccuuuaccuucggaccuggcacaaaacuggagcucaagagaaccgucgccgcgccgucuguguuuaucuuucccccuuccgaugaacaacugaaaagcggcacagcuucuguugugugccuucugaauaacuucuacccccgggaggccaagguccaguggaaaguggacaaugcccuccaguccgggaacagccaggaguccgugaccgaacaagauucuaaggacagcacguauucccugagcucuacccuuacacuguccaaggcugauuacgagaaacacaaggucuacgccugugaaguuacccaucagggacucagcucuccugugacaaagagcuucaaucgcggcgagugc

SEQ ID NO: 38348 - RNA, 1344 nt, Artificial Sequence
  derived and/or modified sequence opt5 from Cantuzumab_mertansine_HeavyChain1
gugcagcugguccaaagcggcgccgagguuaagaaacccggggaaaccgugaagaucuccugcaaggcuucugacuacacauucacguauuacggaaugaacugggugaaacaggccccuggccaggggcucaaauggaugggauggauugauaccacaaccggcgagccgacauaugcgcagaaguuucaagggagaaucgcuuucagccuggaaaccuccgccucuacagccuaccuucagauuaagagccugaaauccgaggacaccgcuacguauuuuugugcccggcgcggacccuacaauugguauuucgaugucuggggccagggcaccacagugaccguuucuagcgcuuccacaaaggggccuagcguguuuccccucgccccuucuuccaaaagcaccucuggaggcacggcggcccuggggugccuugucaaggacuacuuccccgaaccugugacaguuuccuggaacagcggagcucugaccucuggcgugcacacauuuccggccguccuccaguccagcgggcuguacucccugucuagcguggugaccguccccuccagcucucucggaacccaaacauauaucuguaauguuaaccauaaaccuuccaauacgaagguggauaagaaaguggagcccaagagcugcgacaaaacccacacauguccucccugcccggcuccugagcugcuuggcggccccucugucuuccuguuuccucccaagcccaaagauacccucaugauuagcagaacaccugaagugaccuguguuguggucgacgugucccaugaggauccggaaguuaaguucaacugguacguggacggggucgaggugcacaaugccaaaacgaagccccgggaggaacaguauaacucuacauaccgcgucgugagcguucugaccgugcuucaucaggauuggcugaauggaaaggaguauaaaugcaaggucuccaacaaagcgcucccugcccccaucgaaaagaccaucagcaaagcuaagggccagccuagagagccccaaguguacacacugccgccuucucgggacgaacugaccaagaaucagguuucccucacaugucuggugaaaggguuuuaucccagcgauauugccgucgagugggagucuaacggacagccugaaaauaacuacaagacgacacccccugugcuugacuccgacggcagcuucuuucuguacuccaaacucaccguggauaagucucgcuggcaacaggggaauguuuucagcugcuccgucaugcacgaggcucugcacaaccauuauacccagaaaucucuuagccugucccccggaaag

SEQ ID NO: 38349 - RNA, 657 nt, Artificial Sequence; identical to SEQ ID NO: 38347
  derived and/or modified sequence opt5 from Cantuzumab_mertansine_LightChain1

SEQ ID NO: 38350 - RNA, 1347 nt, Artificial Sequence; identical to SEQ ID NO: 38346
  derived and/or modified sequence opt5 from Cantuzumab_ravtansine_HeavyChain1

SEQ ID NO: 38351 - RNA, 657 nt, Artificial Sequence; identical to SEQ ID NO: 38347
  derived and/or modified sequence opt5 from Cantuzumab_ravtansine_LightChain1

SEQ ID NO: 38352 - RNA, 777 nt, Artificial Sequence
  derived and/or modified sequence opt5 from Caplacizumab
gaggugcagcuggucgaaagcggcgggggacucguucaacccggcgggucccugagacuuucuugcgccgcuagcggacggaccuucuccuacaauccuaugggcugguuucgccaggccccggggaagggaagagagcugguggcggcuaucucucggacaggcggcagcacguauuaccccgacuccguggaagggcgcuucaccauuucuagagauaaugccaaacggauggucuaucuccagaugaacagccugcgcgccgaggacacagcuguguacuauugugccgcugccggaguuagagcggaagauggccgggugcgcacccuuccuuccgaguacacauuuugggggcagggaacccaagucacagugagcucugccgcugccgagguucagcugguggaauccggcgggggacucguccagcccggcggcagccugagacugucuugcgcugccuccgggcggaccuucagcuauaauccuaugggaugguuucgccaggcgcccggcaaggggagagagcucguggccgcuaucucucggacgggaggcuccaccuacuacccugacagcguggaagggcgcuucacaauuuccagagauaacgccaaacggauggucuaucugcaaaugaacucucuuagagcugaggacaccgccguuuacuauugugccgcugcgggagugcgcgccgaggauggccgggugagaacacugccgagcgaauacaccuuuuggggccaggggacgcaggucacaguguccagc

SEQ ID NO: 38353 - RNA, 777 nt, Artificial Sequence; identical to SEQ ID NO: 38352
  derived and/or modified sequence opt5 from Caplacizumab_HeavyChain1

SEQ ID NO: 38354 - RNA, 777 nt, Artificial Sequence; identical to SEQ ID NO: 38352
  derived and/or modified sequence opt5 from Caplacizumab_HeavyChain1

SEQ ID NO: 38355 - RNA, 1347 nt, Artificial Sequence
  derived and/or modified sequence opt5 from Carlumab_HeavyChain1
caggugcaacugguccagagcggcgcugagguuaagaaacccggguccucugugaaggugagcugcaaggcuuccggaggcaccuucucuagcuacgggaucuccugggucagacaggccccuggacagggccucgaauggaugggagggauuaucccgauuuuuggcacagcgaacuaugcucaaaaauuccagggccgggugacgaucaccgccgacgagucuacaagcaccgccuacauggaacuguccagccuucgcucugaggauacagcuguuuauuacugugccagauaugacgggauuuacggagaacuggauuuuuggggccaggggacccucgugacagucuccagcgcuucuaccaaaggacccuccguguucccucuggcccccagcucuaaguccacgagcggcgggaccgcggcccuuggaugccugguuaaggacuauuuuccugagcccgugacagucuccuggaacucuggcgcucucaccagcggcgugcacacauucccugccgugcugcaguccagcgggcuguacucucucuccagcgucguuaccgugccgucuagcucccugggaacgcaaacauacaucuguaaugugaaucauaaacccucuaacaccaaggucgauaaaaagguggagccuaaaagcugcgacaagacacacaccugucccccuugccccgcuccggaacuucugggcgggccuuccguuuuucucuuucccccuaagcccaaagauacccugaugaucagccggacacccgaggugacgugugucgugguugacgugucucaugaagauccugaggucaaguuuaauugguauguggacggagucgaggugcacaacgccaaaaccaagccgcgcgaggaacaguacaauuccacauauagaguugugagcguccuuaccgugcugcaucaggauuggcucaacggcaaagaauacaagugcaaaguuucuaauaaggcgcugcccgccccuauugagaagacaaucuccaaagcuaaggggcagccccgggaaccucaaguguauacccugcccccgagccgcgacgagcucacgaaaaaccaggucucccugacaugucuugugaagggauucuacccuucugauauugccguggagugggaaagcaauggccagcccgagaacaauuauaaaaccaccccucccguucuggacuccgacggcucuuucuuccucuacagcaagcugacagucgauaaguccagauggcaacaggggaacguguuuagcugcucugugaugcacgaagcccuucacaaucauuacacccagaaaucccugagccucucuccuggaaag

SEQ ID NO: 38356 - RNA, 648 nt, Artificial Sequence
  derived and/or modified sequence opt5 from Carlumab_LightChain1
gagaucgugcugacccagagccccgccacacucagccugucuccuggcgaacgggcuacgcuuagcugccgggccucccaaucugucagcgacgcguaccuggcuugguaucagcagaagccggggcaggcuccccgccuccugauuuacgaugccuccucuagagccaccggaguuccugcccgguucagcggcuccgggagcggaacagacuuuacccuuacaaucucuucccuggagcccgaagauuucgcuguguauuacugucaccaauauauucagcuccauagcuuuaccuucggccaggggacaaaaguggagaucaagcgcaccgucgccgcgccuucuguguuuauuuuucccccuuccgacgaacagcugaaaagcggaacggccucuguugugugccugcucaacaauuucuacccgagagaggcuaagguccaauggaaaguggauaacgcccugcaguccggcaauagccaggaguccguuaccgaacaggacucuaaggauagcacauauucccuuagcucuacccugacacucuccaaggcugacuacgagaaacacaagguguacgccugugaagucacccaucaaggccugagcucucccgugacgaaauccuucaacagaggggagugc

SEQ ID NO: 38357 - RNA, 1353 nt, Artificial Sequence
  derived and/or modified sequence opt5 from Cergutuzumab_amunaleukin_HeavyChain1
caggugcaacugguccagagcggcgccgagguuaagaaacccggggcuuccgugaaggugucuugcaaagccagcggauacaccuucacagaauuuggcaugaacugggucagacaggcgccugggcagggacucgaguggaugggcuggaucaauacgaagaccggggaagcuacauauguggaggaguucaaaggacggguuaccuuuacaaccgacacauccaccucuacggccuacauggagcugcgcagccuuagauccgaugacaccgccguguauuacugugcucggugggauuucgccuauuacgucgaggcuauggacuauuggggccaaggcacaaccgugacaguuucuagcgccuccaccaaggggccgagcguguuuccccuggcgccuucuuccaagagcacgucuggaggcacagccgcucucgggugccuggucaaagauuacuuccccgaaccugugaccguguccuggaacagcggagcccuuacaucuggcguccacaccuuucccgcuguucugcaguccagcgggcucuacucccugucuagcguggugaccgucccuuccagcucucugggaacacagacguauauuuguaaugugaaccauaagccguccaauaccaaaguugacaagaaaguggagcccaagagcugcgauaagacacacaccuguccucccugcccugcccccgaagcggccggcggcccgucugucuuccucuuuccucccaaaccuaaggacacacugaugaucagccgcacccccgaggugacguguguuguggucgaugugucccaugaggaccccgaagucaaauucaacugguacguggaugggguugaggugcacaaugcuaagacaaaaccuagagaagaacaguauaacucuaccuaccgggucgugagcguucuuaccgugcugcaucaagacuggcucaauggaaaggaauauaaaugcaaggucuccaacaaggcccugggcgcuccgauugagaaaacaaucagcaaggccaaagggcagccccgcgagccucagguguguacccuucccccuucuagagaugaacugacaaagaaucaggugucccucagcugcgccguuaaaggauuuuaccccucugacauugcugucgagugggaauccaacggccaaccggagaauaacuauaagacgaccccucccgugcuggacagcgauggguccuucuuucuggugucuaagcucacagucgacaaaagccgguggcagcagggaaauguguucuccuguucuguuaugcacgaagcgcugcacaaccauuacacccaaaagagccuuucccugagcccuggcaaa

SEQ ID NO: 38358 - RNA, 1794 nt, Artificial Sequence
  derived and/or modified sequence opt5 from Cergutuzumab_amunaleukin_HeavyChain2
caggugcaacugguccagagcggcgccgagguuaagaaacccggggcuuccgugaaggugucuugcaaagccagcggauacaccuucacagaauuuggcaugaacugggucagacaggcgccugggcagggacucgaguggaugggcuggaucaauacgaagaccggggaagcuacauauguggaggaguucaaaggacggguuaccuuuacaaccgacacauccaccucuacggccuacauggagcugcgcagccuuagauccgaugacaccgccguguauuacugugcucggugggauuucgccuauuacgucgaggcuauggacuauuggggccaaggcacaaccgugacaguuucuagcgccuccaccaaggggccgagcguguuuccccuggcgccuucuuccaagagcacgucuggaggcacagccgcucucgggugccuggucaaagauuacuuccccgaaccugugaccguguccuggaacagcggagcccuuacaucuggcguccacaccuuucccgcuguucugcaguccagcgggcucuacucccugucuagcguggugaccgucccuuccagcucucugggaacacagacguauauuuguaaugugaaccauaagccguccaauaccaaaguugacaagaaaguggagcccaagagcugcgauaagacacacaccuguccucccugcccugcccccgaagcggccggcggcccgucugucuuccucuuuccucccaaaccuaaggacacacugaugaucagccgcacccccgaggugacguguguuguggucgaugugucccaugaggaccccgaagucaaauucaacugguacguggaugggguugaggugcacaaugcuaagacaaaaccuagagaagaacaguauaacucuaccuaccgggucgugagcguucuuaccgugcugcaucaagacuggcucaauggaaaggaauauaaaugcaaggucuccaacaaggcccugggcgcuccgauugagaaaacaaucagcaaggccaaagggcagccccgcgagccucagguguacacccuucccccuuguagagaugaacugacaaagaaucaggugucucucuggugccugguuaaaggauuuuaucccuccgacauugccgucgagugggaaagcaacggccaaccggagaauaacuacaagacgaccccucccgugcuggacucugauggguccuucuuucucuacagcaagcugacaguggacaaaucccgguggcagcagggaaaugucuucucuuguagcgugaugcacgaagcucugcacaaccauuauacccaaaagucccugucucucagcccuggcggcgggggaggcuccgggggaggcgggagcggcggaggcgggucugcgcccgccuccagcucuaccaaaaagacacagcugcagcuugagcaccuucuccuggaucugcagaugauccucaacggaaucaauaacuacaaaaauccuaagcugacgcgcaugcuuaccgcuaaguucgccaugcccaaaaaggccacagagcugaaacaucuccaaugccuggaagaggaacuuaagccgcuggaggaaguucucaacggcgcucaguccaaaaauuuucaccugagaccucgggaccugauuagcaacaucaaugugauuguccucgagcugaaggggucugagaccacauucaugugcgaauaugccgaugagaccgcgacgaucguggaauuucuuaaccgcuggauuacauucgcucagagcaucauuuccacccugaca

SEQ ID NO: 38359 - RNA, 645 nt, Artificial Sequence
  derived and/or modified sequence opt5 from Cergutuzumab_amunaleukin_LightChain1
gacauccagaugacccaaagccccuccucucugagcgccuccgugggcgauagagucacaauuacgugcaaggcuucugccgcgguugggaccuacguggcuugguaucagcagaaaccuggaaaggccccgaaacuccugaucuacagcgccuccuaucggaagcgcggcgugcccucuagauucagcggguccggaagcggcacagacuuuacccuuacaauuucuucccugcagccugaggauuucgcuaccuacuauugucaccaauacuauacauacccccucuuuaccuucgggcagggaacgaaacuggaaaucaagcggaccgucgccgcuccuagcguguuuauuuuucccccuucugacgagcagcuuaaguccggcacagccagcguugugugccugcucaacaauuucuacccgcgcgaagcgaaaguccaguggaagguggauaacgcccugcaaucuggcaauucccaggagagcguuaccgaacaggacuccaaagauucuacauauagccuguccagcacccucacgcugucuaaggcugacuacgagaaacauaagguguaugccugugaggucacacaccaggggcuuuccagccccgugaccaagucuuucaacagaggagaaugc

SEQ ID NO: 38360 - RNA, 687 nt, Artificial Sequence
  derived and/or modified sequence opt5 from Certolizumab_pegol_HeavyChain1
gaggugcagcuggucgaaagcggcgggggacucguucaacccggcgggucccugagacuuucuugcgccgcuagcggauacguguucaccgacuauggcaugaacugggugcggcaggccccugggaagggacuggaguggaugggcuggaucaauacauacauuggcgaaccgaucuaugcggauuccgucaaagggcgcuuuacguucucucucgacaccagcaaguccacagcuuaccugcagaugaacucucuuagagccgaggauaccgccguguauuacugugcucggggauaucgcagcuacgccauggacuacuggggccaggggacacugguuaccguguccagcgcuucuacaaaaggacccuccgucuuuccucucgcccccagcucuaaguccaccagcggcgggacggcggcccugggaugccuggugaaagauuauuucccugaacccguuaccgugucuuggaacuccggcgcucucacaagcggcguccacaccuuuccugccgugcugcaauccucugggcuuuacagccuguccagcguggucacaguuccgucuuccagccucggaacccagacguauauuuguaaugugaaucauaagcccucuaacacaaagguggacaaaaaggucgagccuaaaagcugcgauaagacccacacaugugcugcc

SEQ ID NO: 38361 - RNA, 687 nt, Artificial Sequence; identical to SEQ ID NO: 38360
  derived and/or modified sequence opt5 from Certolizumab_pegol_HeavyChain

SEQ ID NO: 38362 - RNA, 642 nt, Artificial Sequence
  derived and/or modified sequence opt5 from Certolizumab_pegol_LightChain1
gacauccagaugacccaaagccccuccucucugagcgccuccgugggcgauagagucacaauuacgugcaaggcuucucagaacguugggaccaauguggccugguaccagcagaaaccuggaaaggcgccgaaagcucucaucuauagcgccuccuuccuguacucuggcgugcccuaucgguuuagcggguccggaagcggcacagacuucacccuuacaauuucuucccugcaaccugaggauuuugccaccuacuauugucagcaguacaacaucuauccccucacauucgggcagggaaccaaggucgaaauuaaacgcacgguggcugccccuagcguuuuuaucuuucccccuucugacgagcaacugaaguccggcaccgcuagcguggucugccuucugaauaacuucuacccgagagaagccaaggugcaguggaaaguugauaaugcgcuccagucuggcaacucccaggagagcgugacagaacaagacuccaaggauucuaccuacagccuguccagcacacugacccucucuaaagccgacuaugagaagcacaaagucuacgcuugugaggugacgcaucaggggcuguccagccccgugacaaagucuuucaaucggggagaaugc

SEQ ID NO: 38363 - RNA, 642 nt, Artificial Sequence; identical to SEQ ID NO: 38362
  derived and/or modified sequence opt5 from Certolizumab_pegol_LightChain

SEQ ID NO: 38364 - RNA, 1356 nt, Artificial Sequence
  derived and/or modified sequence opt5 from Cetuximab_HeavyChain
caggugcaacugaagcagagcggccccgggcucguccagccuucccagucucugagcaucacaugcacaguuuccggauucucucuuacgaacuacggcgugcacugggugagacaaagcccggggaaaggacuggaguggcucggcgucauuugguccgggggaaauaccgacuauaacacacccuuuaccucucggcugagcaucaauaaggauaacuccaaaagccagguguucuuuaagaugaacucucuucaguccaaugacacagccauuuacuauugugcucgcgcccugaccuacuaugauuacgaguucgcguauuggggccagggcacacucguuaccgugagcgcugccucuacgaaagggccuuccgucuuuccccuggccccuagcucuaaguccaccagcggaggcacagcugcccuggggugccucgugaaggacuacuuccccgaaccuguuaccguguccuggaacucuggagcucugacaagcggcguccauaccuuuccggccgugcuucaauccagcgggcuguacucucucuccagcguggucacgguucccucuagcucccugggaacacagaccuauaucuguaaugugaaucacaaaccuucuaacacaaagguggauaaaagagucgaacccaagagcccuaaauccugcgacaagacccauaccugucccccgugcccugcgcccgagcuucugggcggcccuagcguguuccucuuuccucccaagcccaaagauacacugaugauuucucggacgccggaaguuaccuguguggucguggacguuucccacgaggaucccgaggugaaguucaauugguacgucgacgggguggaaguccauaacgccaaaacaaagccucgcgaggaacaguauaauagcaccuacagagugguuucugugcugacaguccuccaccaggauuggcugaacggaaaagaguauaagugcaaaguguccaauaaggcccuucccgcuccuaucgagaagaccaucagcaaagcuaagggccaaccccgggaaccgcagguuuacacgcugccucccucccgcgacgagcucaccaaaaaccaggugucucugaccugucuugucaagggguuuuauccuagcgauauugccguggaaugggaguccaacggacaacccgaaaauaacuacaaaaccacaccucccgugcuggacucugacggcagcuucuuucucuacuccaagcugaccguugauaagagcagauggcagcaggggaaugucuucucuugcuccgugaugcacgaggcgcugcauaaccacuauacacagaaaagccucucucuguccccgggaaag

SEQ ID NO: 38365 - RNA, 1347 nt, Artificial Sequence
  derived and/or modified sequence opt5 from Cetuximab_HeavyChain_variant
caggugcaacugaagcagagcggccccgggcucguccagccuucccagucucugagcaucacaugcacaguuuccggauucucucuuacgaacuacggcgugcacugggugagacaaagcccggggaaaggacuggaguggcucggcgucauuugguccgggggaaauaccgacuauaacacacccuuuaccucucggcugagcaucaauaaggauaacuccaaaagccagguguucuuuaagaugaacucucuucaguccaaugacacagccauuuacuauugugcucgcgcccugaccuacuaugauuacgaguucgcguauuggggccagggcacacucguuaccgugagcgcugccucuacgaaagggccuuccgucuuuccccuggccccuagcucuaaguccaccagcggaggcacagcugcccuggggugccucgugaaggacuacuuccccgaaccuguuaccguguccuggaacucuggagcucugacaagcggcguccauaccuuuccggccgugcuucaauccagcgggcuguacucucucuccagcguggucacgguucccucuagcucccugggaacacagaccuauaucuguaaugugaaucacaaaccuucuaacacaaagguggauaaaaaggucgaacccaaaagcugcgacaagacccauaccuguccucccugcccggcgccugagcuucugggcggccccuccguguuccucuuuccucccaagcccaaagauacacugaugauuagcagaacgccugaaguuaccuguguggucguggacguuucucacgaggauccggaggugaaguucaauugguacgucgacgggguggaaguccauaacgccaaaacaaagccccgggaggaacaguauaauuccaccuaccgcgugguuagcgugcugacaguccuccaccaggauuggcugaacggaaaagaguauaagugcaaagugucuaauaaggcccuuccugcucccaucgagaagaccaucuccaaagcuaagggccaaccuagagaaccccagguuuacacgcugccgccuagccgggacgagcucaccaaaaaccaggugucccugaccugucuugucaagggguuuuaucccucugauauugccguggaaugggagagcaacggacaaccugaaaauaacuacaaaaccacacccccugugcuggacuccgacggcucuuucuuucucuacagcaagcugaccguugauaagucccgcuggcagcaggggaaugucuucagcugcucugugaugcacgaggcgcugcauaaccacuauacacagaaaucccucagccugucucccggaaag

SEQ ID NO: 38366 - RNA, 639 nt, Artificial Sequence
  derived and/or modified sequence opt5 from Cetuximab_LightChain
gacauccugcucacccagagccccgugauucuguccgucucuccuggcgagagaguuagcuucuccugccgggccucucaaagcaucgggacaaacauucacugguaccagcagcgcacgaauggauccccgagacuucugaucaaauaugcuucugaaagcauuuccggcauccccagccgguuuucuggguccggaagcggcaccgauuucacacucucuaucaacuccguggagagcgaagacauugccgauuacuauugucagcaaaauaacaauuggccuaccacauuuggggcgggaaccaaacuggagcuuaagcgcacaguggcugcccccucugucuucaucuuuccucccuccgacgaacagcugaaaagcggcaccgccuccgugguuugccuccugaacaauuucuacccuagagaggcuaaggugcaguggaaagucgauaacgcccugcagucuggcaauagccaagaguccgugacggaacaggacagcaaggauucuaccuauucccucagcucuacacugacccuuagcaaggcugacuacgagaaacauaagguuuaugccugugaagugacacaccaggggcuguccucuccggucaccaagagcuuuaaccggggagcg

SEQ ID NO: 38367 - RNA, 642 nt, Artificial Sequence
  derived and/or modified sequence opt5 from Cetuximab_LightChain_variant
gacauccugcucacccagagccccgugauucuguccgucucuccuggcgagagaguuagcuucuccugccgggccucucaaagcaucgggacaaacauucacugguaccagcagcgcacgaauggauccccgagacuucugaucaaauaugcuucugaaagcauuuccggcauccccagccgguuuucuggguccggaagcggcaccgauuucacacucucuaucaacuccguggagagcgaagacauugccgauuacuauugucagcaaaauaacaauuggccuaccacauuuggggcgggaaccaaacuggagcuuaagcgcacaguggcugcccccucugucuucaucuuuccucccuccgacgaacagcugaaaagcggcaccgccuccgugguuugccuccugaacaauuucuacccuagagaggcuaaggugcaguggaaagucgauaacgcccugcagucuggcaauagccaagaguccgugacggaacaggacagcaaggauucuaccuauucccucagcucuacacugacccuuagcaaggcugacuacgagaaacauaagguuuaugccugugaagugacacaccaggggcuguccucuccggucaccaagagcuuuaaccggggagagugc

SEQ ID NO: 38368 - RNA, 675 nt, Artificial Sequence
  derived and/or modified sequence opt5 from Citatuzumab_bogatox_HeavyChain1
caccaucaccaucaccaugaggugcagcugguccaaagcggccccgggcucguucagccuggaggcuccgugagaaucucuugcgccgcuagcggguacaccuucacaaacuauggaaugaauugggugaagcaggccccgggcaaagggcuggaauggaugggauggauuaacacguacaccggcgaguccacauaugcggacucuuuuaagggccgguucaccuuuagccuugauacauccgcuucugccgccuaccugcagaucaauagccuccgcgcugaagacaccgccgucuauuacugugcuagauucgccauuaaaggggauuauuggggacaaggcacacugcuuaccguguccagcgcgucuacgaaggggcccuccguuuuuccucuggcccccagcucuaaauccaccagcggaggcacagcugcccucgggugccuggugaaggacuacuucccugagcccgucaccgugucuuggaacuccggagcucugacaagcggcguucacaccuuuccugccgugcuccaguccucuggccuguacagccuuuccagcgucgugacggugccgucuuccagccuggggacacagaccuauaucuguaaugucaaccacaagcccucuaauacaaaaguugauaagaaaguggaaccuaagagcugc

SEQ ID NO: 38369 - RNA, 1443 nt, Artificial Sequence
  derived and/or modified sequence opt5 from Citatuzumab_bogatox_LightChain1
gacauccagaugacccaaagccccuccucucugagcgccuccgugggcgauagagucacaauuacgugccggucuaccaagagccuccugcacuccaacgggaucacauaccuuuauugguaccagcagaaaccuggaaaggcuccgaaacugcucauuuaucagaugucuaaucuggccagcggcguucccucccgcuucucuagcuccgggagcggaaccgacuuuacacuuaccaucucuucccugcaaccugaggauuucgcgacauacuauugugcucagaaccucgaaauucccagaaccuuuggccaggggacgaagguggagcugaaacggaccguggccgccccuagcgucuucaucuuucccccuucugacgaacagcugaaguccggaacagcuagcgugguuugccuccugaauaacuucuacccgcgcgaggccaaggugcaauggaaagucgauaaugcccuucaguccggcaacucucaggaaagcgugaccgagcaggacuccaaggauagcacauauucucuguccagcacccucacgcugucuaaagcugacuacgagaagcauaaaguuuacgcgugugaagugacacaccaaggccuuagcucccccgucaccaagucuuuuaauagaggggagugcacacggcaucgccagccuagaggaugggaacagcuguauaacaccgugagcuucaaucucggcgaggccuacgaguaucccaccuuuauccaagaucugcggaacgaacuggcuaaggggacaccugugugucagcuccccgucacgcugcagaccauugccgacgauaaacgcuucguucuuguggacaucacaaccacauccaagaaaaccgugaaggucgcuauugaugugacggacguuuacguggucggauaucaggacaaaugggauggcaaggacagagccguguuucuggauaaaguuccgacaguggcgaccagcaaacucuucccuggggucaccaaucgggugacacugaccuuugacggaucuuaccaaaaacuugucaacgccgcuaaggccgaucgcaaggcucuggagcucggcgugaauaagcuggaguucuccaucgaagccauucacggcaagacaaucaacgggcaggaagccgcuaaauucuuucugauuguuauccagauggugagcgaggcggccagauucaaguauaucgagacggaagucguggaccggggacucuacggcucuuuuaagcccaauuucaaaguucugaaccuugagaacaauuggggagauauuuccgacgcuauccauaagagcuccccucagugcaccacaauuaaccccgcccugcaacucaucucucccagcaaugauccuuggguggucaacaaagugucccagauuucuccggacauggggauccugaaguuuaaaagcuccaag

SEQ ID NO: 38370 - RNA, 1380 nt, Artificial Sequence
  derived and/or modified sequence opt5 from Cixutumumab_HeavyChain1
gaggugcagcugguccaaagcggcgccgaaguuaagaaacccggguccucugugaaggugagcugcaaagccuccggaggcaccuucucuagcuacgccaucuccugggucagacaggcgccugggcagggacucgaguggaugggcgggauuaucccgauuuuuggaacagcuaacuaugcccagaaguuccaaggccgggugacgaucaccgccgacaaaucuacaagcaccgcuuacauggaacuguccagccuucgcucugaggauacagccguuuauuacugugcuagagcuccccugcgguuucucgaaugguccacccaggaccacuauuacuauuacuacauggauguguggggcaaggggacaaccgucacggugagcucugcguccaccaagggaccuagcguuuucccccuggccccuucuuccaaaagcacauccggcgggaccgcugcccuuggaugccuggugaaggacuauuuucccgagccugucacagugucuuggaauagcggcgcucucaccuccggggugcauacguucccggccguccugcagagcucuggacuguacucccucagcucuguugugacagugcccagcuccucucugggcacccagacauauauuuguaacgucaaucacaaaccuagcaacaccaagguggauaaaaagguugagcccaaguccugcgacaaaacccauacauguccucccugcccggcgccugaacuucugggcgggcccagcguguuucucuucccucccaagcccaaagauacgcugaugaucucucgcaccccugaggucacaugugugguuguggacgucucccacgaagauccggaggugaaguuuaauugguacgucgacggaguggagguucauaacgccaaaaccaagcccagagaggaacaauauaauagcacauaccggguggucucugugcuuaccguucugcaccaggauuggcucaacggcaaagaauauaagugcaagguguccaauaaagcucugccugcccccaucgagaagacgauuagcaaagcuaaggggcagccucgcgaaccccaggucuacacacugccgccuuccagagaggagaugaccaaaaaccaagugucucucaccugucuggugaagggauucuaccccagcgacaucgccguugaaugggaguccaauggccagccugaaaacaauuauaagacaacacccccuguccuugauucugacgggagcuuuuuccuguacuccaaacucaccguggacaagagccgguggcagcaaggaaacguguuuucuugcuccgucaugcacgaggcccugcauaaucacuauacgcagaaaagccuuucucugucccccggcaag

SEQ ID NO: 38371 - RNA, 642 nt, Artificial Sequence
  derived and/or modified sequence opt5 from Cixutumumab_LightChain1
agcuccgagcugacccaggaccccgccgugucugucgcucucggccaaacaguuagaaucacgugccagggggauagccugcgguccuacuaugccaccugguaccagcagaagccuggacaagcgccgauucuugugaucuauggcgaaaacaaacgccccucugggauuccugacagauucagcggauccucuagcggcaauacagcuucccugaccaucacaggggcccaggccgaggaugaagcugacuacuauuguaagagccgggauggaucuggccagcaccucguguuuggcgggggaaccaaacugacaguccuuggccagcccaaggccgcuccuuccgugacccuguuucccccuagcucugaggaacuccaagccaacaaagcgacgcugguuugccugauuuccgacuucuacccgggggccgugaccgucgcuuggaaggccgauagcucucccgugaaggcuggaguugagacaaccacaccuuccaaacagagcaauaacaaguaugccgcguccucuuaccucagccugacccccgagcaguggaaaucccaucgcagcuacucuugucaggugacgcacgaaggcuccacagucgagaagaccguggccccugcugaaugcagc

SEQ ID NO: 38372 - RNA, 1350 nt, Artificial Sequence
  derived and/or modified sequence opt5 from Clazakizumab_HeavyChain1
gaggugcagcuggucgaaagcggcgggggacucguucaacccggcgggucccugagacuuucuugcgccgcuagcggauucucccugucuaacuacuaugugaccugggugcggcaggccccuggcaaggggcucgagugggucggaaucauuuacggcagcgacgaaacagcguaugcuacguccgccaucggccgcuuuaccauuucuagagauaauagcaaaaacacacuguaccuucagaugaacucccugcgggccgaggacaccgcuguguauuacugugcccgcgaugacagcucugauugggacgcuaaguucaaucucugggggcagggaacacugguuaccguguccagcgccucuacaaaaggcccguccgucuuuccccuggcgccuagcucuaaguccaccagcgggggaacggccgcucucggcugccuggugaaagauuauuuccccgaaccuguuaccguguccuggaacucuggggcccuuacaagcggaguccacaccuuucccgcugugcugcaauccagcggccucuacucucuguccagcguggucacaguuccuucuagcucccuuggcacccagacguacaucuguaaugugaaucauaagccgucuaacacaaagguggacaaaagagucgagcccaagagcugcgauaaaacccacacauguccucccugcccugcccccgagcugcucgggggaccguccguguuccuguuuccucccaagccuaaagacacccugaugauuagccggacccccgaaguuacauguguggucguggauguuucucaugaggaccccgaagugaaguucaauugguaugucgauggcguggagguccacaacgcgaagacgaaaccucgcgaggaacaguacgccuccaccuauagagugguuagcgugcucacaguccugcaucaggacuggcuuaaugggaaggaguacaaaugcaaggugucuaacaaagcucugccggcccccaucgaaaagaccaucuccaaagcuaagggacaaccucgggagccccagguuuauacacucccucccagccgcgaagagaugaccaagaaucaggugucccugacgugucuugucaaaggcuuuuacccgucugacauugccguggagugggaaagcaacgggcagccugagaauaacuauaagacaacacccccugugcuggauuccgacggaucuuucuuucucuacagcaaacugaccguugauaaguccagauggcaacagggcaacgucuucagcugcucugugaugcacgaagcccugcacaaucauuacacccagaaaucccucagccugucucccggcaag

SEQ ID NO: 38373 - RNA, 651 nt, Artificial Sequence
  derived and/or modified sequence opt5 from Clazakizumab_LightChain1
gccauccagaugacccaaagccccuccucucugagcgcuuccgugggcgacagagucacaauuacgugccaggccucucagagcaucaacaaugagcucuccugguaccagcaaaagccugggaaagcgccgaagcugcuuauuuaucgggcuucuacccuggccagcggaguucccucccgcuucagcggcucuggguccggaacagauuuuacccucacaaucagcucucugcagccugacgauuucgccaccuacuauugucagcagggcuacucccuuagaaacauugacaaugcuuuugggggaggcacaaaaguggaaaucaagcggaccguggccgcucccagcgucuucaucuuuccucccucugaugagcaacugaaauccggcacggccagcgugguuugccuccugaacaauuucuauccucgcgaagcgaaggugcaguggaaggucgacaacgcccugcaguccggaaauucucaggagagcgugaccgaacaagauuccaaagacagcacauacucucucuccagcacccugacacuuucuaaggcugauuaugagaaacacaagguuuacgccugugaggugacccaucaggggcugagcuccccggucacgaaaucuuuuaacagaggcgaaugc

SEQ ID NO: 38374 - RNA, 1347 nt, Artificial Sequence
  derived and/or modified sequence opt5 from Clivatuzumab_tetraxetan_HeavyChain1
caggugcaacugcagcagagcggcgcugaggucaagaaacccggggcuuccguuaaggugucuugcgaagccagcggauacaccuucccuuccuaugugcuccacugggucaaacaggcgccgggccaagggcuggaguggaucggauacauuaaccccuauaaugacggcacacaguacaacgaaaaguuuaaagggaaggcuacgcuuaccagagauacaucuaucaauaccgccuauauggagcugagccggcuccgcuccgacgauacagccguguacuauugugcuagaggauucggcggcucuuacggguuugccuacuggggacagggcacccugguuacagugagcuccgcuagcaccaaggggccuucugucuucccccuugccccuuccagcaaaucuacguccggaggcaccgcggcccuggggugccucgugaaggacuauuuucccgaaccuguuacagugagcuggaacucuggagcucugaccuccggcguccauacauucccggccgugcugcagagcuccggccucuacucucugagcuccguggucaccguucccucuagcucccuugggacgcaaacauauauuuguaaugugaaccacaaaccuagcaauaccaagguggauaaacgggucgagcccaagucuugcgacaagacacauaccuguccucccugcccggcuccugagcugcucggaggccccagcguguuucuguucccucccaaacccaaggauacccuuaugaucucccgcacaccugaaguuacguguguggucguggacguuucucacgaggauccggaagugaaauuuaacugguacgucgacgggguggagguccauaaugccaagaccaaacccagagaggaacaguauaacagcacauaccgggugguuuccgugcugaccguccuccaccaggauuggcugaauggaaaggaguauaaaugcaaggugagcaacaaggcgcugccugcccccauugaaaagacaaucucuaaggcuaaaggccagccucgcgagccccaaguuuacacccucccgccuuccagagaagagaugacgaagaaucaggugagccugacaugucuugucaaaggguucuaccccucugacaucgccguggagugggaauccaacggacagccugagaauaacuauaagaccacacccccugugcuggauagcgacggcuccuuuuuccucuacucuaagcugaccguugacaaaagccgguggcaacagggcaacgucuuuuccugcucugugaugcacgaagcccuucauaaucacuauacccagaaaagccugucccucagccccgggaaa

SEQ ID NO: 38375 - RNA, 645 nt, Artificial Sequence
  derived and/or modified sequence opt5 from Clivatuzumab_tetraxetan_LightChain1
gacauccagcugacccaaagccccuccucucucagcgccuccgugggcgauagagucacaaugacgugcucugcuagcuccucuguuagcuccagcuaccuguauugguaccagcagaagccugggaaagccccgaaacuuuggauuuauucuaccuccaaccuggcgagcggagugcccgcucgguucucuggcuccgggagcggaacagacuuuacccucacaaucucuucccugcagccugaggauagcgccuccuacuucugucaccaauggaaucgcuaucccuacaccuuuggcgggggaacaagacuugaaauuaagcggaccguggccgcuccuucugucuucaucuuucccccuagcgacgagcagcugaaguccggcacggccagcgugguuugccuccugaacaauuucuauccgcgcgaagcuaaagugcaguggaaggucgauaacgcccugcagucuggcaauucccaagagagcgugaccgaacaggacucuaaggauagcacauacucccucucuagcacccugacacuuuccaaagcggacuacgagaagcauaaaguuuaugccugugaggugacccaccaggggcugagcucucccgucacgaaguccuuuaacagaggagaaugc

SEQ ID NO: 38376 - RNA, 1335 nt, Artificial Sequence
  derived and/or modified sequence opt5 from Codrituzumab_HeavyChain1
caggugcaacugguccagagcggcgccgagguuaagaaacccggggcuuccgugaaggugucuugcaaagccagcggauacaccuucacagacuaugaaaugcacugggucagacaggcgccuggccaggggcucgaguggaugggagcucuggauccgaagacgggcgacaccgccuacucccaaaaauuuaaggggcgggugacacuuaccgccgauaagucuacaagcaccgcuuauauggaacuguccucucucacaagcgaggacaccgccguuuacuauuguacgcgcuucuacuccuauaccuacuggggacagggcacacuggugaccgucagcucugcuuccacaaaaggccccagcguguuuccucuugcccccucuuccaagagcaccucugggggaacggcggcccugggcugccucguuaaagauuacuucccugaacccgugacagucuccuggaacagcggggcucugaccuccggagugcauacauuuccugccgugcugcagucuagcggccucuauucccugagcucugucguuaccgugccguccagcucucuugggacccagacauacaucuguaaugugaaccacaagcccagcaauacgaaagucgacaagaagguggagccuaaauccugcgauaagacccauacaugucccccuugccccgcuccggagcugcucggaggcccuucuguuuuccuguuucccccuaaacccaaggacacccuuaugauuagcagaacacccgaagugaccugugucgugguugaugugucccacgaggacccugaagucaaauucaacugguauguggauggcgucgaggugcauaaugccaagacgaaaccgcgggaggaacaauacaacagcacauaucgcguugugucuguccugaccgugcuccaccaggacuggcugaaugggaaggaguacaagugcaaaguuuccaacaaggcgcugcccgccccuaucgaaaagaccauuagcaaggcuaaaggacagcccagagagccucagguguauacacuucccccgucucgggaugaacugaccaagaaucaagucucccuuacaugucuggugaagggcuuuuacccuagcgacaucgccguggagugggaguccaacgggcagcccgaaaauaacuacaaaacgaccccucccguucucgacucugauggcagcuucuuucuguauuccaagcucacagucgacaaaucucgcuggcagcaaggaaauguguucagcugcuccgugaugcacgaggcucugcauaaccacuacacccagaaaagccucucucuguccccugggaaa

SEQ ID NO: 38377 - RNA, 657 nt, Artificial Sequence
  derived and/or modified sequence opt5 from Codrituzumab_LightChain1
gacguggucaugacccagagcccccugucccucccuguuacaccgggcgagcccgccucuaucagcugcagauccucucaaagccuggugcacuccaaccggaauacguaccuucauugguaucugcagaagccugggcagucuccccagcuccugauuuacaaagugagcaaccgcuucuccggagucccugauagauuuagcggcucuggguccggaaccgacuucacacuuaagaucagccggguggaagcugaggauguuggcguguauuacuguucucaaaauacccacgugcccccuacauuugggcagggaaccaaacuggaaauuaagcgcacagucgccgcgccguccguuuucaucuuucccccuagcgacgagcagcucaaaucuggcaccgcuuccguggucugccugcugaacaauuucuaucccagagaagccaaggugcaguggaagguggauaacgcccuccaaagcggcaauucccaggagucugucacggagcaggacagcaaagauuccaccuacagccugucuuccacacuuacccugagcaaggcugacuaugaaaaacauaagguuuacgccugugaggugacacaccaggggcucucuagcccugugaccaaauccuuuaaccggggagaaugc

SEQ ID NO: 38378 - RNA, 1350 nt, Artificial Sequence
  derived and/or modified sequence opt5 from Coltuximab_ravtansine_HeavyChain1
caggugcaacugguccagcccggcgccgagguugugaagccuggggcuagcgugaaacucuccugcaagaccucuggauacacauucacgagcaacuggaugcacugggucaaacaggccccgggccaggggcuggaauggaucggagagauugaccccuccgauucuuauaccaauuacaaccaaaauuuucagggcaaggcgaaacuuacaguggacaagagcaccuccacagcuuauauggaaguuucuagccugagauccgaugacaccgccguguacuauugugcccgggggagcaacccuuacuauuacgcuauggauuacuggggacagggcacaucugucaccguguccagcgccucuacgaagggccccuccguuuucccucucgcucccagcucuaaauccaccagcgggggaacagccgcgcugggcugccuugugaaggacuauuuuccugagccggucaccguguccuggaacucuggggcccugacaagcggagugcauaccuuccccgcuguccuccaguccagcggccuguacucucuguccagcguugugacggugccuucuagcucccucgggacacaaaccuauaucuguaaugucaaucacaaacccucuaacacaaagguggauaaaaagguugaaccuaagagcugcgacaaaacccauaccugucccccgugcccugcccccgagcugcuuggaggcccuuccguguuucuguucccucccaagcccaaagauacacucaugauuagccgcacgccggaggucaccugugugguuguggacgucucucacgaagaucccgaggugaaguuuaauugguacgucgacggcguggaaguucauaacgcuaaaacaaagccuagagaggagcaguauaauuccaccuaccggguggucagcgugcugacaguucuucaccaggauuggcugaacgggaaagaauauaagugcaaggugucuaauaaagcccuccccgcgccuaucgagaagaccauuuccaaagccaagggacagccccgcgaaccgcaagucuacacgcugccucccagcagagacgagcugaccaaaaaccaggugucccucacaugucuggugaagggcuucuacccuucugacaucgcuguugaaugggagagcaaugggcagcccgagaacaacuauaagaccacaccucccguccuugauuccgacggaucuuucuuucuguacagcaaacucaccguggauaagucccgguggcaacagggcaauguguuuagcugcucugucaugcacgaagcccugcauaaccacuauacacagaaaucccuuagccugucuccggggaag

SEQ ID NO: 38379 - RNA, 633 nt, Artificial Sequence
  derived and/or modified sequence opt5 from Coltuximab_ravtansine_LightChain1
gagaucgugcugacccagagccccgccauuauguccgcuucuccuggcgaacgggucacaaugacgugcagcgccuccucugggguuaacuacaugcacugguaucaacagaagccgggaaccagcccccggcgcuggaucuacgacacauccaaacucgcgucuggcgugccugcuagauucagcggguccggaagcggcaccgauuauucucugacaauuuccagcauggagcccgaagacgccgccaccuacuauugucaucagcgggggucuuacacauuuggaggcggcaccaaacuugagaucaagcgcacgguggcugccccuuccgucuucauuuuucccccuagcgaugaacagcugaagucugggaccgcuuccgugguuugccuccugaauaacuucuauccgagagaggccaaagugcaauggaaggucgacaaugcgcuucagagcggaaacucccaggagucugugacagaacaggauagcaaggacuccaccuacagccugucuuccacacucacccugagcaaagccgauuacgagaagcacaaaguuuaugcuugugaagugacgcaucaaggccugucuagccccgucacaaaguccuuuaauagaggggagugc

SEQ ID NO: 38380 - RNA, 1356 nt, Artificial Sequence
  derived and/or modified sequence opt5 from Conatumumab_CV_HeavyChain
caggugcaacugcaggagagcggccccgggcucgucaagccuucccagacccugucucuuacaugcacgguuagcggaggcuccaucucuagcggggacuacuucugguccuggauuagacagcugccgggaaaaggccucgaauggaucgggcacauucauaacucuggaaccacauauuacaaucccagccugaagucccgggugaccaucagcguggauacaucuaaaaagcaauuuucccuucgccugagcucugucaccgccgcugacacagccguguauuacugugcgagagaucggggcggcgacuauuacuaugggauggauguuuggggacagggcaccacggugaccgucuccagcgcuucuacaaaagggccuuccguguucccccucgccccuagcuccaagucuaccagcggaggcacagccgcucuggggugccugguuaaggacuacuuucccgagccugugaccgucuccuggaacagcggagcccucacgucuggcgugcacacauucccggcugugcugcaguccagcggccuuuacucucugagcuccgucguuaccgugcccucuagcucccucgggacacagaccuauauuuguaaugugaaccauaaaccuagcaauaccaaggucgauaaacgcguggaacccaagucuugcgacaaaacacacacguguccucccugcccggccccugagcugcuuggaggccccuccguuuuucuguucccucccaagcccaaggauacccucaugaucagcagaacaccugaagugaccugugucgugguugacgugucucaugaggauccggaggucaaauuuaacugguacguggacggggucgaagugcacaaugcgaagacaaaaccccgggaggaacaauauaacuccaccuaccgcguugugagcguccugacggugcugcaccaggauuggcucaauggaaaggaguauaaaugcaagguuuccaacaaagcccugccugcucccaucgagaagacaauuucuaaggccaaaggccagccuagagaaccccagguguacacccuuccgccuagccgggaggaaaugaccaagaaucaagucucccugacaugucucgugaaaggguucuaucccucugacaucgcuguggagugggaaagcaacggacagccugagaauaacuacaagaccacacccccuguucuggacuccgauggcagcuuuuuccuuuacucuaaacugacggucgacaagucccgcuggcagcaaggcaauguguuuagcugcucugugaugcaugaggcccuccacaaccauuauacccagaagucccugagccugucucccgggaaa

SEQ ID NO: 38381 - RNA, 645 nt, Artificial Sequence
  derived and/or modified sequence opt5 from Conatumumab_CV_LightChain
gagaucgugcugacccagagccccggcacacucucccugucuccuggggaaagagccacgcuuagcugccgggcuucccaaggaauuucucgcagcuaccuggccugguaucagcagaagccgggccaggcgcccucccuccugaucuacggggcuucuagcagagccaccggcauuccugaccgguucuccggaagcgggucuggaacagauuuuacccuuacaaucucccgccuggagcccgaagacuucgccgucuauuacugucaacaguuuggcagcucuccuuggaccuucggccaggggacaaaaguugagauuaagagaaccguggcugcccccuccguguuuaucuucccuccgagcgaugaacagcucaaaucuggaacggcuuccgucgugugccugcugaacaauuuuuauccccgggaggccaagguucaauggaaaguggacaacgcgcuccagagcggcaauucccaggagucugucaccgaacaggauagcaaggacuccacauacagccugucuuccacccuuacacugagcaaggccgauuaugagaaacacaagguguacgcuugugaaguuacccaucaagggcucucuagcccugugacgaaauccuucaaccgcggagagugc

SEQ ID NO: 38382 - RNA, 1356 nt, Artificial Sequence; identical to SEQ ID NO: 38380
  derived and/or modified sequence opt5 from Conatumumab_HeavyChain1

SEQ ID NO: 38383 - RNA, 1356 nt, Artificial Sequence; identical to SEQ ID NO: 38380
  derived and/or modified sequence opt5 from Conatumumab_HeavyChain

SEQ ID NO: 38384 - RNA, 645 nt, Artificial Sequence; identical to SEQ ID NO: 38381
  derived and/or modified sequence opt5 from Conatumumab_LightChain1

SEQ ID NO: 38385 - RNA, 645 nt, Artificial Sequence; identical to SEQ ID NO: 38381
  derived and/or modified sequence opt5 from Conatumumab_LightChain

SEQ ID NO: 38386 - RNA, 1344 nt, Artificial Sequence
  derived and/or modified sequence opt5 from Concizumab_HeavyChain1
gaggugcagcuggucgaaagcggcgggggacucguuaagcccggcgggucccugagacuuucuugcgccgcuagcggauucaccuuuuccaacuacgccaugucuugggugcggcaaacaccugagaaacgccuggaauggguggcgacgaucagcagauccggcucuuauagcuacuucccggacuccguccaggggcgguuuaccauuagccgcgauaaugcuaagaacucucucuaucugcagaugaauagccuuagagccgaggacacagccguguacuauugugcucggcugggaggcuacgaugaaggcgacgccauggauuccugggggcagggaaccacaguuaccgugucuuccgcuagcacaaaaggccccucugucuucccucucgcccccugcucccgcagcaccuccgagucuacggcggcccuggggugucuggugaaggacuauuuuccugagcccguuaccgugagcuggaacuccggagcucucacaagcggcguccacaccuucccugccgugcugcaaucuuccgggcuuuacagccugucuagcguggucacaguuccguccucuagccucggaaccaaaacguacacaugcaauguggaucauaagcccuccaacaccaagguggacaaaagagucgaaagcaaguauggcccucccuguccucccugcccggcuccugaguuucugggcgggcccucuguguuccuuuuuccucccaaacccaaggauacacugaugaucucccggaccccugaaguuaccuguguggucguggacguuagccaggaggauccggaggugcaguucaauugguacgucgacggaguggaaguccacaacgccaaaacaaagccccgcgaggaacaguuuaauucuacguauagagugguuuccgugcucaccguccugcaucaagauuggcugaacggcaaggaguacaaaugcaaggugagcaauaaagggcucccuuccucuauugaaaagacaaucagcaaagcgaagggacagccccgggagccucagguuuauacccugcccccgucccaggaggaaaugaccaaaaaccaagugucucuuacaugucuggucaagggcuucuacccuagcgacauugccguggagugggaauccaaugggcagcccgagaacaauuauaagacgacaccucccgugcucgacagcgauggaucuuucuuucuguacucccgccuuaccguugacaaaagcagauggcaggaaggcaacgucuucucuugcuccgugaugcacgaggcucugcauaaccacuacacccaaaagagccucucucugagccugggcaaa

SEQ ID NO: 38387 - RNA, 657 nt, Artificial Sequence
  derived and/or modified sequence opt5 from Concizumab_LightChain1
gacaucgugaugacgcagacaccccugagccucuccgucacgccuggccaaccggccucuauuagcugcaaguccucucagagccugcuugaguccgaugggaaaaccuaccugaacugguaucuccagaagcccggacagucuccucaacugcuuaucuaccugguuagcauucucgacuccggcgugcccgaucgguucagcgggucuggauccggcacagacuuuacccugaaaaucagccggguggaagcugaggaugucgggguguauuacugucugcaggccacacacuucccucagaccuuuggaggcggcacaaagguugaaauuaaacgcaccguggcggcucccucugucuucaucuuuccuccguccgacgagcagcucaagagcgggacggccucugugguuugccugcuuaauaacuucuaucccagagaagccaaggugcaauggaaagucgauaaugcucugcaguccggaaacagccaggaguccgugaccgagcaggacucuaaggauagcacauacucccucagcucuacccugacacuuuccaaagccgacuaugaaaagcauaaaguguacgcuugugaggucacccaccaaggccugagcucuccuguuaccaagagcuuuaauagaggggaaugc

SEQ ID NO: 38388 - RNA, 1314 nt, Artificial Sequence
  derived and/or modified sequence opt5 from Crenezumab_HeavyChain1
gaggugcagcuggucgaaagcggcgggggacucguucaacccggcgggucccugagacuuucuugcgccgcuagcggauucaccuuuuccucuuacggcaugagcugggugcggcaggccccugggaagggacuggagcucguggcguccaucaacucuaauggcggcagcacauauuacccggacuccgucaaagggcgcuucacgauuagcagagauaacgcuaaaaauucucuguaucuucagaugaacucccugcgggccgaagacaccgccguguacuauugugcuagcggagauuacuggggccaggggacaaccguuacagugucuuccgccagcaccaagggacccucugucuuuccucucgcucccugcucccgcagcacauccgagucuaccgccgcgcugggcugucuggugaaggacuauuucccugaacccguuacggugagcuggaacuccggggcccucaccagcggaguccacacauuuccugcugugcugcaaucuuccggccuuuacagccugucuagcguggucaccguuccguccucuagccucggcacaaaaaccuacacgugcaauguggaucauaagcccuccaauacaaagguggacaaaagagucgagagcaaguaugggccucccuguccucccugcccggccccugaguuccugggaggccccucuguguuucuuuucccucccaaacccaaggauacccugaugaucucccggacaccugaaguuaccuguguggucguggacguuagccaggaggauccggaagugcaguuuaacugguacgucgacgggguggagguccacaaugcuaaaaccaagccccgcgaggaacaguucaacucuacauauagagugguuuccgugcucacgguccugcaucaagauuggcugaauggaaaggaguacaaaugcaaggugagcaacaaaggccucccuuccucuauugaaaagaccaucagcaaagccaaggggcagccccgggagccucagguuuauacacugcccccgucccaggaagagaugaccaaaaaucaagugucucuuacaugucuggucaagggauuuuacccuagcgacauugcgguggagugggaauccaacggccagcccgagaauaacuauaagaccacgccucccgugcucgauagcgacggcucuuucuuucuguacucccgccuuacaguugacaaaagcagauggcaggaagggaacgucuucucuugcuccgugaugcacgaggcccugcauaaucacuacacccaaaagagccucucucugagccuggga

SEQ ID NO: 38389 - RNA, 657 nt, Artificial Sequence
  derived and/or modified sequence opt5 from Crenezumab_LightChain1
gacaucgugaugacccagagcccccugucccucccugucacaccgggcgagcccgccucuauuagcugcagauccucucaaagccugguuuacuccaacggggauacguaucuucacugguaccugcagaagccuggacagucuccccagcuccugaucuauaaagugagcaaucgguucuccggcgugccugaccgcuuuagcgggucuggauccggcaccgauuucacacuuaagauuagcagagucgaagcugaggacguggggguuuacuauuguucucaauccacccaugugcccuggacauuuggacagggcaccaaagucgaaaucaagcggacaguggccgcgccuagcguuuucauuuuuccgcccucugaugagcagcugaaauccggcaccgcuagcguggucugccuccugaacaauuucuacccucgcgaagccaaggugcaguggaagguggacaacgcccugcaauccggaaauucucaggagagcgucacggagcaggauuccaaagacagcaccuauucucucuccagcacacugacccuuucuaaggcugauuacgaaaaacacaagguuuacgccugugaggugacacaucaggggcugagcucccccgugaccaaaucuuuuaacagaggcgaaugc

SEQ ID NO: 38390 - RNA, 1365 nt, Artificial Sequence
  derived and/or modified sequence opt5 from Crotedumab_HeavyChain1
gaggugcagcuggucgaaagcggcgggggacucguucaacccggcgggucccugagacuuucuugcgccgcuagcggauucaccuuuuccaacuaccugaugaauugggugcggcaggccccuggcaaggggcucgaguggcuggcgaacauccaggaagacggaauugagaaauauuacguggauucugucaagggccgcuucacaaucagcagagacaaugcuaaaaacucccuuuaucugcagaugaacucucuccgggccgaagauacggccguguacuauugugcucgcgagccgagccacuacgacauucugaccggcuaugauuacuacuaugggauggacguuuggggacaaggcacaaccgugacagucuccagcgccucuaccaaggggcccuccguguuuccucuggcucccugcagcagaucuacauccgagagcaccgccgcgcucggaugucugguuaaagauuacuucccugaacccgugacggucucuaauaauuccggcgcccuuaccagcggggugcauacauuuccugcugugcugcaguccucuggacucuauagccuguccagcgucguuaccgugccgucuuccagccuuggcacaaagaccuacacgugcaacguggaccacaagcccucuaauacaaaagucgauaagcggguggagagcaaauauggcccucccuguccucccugcccggccccugaguuccucgggggacccuccguuuuucuguucccucccaagcccaaagacacccugaugaucucucgcacaccugaggugaccugugucgugguugaugugagccaggaggacccggaaguccaguuuaacugguacguggauggcgucgaggugcauaaugcuaagaccaagcccagagaagaacaauucaacuccacauaucggguugugagcguccugacggugcuccaccaggacuggcugaaugggaaagaauacaagugcaaaguuucuaacaagggacuuccuuccagcauugagaaaaccaucucuaaggccaaaggccagccccgcgagccucagguguacacacugcccccgucccaagaagagaugaccaagaaucaggucagccucacaugucuggugaagggguuuuauccuuccgacaucgcgguggaaugggagucuaacggacagcccgaaaacaauuacaaaaccacgccucccguucuugauagcgacggcuccuucuuucuguauucuagacucacagucgauaagagccgguggcaagagggcaacguguucuccugcagcgugaugcaugaggcccugcacaaucacuacacccagaaaucucugucccucagccuggggaag

SEQ ID NO: 38391 - RNA, 1365 nt, Artificial Sequence
  derived and/or modified sequence opt5 from Crotedumab_HeavyChain2
gaggugcagcuggucgaaagcggcgggggacucguucaacccggcgggucccugcaccuuucuugcgccgcuagcggauucaccuuuuccaacuaccugaugaauugggugagacaggccccuggcaaggggcucgaguggcuggcgaacauccaggaagacggaauugagaaauauuacguggauucugucaagggccgguucacaaucagccgcgacaaugcuaaaaacucccuuuaucugcagaugaacucucucagagccgaagauacggccguguacuauugugcucgggagccgagccauuacgacauucugaccggcuaugauuacuacuaugggauggacguuuggggacaaggcacaaccgugacagucuccagcgccucuaccaaggggcccuccguguuuccucuggcucccugcagccgcucuacauccgagagcaccgccgcgcucggaugucugguuaaagauuacuucccugaacccgugacggucucuaauaauuccggcgcccuuaccagcggggugcacacauuuccugcugugcugcaguccucuggacucuauagccuguccagcgucguuaccgugccgucuuccagccuuggcacaaagaccuacacgugcaacguggaccauaagcccucuaauacagaggucgaugaaagaguggagagcaaauauggcccucccuguccucccugcccggccccugaguuccucgggggacccuccguuuuucuguucccucccaagcccaaagacacccugaugaucucucggacaccugaagugaccugugucgugguugaugugagccaggaggacccggaaguccaguuuaacugguacguggauggcgucgaggugcacaaugcuaagaccaaaccccgcgaagaacaauucugguccacauauagaguugugagcguccugacggugcuccaucaggacuggcugaacgggaaggaguacaagugcaaaguuucuaauaagggacuuccuuccagcauugagaaaaccaucucuaaggccaaaggccagccccgggagccucagguguacacacugcccccgucccaagaagagaugaccaagaaccaggucagccucacaugucuggugaaaggguuuuauccuuccgacaucgcgguggaaugggagucuaauggacagcccgagaacaacuacaagaccacgccucccguucuugauagcgacggcuccuucuuucuguauucucgccucacagucgaugaaagcagauggcaagagcacaauguguucuccugcagcgugaugcacgaagcccugcauaaccacuacacccagaagucucugucccucagccugggcaaa

SEQ ID NO: 38392 - RNA, 642 nt, Artificial Sequence
  derived and/or modified sequence opt5 from Crotedumab_LightChain1
gacauccagaugacccaaagccccuccucucugagcgccuccgugggcgauagagucacaauuacgugccgggcuucucaggggauccgcaacgaccucggaugguaccagcagaagccuggcaaagccccgaagagacugauuuaugcggcuagcucccuucaaucugggguucccagccgguucuccggaagcggcucugggaccgaguuuauccugacaguguccagccuccagccugaagauuucgccaccuacuauugucugcaguacaaugagaaccccuuuacauucggaccuggcaccaaaguggacauuaagcgcacagucgccgcucccucuguguuuaucuucccuccguccgaugaacagcuuaaaagcggcaccgccucuguugugugccugcucaauaacuuuuaucccagagaggcuaagguccaauggaagguggacaaugcccugcaguccgggaacagccaggaauccguuacggagcaggauucuaaagacagcaccuacucccugagcucuacacucacccuguccaaggcggauuaugaggaacacaaaguguacgccugugaggucacacaucaaggacuuagcucuccugugaccaagagcuucaaucggggcgaaugc

SEQ ID NO: 38393 - RNA, 642 nt, Artificial Sequence
  derived and/or modified sequence opt5 from Crotedumab_LightChain2
gacauccagaugacccaaagccccuccucucugagcgccuccgugggcgauagagucacaauuacgugccgggcuucucaggggauccgcaacgaccucggaugguaccagcagaagccuggcaaagccccgaagagacugauuuaugcggcuagcucccuucaaucugggguucccagccgguucuccggaagcggcucugggaccgaguuuauccugacaguguccagccuccagccugaagauuucgccaccuacuauugucugcaguacaauucuaaccccuuuacauucggaccuggcaccaaaguggacauuaagcgcacagucgccgcucccuccguguuuaucuucccuccgagcgaugagcagcuuaaaucuggcaccgccuccguugugugccugcucaauaacuuuuaucccagagaagcuaagguccaaaauaagguggacaacgcccugcagagcggaaauucccaggagucuguuacggaacaggauagcaaagacuccaccuacagccugucuuccacacucacccugagcgaggcggauuaugagaagcacaaaguguacgccugugaagucacacaucaagggcuuucuagcccugugaccaaguccuucaaccggggcgagugc

SEQ ID NO: 38394 - RNA, 1332 nt, Artificial Sequence
  derived and/or modified sequence opt5 from Dacetuzumab_HeavyChain1
gaggugcagcuggucgaaagcggcgggggacucguucaacccggcgggucccugagacuuucuugcgccgcuagcggauacuccuucaccggcuauuacauccacugggugcggcaggccccugggaagggacuggaguggguggcgcgcgucauuccgaacgcuggcggcacaucuuauaaucagaaauuuaaggggagauucacgcucagcguggacaacuccaaaaauaccgccuaccugcagaugaacucucuucgggccgaagauacagcuguuuauuacugugcccgcgagggaaucuauugguggggccaagggacccuggugacagucagcuccgcuagcaccaagggacccucuguguuuccucucgcccccuccagcaaaucuacauccggcgggaccgcggcccugggaugccugguuaaggacuacuucccugaacccgugacggucagcuggaauagcggcgcucucaccuccggcgugcauacauuuccugccgugcugcagagcuccgggcuuuacucucugagcuccgucguuaccgugccgucuucuucccucggaacacagaccuauauuuguaacgugaaucacaagcccagcaacacgaaagucgauaagaaaguggagccuaagucuugcgacaaaacacauaccugucccccuugccccgcuccggagcugcuuggcgggccuagcguuuuccuguuucccccuaagcccaaggauacacucaugaucuccagaacccccgaagugaccugugucgugguugacgugucucacgaggauccugaagucaaauucaauugguacguggacggagucgaggugcauaacgccaagacaaaaccgcgggaggaacaguauaauagcacguaccgcguuguguccguccugaccgugcugcaccaagauuggcucaacggcaaggaguauaaaugcaagguuagcaauaaagcgcugcccgccccuauugaaaagacaaucucuaaggcuaaagggcagcccagagagccucagguguacacccuucccccgucccgggaagagaugacaaagaaccaggucagccugaccugucucgugaaaggauuuuauccuucugacaucgccguggagugggaauccaauggccaacccgagaacaacuacaagacgacaccucccguucuggauagcgacggcuccuucuuucuuuacucuaaacugaccgucgauaagagccgcuggcagcaggggaauguguucuccugcucugugaugcacgaagcucuccauaaccacuauacccaaaagagccugucccugagcccuggaaaa

SEQ ID NO: 38395 - RNA, 657 nt, Artificial Sequence
  derived and/or modified sequence opt5 from Dacetuzumab_LightChain1
gacauccagaugacccaaagccccuccucucugagcgccuccgugggcgauagagucacaauuacgugccggucuagccagucccucguucacucuaacgggaauaccuuccugcauugguaccagcagaagccuggaaaagcuccgaaacuucugaucuauacagugagcaaccgcuuuuccggcgugcccagcagauucucuggguccggaagcggcaccgacuuuacacucaccauuucuucccugcaaccugaggauuucgccacauacuuuuguagccagaccacgcacguccccuggaccuucgggcagggaacaaaaguggaaaucaagcggaccguugcggcuccuucuguguuuauuuuucccccuuccgacgagcagcuuaaaagcggcacagccuccgucgugugccugcucaauaacuucuauccgcgcgaagccaagguucaauggaagguggauaaugcucugcagucuggcaacagccaggaguccgucaccgaacaggacagcaaagauucuacguacucccugagcucuacacucacccugagcaaggccgacuaugagaaacauaagguguacgcuugugaggugacacaccaagggcuuuccucucccgucaccaagagcuucaauagaggagaaugc

SEQ ID NO: 38396 - RNA, 318 nt, Artificial Sequence
  derived and/or modified sequence opt5 from Dacliximab_LightChain_VJ-Region
gacauccagaugacccaaagccccuccacacugucugccagcgugggcgauagagucacgauuaccugcuccgcuucuagcuccaucucuuacaugcacugguaucagcagaagccugggaaagccccgaagcuccugauuuacacaaccagcaaccuugcguccggaguucccgcucgguucagcggcucuggguccggaacagaguuuacccugacaaucagcucucuccagccugacgauuucgccaccuauuacugucaucaacgcuccacguauccccugaccuuuggccaggggacaaaaguggaagugaag

SEQ ID NO: 38397 - RNA, 348 nt, Artificial Sequence
  derived and/or modified sequence opt5 from Dacliximab_gamma2-Chain_VDJ-Region
caggugcaacugguccagagcggcgccgagguuaagaaacccggguccucugugaaggugagcugcaaggcuuccggauacaccuucacaucuuauagaaugcacuggguccggcaggccccuggccaggggcucgaauggaucggauacauuaacccgagcacgggcuauaccgaguacaaucaaaaauuuaaagacaaggcgacaaucaccgcugaugaauccacaaacaccgccuauauggagcugucuagccuucgcuccgaagacacagccguguacuauugugcuagagggggaggcguuuucgauuacuggggccaggggacccuggugacggucagcucu

SEQ ID NO: 38398 - RNA, 1326 nt, Artificial Sequence
  derived and/or modified sequence opt5 from Daclizumab_HeavyChain
caggugcaacugguccagagcggcgccgagguuaagaaacccggguccucugugaaggugagcugcaaggcuuccggauacaccuucacaucuuauagaaugcacuggguccggcaggccccuggccaggggcucgaauggaucggauacauuaacccgagcacgggcuauaccgaguacaaucaaaaauuuaaagacaaggcgacaaucaccgcugaugaauccacaaacaccgccuauauggagcugucuagccuucgcuccgaagacacagccguguacuauugugcuagagggggaggcguuuucgauuacuggggccaggggaccacgcugaccgugagcucuggacccuccgucuuuccucucgcccccagcucuaaguccacaagcggcgggaccgcugcccugggaugccuugugaaagacuacuucccugagcccguuacagugucuuggaacuccggcgcgcugaccagcgggguccauacguuuccugccgugcuccaguccucuggacuguauagccuguccagcguggucacaguuccgucuuccagccucggcacccagacauacauuuguaaugugaaucacaagcccucuaacaccaaaguggauaagaaagcugagccuaagagcugcgacaagacccauacaugucccccuugccccgccccggaacugcuuggcgggccuuccgucuuccuguuucccccuaaacccaaggauacgcucaugaucucucggacccccgaggugacauguguuguggucgacgugagccacgaagauccugagguuaaauucaauugguauguggacggagucgaggugcauaacgcuaagaccaaaccgcgcgaggaacaauacaauuccacauauagagucgugagcguucugaccgugcuucaccaggauuggcugaacggcaaggaauacaaaugcaaggucucuaauaaggcccuccccgcgccuauugagaaaacgaucuccaaggccaaagggcagccccgggaaccucagguguauacacugcccccgagccgcgacgagcugaccaagaaccaaguuucucucaccugucuggugaaaggauuuuacccuuccgauaucgcugucgagugggaaagcaauggccagcccgagaacaauuacaagacaaccccucccgugcuugacuccgacgggucuuucuuucuguauagcaagcucacaguggauaaauccagauggcagcaaggaaacguuuucucuugcagcgucaugcacgaagcccugcauaaccacuacacgcagaagucccuuagccugucuccuggcaaa

SEQ ID NO: 38399 - RNA, 630 nt, Artificial Sequence
  derived and/or modified sequence opt5 from Daclizumab_LightChain
gacauccagaugacccaaagccccuccacacugucugccagcgugggcgauagagucacgauuaccugcuccgcuucuagcuccaucucuuacaugcacugguaucagcagaaaccugggaaagccccgaagcuccugauuuacacaaccagcaaccuugcguccggaguucccgcucgguucagcggcucuggguccggaacagaguuuacccugacaaucagcucucuccagccugacgauuucgccaccuauuacugucaucaacgcuccacguauccccugaccuuuggcagcgggacaaaaguggaagugaagagaaccgucgccgcuccuucuguguucauuuuucccccuuccgacgagcagcuuaaaagcggaacagccuccguugugugccugcucaauaacuucuacccgcgggaagcuaagguccaguggaagguggauaaugcccugcagucuggcaacagccaagaguccguuaccgaacaggacagcaaagauucuacguauucccugagcucuacacucacccugagcaaggcggacuacgagaaacacaagguguacgccugugaggucacacaucagggccuuuccucucccgugaccaagagcuuuaaucgc

SEQ ID NO: 38400 - RNA, 1341 nt, Artificial Sequence
  derived and/or modified sequence opt5 from Dalotuzumab_HeavyChain1
caggugcaacugcagcagagcggccccgggcucgucaagccuucccagacccugucucuuacaugcacgguuagcggaugguccaucucuggcggguggcuguggaacuggauuagacaaccgcccggaaaaggccuccaguggaucggguggauuagcugggacggaaccaauaacuggaagccuucccugaaagaucgggugacaaucucuguggacaccagcaagaaucaguucucccuuaaacugagcucugucacagccgcugauaccgccgugugguggugugcgcgcuggggcagaguguuuuucgacugguggggccaggggacacucguuaccgucuccagcgcuucuacgaagggacccuccguguuuccucuggcccccagcucuaaguccaccagcggcgggacagccgcucugggaugccucguuaaagauuacuucccugagccggugaccgucuccuggaacucuggcgcccugacaagcggggugcacaccuuucccgcugugcuucaauccagcggacuguauucucucuccagcgucguuacggugccuucuagcucccugggcacacagaccuacauuuguaaugugaaccauaagcccucuaauacaaaagucgacaagcggguggaaccuaaaagcugcgauaagacccacaccugucccccgugcccugcccccgagcuucugggcgggccuuccguuuuccucuuuccgcccaagccuaaagacacacugaugaucagccgcacgccggaagugaccugugucgugguugaugugucucaugaggaccccgaagucaaguucaacugguauguggauggagucgaggugcacaaugcgaaaacaaagccuagagaggaacaguacaacuccaccuaucggguugugagcguccugacagugcuccaucaggacuggcugaauggcaaagaguacaagugcaaaguuucuaacaaggcccuucccgcuccuaucgaaaagaccauuuccaaagccaaggggcaaccccgcgagccccagguguauacgcugccucccagcagagaggaaaugaccaaaaaucaggucucccucacaugucuggugaagggauuuuacccuucugauaucgcuguggagugggaaagcaacggccaacccgagaauaacuacaaaaccacaccucccguucuugacuccgacgggucuuucuuucuguauagcaagcucaccgucgauaagucccgguggcagcagggaaacguguucagcugcucugugaugcacgaagcccugcacaaucauuacacacagaaaucccugagccucucuccgggcaag

SEQ ID NO: 38401 - RNA, 657 nt, Artificial Sequence
  derived and/or modified sequence opt5 from Dalotuzumab_LightChain1
gacaucgugaugacccagagcccccugucccucccugucacaccgggccaacccgccucuauuagcugcagauccucucagagcaucguucacuccaacgggaauacguggcugcagugguggcuucagaaaccuggacaaucuccccagcugcucauuuggaaagugagcaaccggcuguggggcgugccugaucgcuucuccgggagcggaucuggcaccgacuuuacacuuaagaucuccagaguccaggcucaggauguggggguuuggugguguuuccaaggaagccaugugcccuggaccuuuggccagggcacaaaaguccagauuaagcggaccguggccgcgccuucuguuuucaucuuuccgcccuccgacgagcagcugaaaagcgggacagcuucuguggucugccuccugaauaacuucuacccucgcgaagccaaggugcaauggaagguggauaaugcccugcaguccggaaacagccaggaguccgucaccgaacaagacucuaaagauagcacguauucccucagcucuacccugacacuuuccaaggcugacuacgagaaacacaagguuuaugccugugaagugacccaucagggccugagcucucccgugacaaagagcuuuaauagaggggagugc

SEQ ID NO: 38402 - RNA, 687 nt, Artificial Sequence
  derived and/or modified sequence opt5 from Dapirolizumab_pegol_HeavyChain1
gaggugcagcuggucgaaagcggcgggggacucguucaacccggcgggucccugagacuuucuugcgccgugagcggauucuccucuaccaacuaccacgugcauuggguccggcaggcuccuggcaaggggcuggaguggaugggagugaucuggggcgacggcgauacaagcuauaauuccguucucaaaucucgcuuuacgauuagcagagacaccuccaagaacacaguguaccugcagaugaauagccuucgggccgaagauaccgcggucuauuacugugcucgccagcugacacacuauuacgugcucgccgccugggggcaaggaacccugguuacagugucuuccgcuagcaccaaaggcccgucugucuucccccuggccccuuccagcaagucuacguccgggggaaccgcugcccucggcugccuggugaaagacuauuuucccgagccugugacagucagcuggaacuccggggcgcuuaccucuggaguucauacauuccccgccgugcugcagagcuccggccucuacagccugucuuccguggucaccgugccuagcucuagccuuggcacgcagacauacaucuguaauguuaaccacaagccguccaauaccaagguggauaaaaaggucgaacccaaaucuugcgacaagacacauaccugugcugcc

SEQ ID NO: 38403 - RNA, 642 nt, Artificial Sequence
  derived and/or modified sequence opt5 from Dapirolizumab_pegol_LightChain1
gacauccagaugacgcaaagccccuccucucugagcgccuccgugggcgaucgggucacaauuacgugccgggcuucugaggaccucuacuauaaccuggccugguaccagcgcaagccugggaaagcgccgaaacuucugaucuaugauaccuacagacucgcugacggaguucccagccgguucuccggcucugggagcggaacagauuauacccugacaauuuccagccuucagccugaagacuuugccucuuacuauugucagcaauacuacaaguuccccuuuaccuucggccaggggacaaagguggagaucaaacgcaccguggccgcuccuuccgucuuuauuuuucccccuagcgaugaacagcugaagucuggaacggccuccgugguuugccuccugaauaacuucuauccgagagaggcuaaggugcaguggaaagucgacaaugcccugcaaagcggcaacucucaggaauccgugaccgagcaggauagcaaggacuccacauacucucucagcuccacccugacacuuagcaaagcggauuaugagaagcacaaaguuuacgccugugaagugacccaucagggccugucuucccccgucaccaagagcuucaauagaggggagugc

SEQ ID NO: 38404 - RNA, 1356 nt, Artificial Sequence
  derived and/or modified sequence opt5 from Daratumumab_HeavyChain1
gaggugcagcugcucgaaagcggcgggggacugguccaacccggcgggucccuuagacugucuugcgccguuagcggauucaccuuuaacuccuucgcuaugucuugggugcggcaggccccuggcaaggggcucgagugggugagcgcgaucuccggaucuggcggcgggacauacuaugcugacagcgucaaaggacgcuuuacgauuuccagagauaauagcaagaacacccuguaccuucagaugaacucucugcgggccgaagacacagccguguauuucugugcuaaagauaagauccucugguuuggcgagccgguuuucgacuacugggggcagggaacccuggugacagucuccagcgccucuaccaaaggccccuccguguuuccucuggcucccagcucuaaguccacaagcgggggaaccgccgcgcucggcugccugguuaaggauuauuucccugaacccgugacggucuccuggaacucuggcgcccuuaccagcggggugcacacauuuccugcugugcugcaauccagcggacucuacucucuguccagcgucguuaccgugccgucuagcucccuuggcacacagaccuauauuuguaaugugaaucauaaacccucuaauacgaaggucgacaaacgcguggagccuaagagcugcgauaaaacacacaccugucccccuugccccgccccggagcugcucgggggaccuuccguuuuccuguuucccccuaagcccaaggacacacugaugaucagcagaacccccgaagugaccugugucgugguugaugugucucaugaggacccugaagucaaauucaacugguacguggauggcgucgaggugcacaaugcuaagacaaaaccgcgggaggaacaguacaacuccacguaucgcguugugagcguccucaccgugcugcaucaggacuggcuuaaugggaaggaguacaaaugcaagguuucuaacaaagcccugcccgcgccuauugaaaagacaaucuccaaggccaaaggacaacccagagagccucagguguauacccugcccccgagccgggaagagaugacaaagaaucaggucucccucaccugucuugugaaaggcuuuuacccuucugauaucgcuguggagugggaaagcaacggccagcccgagaauaacuauaagacgacaccucccguucuggacuccgacgggucuuucuuccucuacagcaaacugaccgucgauaagucccgcuggcaacagggaaacguguuuagcugcucugugaugcacgaagcccugcacaaucauuauacccagaagucccucagccugucuccuggcaaa

SEQ ID NO: 38405 - RNA, 642 nt, Artificial Sequence
  derived and/or modified sequence opt5 from Daratumumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccucccaccuuuggccaggggacaaaaguggagaucaagagaaccguggcugccccuucugucuucauuuuuccgcccuccgaugaacagcucaaaagcggaacggcgucugugguuugccugcugaacaauuucuauccucgggaggccaaggugcaauggaaagucgacaacgcucuccaguccggcaauagccaggaguccgugaccgaacaggauucuaaggacagcacauacucccugagcucuacccuuacacuguccaaggccgauuaugagaaacacaagguuuacgcuugugaagugacccaucaaggccucagcucucccgucacgaaauccuuuaaccgcggggagugc

SEQ ID NO: 38406 - RNA, 1350 nt, Artificial Sequence
  derived and/or modified sequence opt5 from Dectrekumab_HeavyChain1
gaggugcagcuggucgaaagcggcgggggaguugugcagcccggcagaucccuccggcugucuugcgccgcuagcggguucaccuuuuccucuuacggaaugcacugggugcgccaggccccuggcaaggggcuugagugggucgcgaucauuugguaugacggaagcaacaaauacuaugcugauuccgugaagggcagauucacaaucucucgggacaauagcaaaaacacgcuguaccuccagaugaauagccugcgcgccgaagauaccgccguuuauuacugugcuagacuuugguuuggcgaccuggaugccuucgacauuugggggcagggaacaauggugaccgucagcucugcuuccacaaagggcccgagcguguuuccccucgccccuucuuccaaaagcaccucugggggaacagcggcccugggcugccugguuaaggauuauuuccccgagccugugaccgucuccuggaacagcggggcucucacguccggagugcauaccuuucccgccgugcugcaaucuagcggccuuuacucccugagcucugucguuacagugccuuccagcucucucggcacccagacauacaucuguaaugugaaccacaagccgagcaauaccaaagucgacaagcggguggaacccaaauccugcgauaagacgcauacauguccucccugcccugcucccgagcugcuugggggaccgucuguuuuccuguuuccucccaaaccuaaggacacccucaugauuagccgcacacccgaggugaccugugucgugguugaugugucccacgaagaccccgaggucaaguucaacugguauguggauggcgucgaagugcauaaugccaaaaccaagccuagagaggagcaguacaacagcacauaucggguugugucuguccugacggugcugcaccaggacuggcucaaugggaaagaauacaagugcaaaguuuccaacaaggcgcugccggcccccaucgagaaaaccaucagcaaggcuaagggacaaccucgcgaaccccagguguauacacuuccucccucuagagaggaaaugaccaaaaaucaggucucccugacaugucucgugaagggcuuuuacccgagcgacauugccguggagugggaguccaacgggcagccugaaaauaacuauaaaaccacgcccccuguucuggauucugacggauccuucuuucuuuacuccaagcugacagucgauaaaucucgguggcaacagggcaacguguucagcugcuccgugaugcacgaggcucuccauaaucacuacacccaaaagagccugucucugucccccggcaag

SEQ ID NO: 38407 - RNA, 648 nt, Artificial Sequence
  derived and/or modified sequence opt5 from Dectrekumab_LightChain1
gagaucgugcugacccagagccccgccacacucucccugucuccuggcgaaagagcuauucuuagcugccgggccgggcaauccgucucuagcuaccugguuugguaucagcagaaaccgggacaggcgccccgccuccugaucuacgacgcuuccaacagagccacgggcauuccugcccgguucucugggagcggauccggcaccgauuuuacacuuaccaucagcucucuggagcccgaagacuucgcuguguauuacugucaacagcgcuccagcuggccucccguguauacauuugggcagggaaccaaacucgagauuaagagaacagucgccgcuccuucuguguucaucuuuccgcccuccgaugaacagcugaaaagcggcaccgccucuguugugugccugcucaauaacuucuacccucgggaggcgaagguccaauggaaaguggacaaugcccugcaguccggcaacagccaggaguccguuacggaacaggauucuaaggacagcaccuauucccuuagcucuacacugacccucuccaaggcugauuacgagaaacacaagguguacgccugugaagucacacaucaagggcugagcucucccgugaccaagagcuuuaaucgcggagagugc

SEQ ID NO: 38408 - RNA, 1332 nt, Artificial Sequence
  derived and/or modified sequence opt5 from Demcizumab_HeavyChain1
caggugcagcugguccagagcggcgccgagguuaagaaacccggggcuuccgugaagaucucuugcaaagccagcggauacuccuucaccgcguauuacauucacugggugaagcaggcuccuggccaggggcucgaauggaucggauauauuucuagcuacaacggcgccacaaauuauaaccaaaaauuuaaggggagagucacguucaccacagacaccuccacaucuaccgccuacauggagcugcggagccuucgcuccgaugacacagcuguguauuacugugccagagauuacgacuaugauguuggaauggacuacuggggccagggcacccuggugacggucagcucugcuuccaccaaggggccgagcguguuuccccucgccccuugcucucgguccacaagcgaaucuaccgcggcccugggaugucuuguuaaagauuauuuccccgagccugugacagucuccuggaauagcggcgcucugaccuccggggugcauacguuucccgccgugcuccagucuagcggacuguacucccugagcucugucguuacagugccuuccagcaacuucggcacccagacauauaccugcaauguggaccacaagccgucuaacaccaaagucgauaagacaguggaacgcaaauguugcguugagugucccccuugccccgcuccucccguggccgggccgagcgucuuucucuucccucccaagccuaaggacacgcugaugaucuccagaacccccgaggugacauguguuguggucgaugugucucaugaagaccccgagguccaauuuaauugguacguggauggaguugaagugcacaacgcgaaaaccaagccucgggaggagcaguucaauagcacauuucgcgucguguccguucuuaccgugguccaucaggacuggcugaacggcaaagaauauaagugcaaagugagcaauaagggccucccggcccccauugagaaaacgaucucuaagacaaaggggcagccuagagaaccccaaguguacacccugccucccucccgggaggaaaugaccaaaaaccagguuagccuuacaugucuggucaagggauucuacccgucugacaucgcuguggagugggaguccaauggccagccugaaaacaauuauaaaaccacacccccuaugcucgauagcgacggguccuuuuuccuguacucuaagcugacgguggauaaaagccgcuggcaacagggaaacgucuucuccugcucugugaugcacgaggcccuccacaaccauuauacccaaaagagccugucccuuagccccggc

SEQ ID NO: 38409 - RNA, 654 nt, Artificial Sequence
  derived and/or modified sequence opt5 from Demcizumab_LightChain1
gacaucgugaugacccagagccccgauucccuggccgucucucucggcgagagagcuacaauuagcugccgggccuccgaaucuguugacaacuacgggaucagcuucaugaagugguuucaacagaaaccuggacagccgcccaagcugcuuauuuaugcggcuuccaaucagggcucuggggugccugaucgcuucagcggauccggcagcgggacggacuuuacccugacaaucucuucccuccaagccgaggauguggccgucuacuauugucagcagagcaaagaagugcccuggaccuucggaggcggcacaaagguugagauuaaaagaaccguggcugccccuucugucuuuaucuuucccccuuccgacgaacagcuuaagagcgggacagcuucugugguuugccugcugaacaauuucuacccgcgggaggccaaggugcaauggaaagucgauaacgcgcuccaguccggaaauagccaggaguccgugaccgaacaggacucuaaggauagcacguauucccugagcucuacccugacacucuccaaagccgacuacgagaagcacaaaguguaugcuugugaagucacccaucaaggccugagcucucccguuacaaagagcuucaaccgcggggagugc

SEQ ID NO: 38410 - RNA, 1350 nt, Artificial Sequence
  derived and/or modified sequence opt5 from Denintuzumab_mafodotin_HeavyChain1
caggugcagcugcaggagagcggccccgggcucgucaagccuucccagacccugucucuuacaugcacgguuagcggaggcuccaucucuaccagcgggaugggagugggcuggauuagacagcacccggggaaaggacuggaauggaucggccauauuuggugggacgaugacaagcgguacaaccccgcccucaaaucccgcgugacaaucucugucgauaccagcaagaaucaauucucccugaaacuuagcucugugacagcugccgacaccgcgguuuauuacugugcuagaauggagcugugguccuauuacuuugauuauuggggccaggggacacucgugaccgucagcucugccuccacgaagggaccuagcguguucccccuggccccuucuuccaagagcaccuccggcgggacagcugcccugggaugccucguuaaagacuacuuucccgaaccugugaccgucucuuggaacagcggcgcucugacauccggggugcacaccuucccggccgugcuucagagcucuggacuguauucccucagcucugucguuacggugcccagcuccucucugggcacacagaccuacauuuguaaugugaaccauaagccuagcaauacaaaagucgauaagaaaguggagcccaaguccugcgacaagacccacaccuguccucccugcccggcgccugaacuucugggcgggcccagcguuuuucucuucccucccaaacccaaggauacacugaugaucucucggacgccugaggugaccugugucgugguugacgugucccaugaggauccggaagucaaauuuaacugguacguggacggagucgaggugcacaaugccaagacaaaaccccgcgaagaacaauauaacagcaccuacagaguugugucuguccugacagugcuccaccaggauuggcugaauggcaaggaguauaaaugcaagguuuccaacaaggcccuuccugcucccaucgagaaaaccauuagcaaggcuaaagggcagccucgggagccccagguguacacgcugccgccuucccgcgacgaacucacaaagaaucaagucucucugaccugucuugugaaaggauucuaucccagcgacaucgccguggagugggaauccaacggccagccugagaauaacuacaagaccacacccccuguucuggauucugacgggagcuuuuuccucuauuccaagcugaccgucgauaaaagcagauggcagcaaggaaauguguuuucuugcuccgugaugcaugaggcgcugcacaaccauuacacacaaaagagccucucucugucccccggcaaa

SEQ ID NO: 38411 - RNA, 639 nt, Artificial Sequence
  derived and/or modified sequence opt5 from Denintuzumab_mafodotin_LightChain1
gagaucgugcugacccagagccccgccacacucucccugucuccuggcgaaagagcuacgcuuagcugcuccgccucuagcuccgucucuuacaugcacugguaucaacagaagccggggcaggcgccccggcugcucauuuacgacaccagcaaacuggcuuccggaaucccugcccgcuucagcggcucuggguccggaacagauuuuacccuuacaauuagcucucuggagcccgaagacguugccguguauuacuguuuccagggcuccguguauccuuuuaccuucgggcaaggaacaaagcucgagaucaaaagaaccgucgcugcccccagcguguuuauuuucccuccgucugaugaacagcugaaguccggcacggcuagcguugugugccugcucaacaauuuuuacccccgggaggccaaaguccaguggaagguggacaacgcgcugcaguccggcaauucucaagagagcguuaccgaacaggauuccaaggacagcacauauucucuuuccagcacccugacacucucuaaagccgauuacgagaagcauaaaguguacgcuugugaagucacccaccaggggcugagcuccccugugacgaagucuuucaaccgcggagagugc

SEQ ID NO: 38412 - RNA, 1356 nt, Artificial Sequence
  derived and/or modified sequence opt5 from Denosumab_HeavyChain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccggaaucacaggcucuggcgggagcacguauuacgcugacuccgugaaaggacgcuucaccauuagcagagauaacucuaagaauacacuguaucuucagaugaacucccugcgggccgaagacaccgccgucuacuauugugcuaaagauccgggcacaaccgugaucaugagcugguuugaccccugggggcagggaacacucguuaccgugucuuccgccagcacgaagggcccuucugucuucccccuggcuccuuccagcaaauccaccucugggggaacagccgcgcugggcugccucgugaaggauuacuuucccgagccuguuaccgugagcuggaacuccggcgcccugacaagcgggguccacaccuucccggcugugcuucaaucuuccggacuguauagccucucuagcguggucacgguucccuccucuagccugggcacacagaccuacauuuguaaugugaaucauaagccuuccaacacaaaaguggacaagaaagucgaacccaagagcugcgauaaaacccacaccuguccucccugcccggccccugagcuucucgggggacccucuguguuucuguucccucccaagcccaaggacacacugaugaucucccgcacgccugagguuaccuguguggucguggauguuagccaugaagacccggaggugaaauuuaauugguacgucgauggcguggaaguccacaacgcuaagacaaaacccagagaggagcaguauaauucuaccuaccgggugguuuccgugcugacaguccuccaucaggacuggcugaacgggaaggaauauaaaugcaaggugagcaauaaagcccuuccugcgcccauugagaagaccaucuccaaggccaaaggacaaccucgcgaaccccagguuuacacgcugccgccuucuagagaugagcucacaaagaaccaggugagccugaccugucuugucaaaggcuucuaucccuccgacaucgcuguggaaugggagucuaauggccagccugagaacaauuacaagaccacacccccugugcuggacagcgauggguccuuuuuccucuauagcaaacugaccguugacaagucucgguggcaacagggaaacgucuuuuccugcagcgugaugcacgaagcccugcacaaccauuacacacagaagucucucucccugagccccggcaaa

SEQ ID NO: 38413 - RNA, 645 nt, Artificial Sequence
  derived and/or modified sequence opt5 from Denosumab_LightChain
gagaucgugcugacccagagccccggcacacucucccugucuccuggggaaagagccacgcuuagcugccgggcuucccaaucuguccgcggaagauaccuggccugguaucagcagaagccgggccaggcgccccggcuccugauuuacggggcuagcucccgcgccaccggaaucccugacagauucucuggcagcggguccggaacagauuuuacccuuacaauuagccggcuggagcccgaagacuucgccguguuuuauugucaacaguacgggucuuccccucgcaccuucggccagggcacaaaaguugagaucaagagaaccguggcugcccccagcgucuuuauuuucccuccgucugaugaacagcucaaauccggaacggcuagcgugguuugccugcugaacaauuuuuauccccgggaggccaaggugcaauggaaagucgacaacgcgcuccagucuggcaauucccaggagagcgugaccgaacaggauuccaaggacucuacauacagccuguccagcacccuuacacugucuaaggccgauuaugagaaacacaagguuuacgcuugugaagugacccaucaagggcucuccagcccugucacgaaaucuuucaaccgcggagagugc

SEQ ID NO: 38414 - RNA, 1338 nt, Artificial Sequence
  derived and/or modified sequence opt5 from Depatuxizumab_HeavyChain1
caggugcaacugcaggagagcggccccgggcucgucaagccuucccagacccugucucuuacaugcacgguuagcggauacuccaucucuagcgacuucgccuggaacuggauuagacagccgcccggcaaagggcuggaauggaugggauauaucuccuacucuggcaauacccgguaucaaccuagccucaagucccgcauuacaaucagcagagauaccucuaaaaaccaguuuuuccugaaacuuaauuccgugacagcugccgacaccgcgacauacuauugugugaccgcugggcggggauuucccuacuggggccagggcacgcuggucaccgugagcucugccuccacaaaggggccuagcguuuucccccucgccccuucuuccaagagcaccuccggaggcacagcugcccuggggugccuggugaaggauuauuuuccggagcccgucaccgugucuuggaacagcggagcucucacguccggcguucacacauucccugccgugcugcagagcucugggcuuuacucccugagcucugucgugaccgugcccagcuccucucucggaacacaaaccuacauuuguaaugucaaccauaaaccuagcaauaccaagguugacaaaaagguggaacccaaauccugcgauaagacacacacguguccgccuugccccgcgccugagcugcuuggcggccccagcguguuucuguuucccccuaagccgaaagacacccucaugaucucucgcacacccgaagucaccugugugguuguggaugucucccaugaggacccugaggugaaguucaacugguauguugaugggguggaaguccacaaugccaaaacaaagcccagagaggaacaguacaacagcaccuaucggguggucucugugcugacgguucugcaucaggacuggcucaauggaaaagaguacaagugcaaaguguccaacaaggcucugccugcccccaucgagaagacaauuagcaaagcuaagggccagccgcgcgaaccucaagucuauacccuucccccuuccagagaugagcugaccaaaaaucaggugucucucacaugucugguuaagggguucuaccccagcgacaucgccguggaaugggaguccaacggacagccugaaaauaacuauaaaaccacacccccgguccuugauucugacggcagcuuuuuccuguacuccaagcucacgguggacaagagccgguggcaacaggggaacguguuuucuugcuccguuaugcacgaggcgcugcacaaucauuacacccagaaaagccugucucucuccccuggaaag

SEQ ID NO: 38415 - RNA, 642 nt, Artificial Sequence
  derived and/or modified sequence opt5 from Depatuxizumab_LightChain1
gacauccagaugacccaaagccccuccucuaugagcguguccgucggcgauagaguuacaauuacgugccacucuagccaggacaucaacuccaauauuggguggcugcagcagaaaccuggaaaaucuuucaagggccucaucuaccaugggaccaaccuggaugacggagugccgagccgguuuuccggcagcgggucuggaacagauuauacccuuacaauuuccagccugcaacccgaggacuucgccaccuacuauugugugcaguacgcucaguuuccuuggacauucggcggcgggaccaaacucgaaaucaagcgcacggucgccgcgcccucuguguuuaucuucccucccuccgaugagcagcugaaaagcggaaccgcuucuguugugugccuucugaauaacuuuuauccuagagaagccaagguccaauggaagguggacaaugcccuccaguccggcaacagccaggaguccguuacagaacaggauucuaaagacagcaccuacucccugagcucuacacugacccucuccaaggcugauuaugagaaacacaagguguacgccugugaggucacgcaucaagggcugagcucuccggugacaaagagcuucaaucggggagaaugc

SEQ ID NO: 38416 - RNA, 1338 nt, Artificial Sequence; identical to SEQ ID NO: 38414
  derived and/or modified sequence opt5 from Depatuxizumab_mafodotin_HeavyChain1

SEQ ID NO: 38417 - RNA, 642 nt, Artificial Sequence; identical to SEQ ID NO: 38415
  derived and/or modified sequence opt5 from Depatuxizumab_mafodotin_LightChain1

SEQ ID NO: 38418 - RNA, 1329 nt, Artificial Sequence
  derived and/or modified sequence opt5 from Dinutuximab_beta_HeavyChain1
gaggugcagcugcuccaaagcggccccgaacuggagaagccuggggccuccgucaugaucucuugcaaagcuagcggauccucuuucaccggcuacaacaugaauuggguuagacagaacauuggaaagagccuugaauggaucggggccauugacccguauuacggcgggacauccuauaaucagaaauuuaagggacgggcgacgcugaccguggauaaaucuagcuccacagcuuacaugcaccucaagagccugaccucugaggacuccgccguguauuacugugucagcggcauggaauauuggggccaggggacaucugugaccguuuccagcgccucuacaaagggacccuccguguucccucuugcucccagcuccaaaucuaccagcggcgggacggccgcucugggaugccucgucaaggauuacuuuccugagcccgugaccguuuccuggaacagcggcgcccugacaucuggggugcauaccuucccugcgguccugcaauccagcggacucuacucucugagcuccguggugacagucccgucuagcucccuuggcacccagacguauaucuguaauguuaaccacaaacccagcaauacaaagguggacaaacgcguggagccuaagucuugcgauaagacccauacaugucccccuugccccgccccggaacugcucggcgggccuuccgucuuucuguuucccccuaaacccaaggacacccuuaugauuagcagaacccccgaggugacauguguuguggucgaugugucucacgaagacccugagguuaaauucaacugguacguggauggagucgaggugcauaaugcuaagacgaaaccgcgggaggaacaguauaacuccaccuaccgcgucgugagcguucugacagugcuccaccaggacuggcugaauggcaaggaauauaaaugcaaggucuccaacaaggcccugcccgcuccuaucgagaaaaccaucucuaaggccaaagggcaacccagagaaccucagguguacacacugcccccgagccgggaggagaugaccaagaaucagguuucccucacgugucuugugaaaggauucuauccuucugauauugcggucgaaugggagagcaacggccagcccgaaaauaacuacaagacaaccccucccgugcuggacuccgaugggagcuuuuuccucuacucuaagcugaccguggacaaaucccgcuggcaacagggaaacguuuuuagcugcucugucaugcacgaggcccuucauaaucacuauacacagaagucccugagccucucuccuggcaaa

SEQ ID NO: 38419 - RNA, 660 nt, Artificial Sequence
  derived and/or modified sequence opt5 from Dinutuximab_beta_LightChain1
gagaucgugaugacccagagccccgccacacuguccgucucuccuggcgaaagagcuacgcucagcugccgguccucucaaagccugguucaccgcaacgggaauaccuaccuucauugguaucugcagaagccgggacagucccccaaacuccugauucacaaggugucuaacagauucagcggcgugccugaccgguuuuccgggagcggaucuggcacagauuucacccuuaaaaucucccgcgucgaggccgaagaccuggggguguacuuuuguagccagucuacacauguucccccucucaccuucggagcgggcacaaagcuggagcugaaaagaaccguggcugcccccuccgucuuuauuuucccuccgagcgaugaacaacucaagucuggcacggccuccgugguuugccugcuuaauaacuuuuauccccgggaggcuaaggugcaguggaaagucgacaaugcccugcagagcgggaacucccaggagucugugaccgaacaagauagcaaggacuccacauacagccucucuuccacccugacacuuagcaaagcugauuaugagaagcacaaaguguacgccugugaagucacccaucagggacugucuagcccuguuacgaaguccuucaaucgcggcgagugc

SEQ ID NO: 38420 - RNA, 1329 nt, Artificial Sequence; identical to SEQ ID NO: 38418
  derived and/or modified sequence opt5 from Dinutuximab_HeavyChain1

SEQ ID NO: 38421 - RNA, 660 nt, Artificial Sequence; identical to SEQ ID NO: 38419
  derived and/or modified sequence opt5 from Dinutuximab_LightChain1

SEQ ID NO: 38422 - RNA, 660 nt, Artificial Sequence; identical to SEQ ID NO: 38419
  derived and/or modified sequence opt5 from Dinutuximab_LightChain

SEQ ID NO: 38423 - RNA, 1350 nt, Artificial Sequence
  derived and/or modified sequence opt5 from Diridavumab_HeavyChain1
gaggugcagcuggucgaaagcggcgcugagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgcuucuacgaaagggccuuccguguucccccuugccccuagcucuaaguccaccagcggaggcacagcggcccuggggugccucgucaaagacuacuuuccggagcccgugaccgugucuuggaacuccggagcucugacaagcggcguccauaccuucccugccguucuucaauccucuggccuguauagccucuccagcguggugacgguccccucuuccagccuggggacacagaccuacauuuguaaugugaaccacaagccuucuaauacaaaaguugauaagcgcguggaacccaagagcugcgacaaaacccauaccuguccgccuugccccgcuccugagcugcucggaggccccuccgucuuucuguuucccccuaagccgaaagauacacuuaugaucucuagaacgcccgaagugaccuguguuguggucgacgugagccacgaggauccugaggucaaguuuaacugguacguggacgggguugaagugcauaaugccaaaacaaagccccgggaggaacaguauaacuccaccuaccgcgucgugagcguucugacagugcuccaccaggauuggcugaauggaaaagaguauaagugcaaggucucuaacaaagcgcuuccugcccccaucgaaaagaccauuuccaaagcuaagggccaaccgagagagccucagguguacacgcugcccccuagccgggaggaaaugaccaaaaaucaggugucucucacaugucugguuaagggguucuaucccuccgacaucgccgucgagugggaaagcaacggacagccugagaauaacuacaagaccacacccccggugcuggauuccgacggcucuuucuuccucuauagcaaacugaccguggacaagucccgcuggcaacagggcaaugucuuuucuugcagcgugaugcacgaagcccuucauaaccacuacacacagaaaucccugagccucucuccuggg

SEQ ID NO: 38424 - RNA, 651 nt, Artificial Sequence
  derived and/or modified sequence opt5 from Diridavumab_LightChain1
cagagcgugcugacccaacccccuuccgucucugccgcuccgggccagaagguuacaaucagcugcuccgggucuagcuccaacauuggaaaugacuacgugucuugguaucagcagcuccccggcacggccccuaaacugcuuaucuacgauaacaauaagagacccagcgggauuccugaccgguucuccggaagcaaaucuggcaccuccgcgacacuggggaucaccggacuccaaacaggcgaugaggcuaacuauuacugugccaccugggaccgcagacccacagccuauguggucuuuggcgggggaaccaagcugacggugcuuggccagccuaaagcugccccgagcguuacccuguuucccccuucuuccgaggaacuccaggcuaauaaggccacacuggugugccugauuagcgauuucuaccccggggcggucaccguggccuggaaggcugacucuuccccuguuaaagccggaguggaaacaaccacgcccagcaagcaguccaacaauaaauaugcugccucuagcuaccucucccugacaccggagcaauggaaaagccaccggucuuacuccugucaggucacccaugaaggcagcacaguggagaagaccguggcgccuaccgagugcucu

SEQ ID NO: 38425 - RNA, 1338 nt, Artificial Sequence
  derived and/or modified sequence opt5 from Domagrozumab_HeavyChain1
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccacaaucucuagcggaggcuccuauacgagcuacccggacucugugaaaggccgcuucaccauuuccagagauaacagcaagaauacacuguaucuucagaugaacucucugcgggcugaagacaccgccgucuacuauugugccaaacaggauuacgcuaugaauuauugggggcaaggaacacucgugaccguuuccagcgccucuacaaagggccccuccguguuuccucuggcucccagcuccaaaucuaccagcgggggaacggccgcgcugggcugccucgucaaggacuacuucccugagcccgugaccguuuccuggaacagcggggcccugacaucuggagugcacaccuuuccugcuguccuucaguccagcggccuguacucucucagcuccguggugacagucccgucuagcucccugggcacccagacguauaucuguaauguuaaccauaagcccagcaauacaaaaguggauaagaaaguggaaccuaagucuugcgacaaaacccacacaugucccccuugccccgccccggaggcugccggggcgccuuccgucuuccuuuuucccccuaagcccaaggauacccugaugauuagccgcacccccgaggugacauguguuguggucgacgugucucaugaagauccugagguuaaauucaacugguacguggacggagucgaagugcacaaugccaagacgaaaccgagagaggagcaguauaacuccaccuaccgggucgugagcguucucacagugcugcaucaagauuggcugaauggcaaggaauauaaaugcaaggucuccaacaaagcucuccccgccccuaucgagaagaccauuucuaaggcuaaagggcagccccgcgaaccucagguguacacacugcccccgagcagagaggaaaugaccaagaaucagguuucccuuacgugucuggugaaaggauuuuauccuucugacaucgccgucgagugggagagcaacggccaacccgaaaauaacuacaagacaaccccucccgugcucgauuccgacgggagcuucuuucuguacucuaaacuuaccguggacaagucccgguggcagcagggaaacguuuucagcugcucugucaugcacgaggcccugcacaaucauuauacacaaaagucccucagccugucuccuggcaaa

SEQ ID NO: 38426 - RNA, 1335 nt, Artificial Sequence
  derived and/or modified sequence opt5 from Domagrozumab_HeavyChain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccacaaucucuagcggaggcuccuauacgagcuacccggacucugugaaaggccgcuucaccauuuccagagauaacagcaagaauacacuguaucuucagaugaacucucugcgggcugaagacaccgccgucuacuauugugccaaacaggauuacgcuaugaauuauugggggcaaggaacacucgugaccguuuccagcgccucuacaaagggccccuccguguuuccucuggcucccagcuccaaaucuaccagcgggggaacggccgcgcugggcugccucgucaaggacuacuucccugagcccgugaccguuuccuggaacagcggggcccugacaucuggagugcacaccuuuccugcuguccuucaguccagcggccuguacucucucagcuccguggugacagucccgucuagcucccugggcacccagacguauaucuguaauguuaaccauaagcccagcaauacaaaaguggauaagaaaguggaaccuaagucuugcgacaaaacccacacaugucccccuugccccgccccggaggcugccggggcgccuuccgucuuccuuuuucccccuaagcccaaggauacccugaugauuagccgcacccccgaggugacauguguuguggucgacgugucucaugaagauccugagguuaaauucaacugguacguggacggagucgaagugcacaaugccaagacgaaaccgagagaggagcaguauaacuccaccuaccgggucgugagcguucucacagugcugcaucaagauuggcugaauggcaaggaauauaaaugcaaggucuccaacaaagcucuccccgccccuaucgagaagaccauuucuaaggcuaaagggcagccccgcgaaccucagguguacacacugcccccgagcagagaggaaaugaccaagaaucagguuucccuuacgugucuggugaaaggauuuuauccuucugacaucgccgucgagugggagagcaacggccaacccgaaaauaacuacaagacaaccccucccgugcucgauuccgacgggagcuucuuucuguacucuaaacuuaccguggacaagucccgguggcagcagggaaacguuuucagcugcucugucaugcacgaggcccugcacaaucauuauacacaaaagucccucagccugucuccuggc

SEQ ID NO: 38427 - RNA, 642 nt, Artificial Sequence
  derived and/or modified sequence opt5 from Domagrozumab_LightChain1
gacauccagaugacccaaagccccuccucucugagcgccuccgugggcgauagagucacaauuacgugcaaggcuucucaggacguuagcaccgccguggcgugguaccagcagaaaccugggaaggcuccgaaacuccugaucuauuccgccucuuaccgguauacaggagugcccagccgcuucuccggcagcgggucuggaaccgauuuuacacuuaccauuuccagccugcaaccugaggacuucgccacauacuauugucagcagcacuacucuacccccuggacguuuggcgggggaaccaaggucgaaaucaaaagaacaguggcugccccuuccguuuucauuuuucccccuagcgaugagcagcucaagucuggcaccgcuuccguggucugccugcuuaacaauuucuauccgcgggaagccaaggugcaauggaaaguugacaacgcgcugcagagcggcaauucccaggagucugugacagaacaggauagcaaggacuccaccuacagccucucuuccacgcugacacugagcaaagccgauuacgagaagcauaaagucuaugcuugugaggugacccaccaagggcucucuagccccgugacaaaguccuuuaaccgcggagaaugc

SEQ ID NO: 38428 - RNA, 1335 nt, Artificial Sequence
  derived and/or modified sequence opt5 from Drozituab_HeavyChain1
gaggugcagcugguccaaagcggcgggggaguugaaagacccggcgggucccuccggcugucuugcgccgcuagcggauucaccuuugacgauuacgccuccugggugcgccaggcgccuggcaaggggcuugagugggugucuggaaucaacuggcagggcggcagcacaggguaugcugacuccgucaaaggaagagugacgauuucucgggauaaugccaagaacagccuguaccuccaaaauucccugcgcgccgaagacaccgcuguuuauuacugugccaaaauccuuggcgcugggagaggaugguauuucgauuacuggggcaaggggacaaccgugacagucagcucugccuccaccaaaggaccgagcguguuuccccuggcgccuucuuccaagagcacaucuggcggcaccgccgcucucgggugccugguuaaggacuauuuccccgagccugugacggucuccuggaacagcggagcccugaccuccggcgugcacacauuucccgcugugcuccagucuagcgggcuguacucccuuagcucugucguuaccgugccuuccagcucucugggaacacagaccuacauuuguaaugugaaccauaaaccgagcaauacgaaggucgauaaaaagguggaacccaaauccugcgacaagacacacaccuguccucccugcccugcccccgagcuccugggcgggccgucuguuuuccuuuuuccucccaagccuaaagauacacugaucagccggacccccgaggugaccugugucgugguugacgugucccaugaagaucccgaggucaaguucaacugguauguggacggagucgaagugcacaaugcgaaaacaaagccucgcgaggagcaguacaacagcacguauagaguugugucuguccucaccgugcugcaucaggauuggcugaauggcaaagaauacaagugcaaaguuuccaacaaggcccucccggcucccauugagaagacaaucagcaaagccaagggccaaccucgggaaccccagguguauacccugccucccucucgcgaggaaacaaagaaucaggucucccuuaccugucuggugaagggguuuuacccgagcgacaucgcuguggagugggaguccaacggacagccugaaaauaacuauaaaacgacacccccuguucucgacucugauggcagcuucuuucuguacuccaaacuuaccgucgacaagucuagauggcaacaggggaacguguucagcugcuccgugcacgaggcccugcacaaucauuacacccagaaaagccucucucugucccccgga

SEQ ID NO: 38429 - RNA, 639 nt, Artificial Sequence
  derived and/or modified sequence opt5 from Drozituab_LightChain1
agcgagcugacccaggaccccgccguguccgucgcucucggccaaacaguuagaaucacgugcucuggggauagccugcgguccuacuaugccucuugguaccagcagaagccuggacaggcgccggugcuugugauuuauggcgcuaacaaucgccccagcgggaucccugacagauucuccggaucuagcuccggcaacaccgccagccugacaauuaccggggcccaagcugaagaugaggccgacuacuauuguaauucugcugauuccagcggaaaccacgucguguuuggcggcgggacaaaacucaccguucugggacagcccaaggccgcgccuucugugacacuuuuucccccuuccagcgaagaacugcaggccaauaaagcuacccucgucugccugaucucugacuucuacccgggcgccgugacgguugcuuggaaggccgauuccagccccgugaaagcgggggucgaaaccacaaccccuuccaagcagucuaacaauaaguaugccgcuagcuccuaccugagccucacacccgagcaauggaaaucucauaaguccuacagcugucaggugacccacgagggaucuacgguggagaaaacagucgccccuaccgagugcagc

SEQ ID NO: 38430 - RNA, 1353 nt, Artificial Sequence
  derived and/or modified sequence opt5 from Drozitumab_HeavyChain1
gaggugcagcugguccaaagcggcgggggaguugaaagacccggcgggucccuccggcugucuugcgccgcuagcggauucaccuuugacgauuacgccauguccugggugcgccaggcgccuggcaaggggcuugagugggugucuggaaucaacuggcagggcggcagcacaggguaugcugacuccgucaaaggaagagugacgauuucucgggauaaugccaagaacagccuguaccuccagaugaacucccugcgcgccgaagacaccgcuguuuauuacugugccaaaauccuuggcgcugggagaggaugguauuucgauuacuggggcaaggggacaaccgugacagucagcucugccuccaccaaaggaccgagcguguuuccccuggcgccuucuuccaagagcacaucuggcggcaccgccgcucucgggugccugguuaaggacuauuuccccgagccugugacggucuccuggaauagcggagcccugaccuccggcgugcacacauuucccgcugugcuccaaucuagcgggcuguacucccuuagcucugucguuaccgugccuuccagcucucugggaacacagaccuacauuuguaaugugaaccauaaaccgagcaauacgaaggucgauaaaaagguggaacccaaauccugcgacaagacacacaccuguccucccugcccugcccccgagcuccugggcgggccgucuguuuuccuuuuuccucccaagccuaaagauacacugaugaucagccggacccccgaggugaccugugucgugguugacgugucccaugaagaucccgaggucaaguucaacugguauguggacggagucgaagugcacaaugcgaaaacaaagccucgcgaggagcaguacaacagcacguauagaguugugucuguccucaccgugcugcaucaggauuggcugaauggcaaagaauacaagugcaaaguuuccaacaaggcccucccggcucccauugagaagacaaucagcaaagccaagggccaaccucgggaaccccagguguauacccugccucccucucgcgaggaaaugacaaagaaucaggucucccuuaccugucuggugaagggguuuuacccgagcgacaucgcuguggagugggaguccaacggacagccugaaaauaacuauaaaacgacacccccuguucucgacucugauggcagcuucuuucuguacuccaaacuuaccgucgacaagucuagauggcaacaggggaacguguucagcugcuccgugaugcacgaggcccugcacaaucauuacacccagaaaagccucucucugucccccggaaag

SEQ ID NO: 38431 - RNA, 639 nt, Artificial Sequence; identical to SEQ ID NO: 38429
  derived and/or modified sequence opt5 from Drozitumab_LightChain1

SEQ ID NO: 38432 - RNA, 1353 nt, Artificial Sequence
  derived and/or modified sequence opt5 from Duligotumab_HeavyChain1
gaggugcagcuggucgaaagcggcgggggacucguucaacccggcgggucccugagacuuucuugcgccgcuagcggauucacccuguccggcgacuggauccacugggugcggcaggccccugggaagggacucgagugggugggcgaaauuucugcggcuggcggguacacagauuaugccgacagcgucaaaggacgcuuuacgaucuccgccgauaccucuaagaacacagcuuaccugcagaugaauagccuuagagccgaggacaccgcuguguauuacugugcccgggaaucccgcguuagcuucgaggcggccauggauuauuggggccaggggacacuggugaccgucucuuccgcuagcacaaaaggaccgucuguguuuccccucgccccuuccagcaagucuaccuccggcgggacggcugcccugggaugccugguuaaagacuacuuccccgagccugugaccgucagcuggaacuccggcgcgcucacaucuggcgugcauaccuuucccgccgugcugcaaagcuccgggcuuuauagccugucuuccgucguuacagugccuagcucuagccucggaacccagacguacauuuguaaugugaaccacaagccguccaauacaaaggucgauaaaaagguggaacccaaaucuugcgacaagacccauacauguccucccugcccugcucccgagcugcuuggcgggccgagcguuuuccuguuuccucccaaaccuaaggauacccucaugaucuccagaacccccgaagugacaugugucgugguugacgugagccacgaggaucccgaggucaaguucaacugguacguggacggagucgaagugcauaaugccaaaacgaagccucgggaggaacaguauaacucuaccuaccgcguuguguccguccugacagugcugcaccaggauuggcucaauggcaaagaguauaagugcaaaguuagcaacaaggcucugccggcccccauugagaaaaccaucucuaaggccaaggggcaaccuagagaaccccagguguacacacuuccucccucccgggaggaaaugaccaaaaaucaggucagccugacgugucucgugaagggauuuuauccguccgacaucgcuguggagugggaaucuaacggccagccugagaauaacuacaaaacaacacccccuguucuggacagcgauggcuccuucuuucuuuauucuaagcugaccgucgacaaaagccgcuggcaacaggggaauguguucuccugcagcgugaugcacgaagcgcuccauaaccacuacacccagaagucucugucccugagccccggaaag

SEQ ID NO: 38433 - RNA, 642 nt, Artificial Sequence
  derived and/or modified sequence opt5 from Duligotumab_LightChain1
gacauccagaugacccaaagccccuccucucugagcgccuccgugggcgauagagucacaauuacgugccgggcuucucagaacaucgccaccgacguugcgugguaccagcagaagccugggaaagcuccgaagcuccugauuuauagcgccuccuuccuuuacucuggagugcccagccgcuuuuccggcagcgggucuggaacagauuucacccugacaaucuccagccuccaaccugaggacuuugccaccuauuacugucagcagucugaacccgagccuuauacauucggccaggggaccaaaguggaaauuaagagaacggucgcugcccccuccguguuuaucuucccuccgagcgaugagcaacugaaaucuggaaccgcuuccguugugugccuucugaauaacuuuuacccccgggaagccaagguccaguggaagguggacaaugcgcuccagagcggcaacucccaggagucuguuacagagcaagauagcaaagacuccaccuauagccugucuuccacacugacccucagcaaggccgauuacgaaaaacacaagguguacgcuugugaggucacgcaucagggccugucuagcccugugacaaaauccuucaaucgcggggaaugc

SEQ ID NO: 38434 - RNA, 1353 nt, Artificial Sequence; identical to SEQ ID NO: 38432
  derived and/or modified sequence opt5 from Duligotuzumab_HeavyChain1

SEQ ID NO: 38435 - RNA, 642 nt, Artificial Sequence; identical to SEQ ID NO: 38433
  derived and/or modified sequence opt5 from Duligotuzumab_LightChain1

SEQ ID NO: 38436 - RNA, 1353 nt, Artificial Sequence
  derived and/or modified sequence opt5 from Dupilumab_HeavyChain1
gaggugcagcuggucgaaagcggcgggggacucgagcaacccggcgggucccugagacuuucuugcgccggaagcggcuucaccuuucgggacuacgcuaugacauggguucgccaggccccugggaagggacuggaauggguguccucuaucagcggcuccggcgggaacacguauuacgcggauucugugaaaggaagauucaccauuagccgggacaauuccaagaacacacucuaucugcagaugaauagccuucgcgcugaggauaccgccgucuacuauugugccaaagacagacugucuaucacaauucggccgcgcuacuauggccucgaugugugggggcagggaaccacaguuaccguguccagcgcuucuacgaagggccccuccgucuuuccucuggcccccugcagcagaucuaccuccgaaagcacagcugcccuggggugucucgugaaagacuacuucccugagcccguuaccguguccuggaacucuggagcgcugacaagcggcguccacaccuuuccugccgugcuucaauccagcggccuguacucucucuccagcguggucacgguuccgucuagcucccuggggacaaagaccuauacaugcaauguggaucauaagcccucuaacaccaaaguggacaagcgggucgagagcaaauacggaccucccuguccucccugcccggcuccugaguuccuuggcgggcccuccguguuucuguucccucccaagcccaaagauacccucaugaucagccgcacaccugagguuacguguguggucguggacguuucucaggaagauccggaggugcaguuuaauugguaugucgacggaguggagguccacaacgccaagaccaagcccagagaagaacaguucaauuccacauaccgggugguuagcgugcugaccguccugcaucaagauuggcucaacggcaaagaauauaagugcaaagugucuaauaaggggcugccuuccagcauugagaaaacaaucuccaaggcuaaaggacagccccgcgaaccucagguuuacacccuucccccgucucaggaggagaugacgaagaaccaagugagccugacaugucucgucaagggcuuuuauccuuccgacaucgccguggaaugggagucuaauggccagcccgaaaacaauuacaaaaccaccccucccgugcuggacagcgauggguccuucuuucuuuacagcagacugacaguugacaagucucgguggcaggagggaaacgucuucuccugcagcgugaugcacgaagcgcuccauaaccacuauacccaaaaaucucugucccugagccucggc

SEQ ID NO: 38437 - RNA, 657 nt, Artificial Sequence
  derived and/or modified sequence opt5 from Dupilumab_LightChain1
gacaucgugaugacccagagcccccugucccucccugucacaccgggcgagcccgccucuauuagcugcagauccucucaaagccugcuuuacuccaucggguauaacuaccuggauugguaucuccagaagucuggacagagcccucagcugcuuauuuaccugggcuccaaucgggcuagcgggguucccgaccgcuucucuggauccggcagcgggacggauuuuacccucaaaaucucuagaguggaagccgaggacgugggauucuauuacuguaugcaagcgcugcagacaccuuauaccuuuggccagggcacaaagcuggaaauuaaacggaccgucgcugcccccuccguguucaucuuuccuccgagcgaugagcagcucaagucugggacagccuccguugugugccugcuuaacaauuucuacccccgcgaagcuaaaguccaauggaagguggacaacgcccugcagagcggaaauucccaggagucuguuaccgagcaggauagcaaggacuccacguacagccucucuuccacccugacacuuagcaaagcugauuaugaaaagcacaaaguguacgccugugaggucacccaucaaggccugucuagcccugugacaaaguccuuuaacagaggggaaugc

SEQ ID NO: 38438 - RNA, 1353 nt, Artificial Sequence
  derived and/or modified sequence opt5 from Durvalumab_HeavyChain1
gaggugcagcuggucgaaagcggcgggggacucguucaacccggcgggucccugagacuuucuugcgccgcuagcggauucaccuuuucccgguacuggaugucuugggugcgccaggccccuggcaaggggcuggaguggguggcgaacaucaaacaggacggaagcgaaaaguauuacgucgauuccgugaaaggcagauucacaauuucucgggacaaugcuaagaacagccucuaucugcagaugaacucccuucgcgccgaggauacggccguuuacuauugugcuagagaaggcgggugguuuggagagcuggccuucgacuacuggggccaagggacccucgugacagucagcucugcuuccaccaaaggaccgagcguguuuccccuggccccuucuuccaagagcacaucuggcgggaccgcggcccugggaugccucguuaaggauuauuuccccgagccugugacagucuccuggaauagcggcgcucugaccuccggcgugcacacguuucccgccgugcuucagucuagcgggcuguacucccucagcucugucguuaccgugccuuccagcucucugggaacacagaccuacaucuguaaugugaaccauaaaccgagcaauacaaaggucgacaaacggguggaacccaaguccugcgauaaaacccacacguguccucccugcccugcucccgaguucgaaggcgggccgucuguuuuucuuuucccucccaagccuaaggacacacugaugauuagccgcacccccgaggugacaugugucgugguugaugugucccaugaggaccccgaagucaaauuuaacugguauguggauggagucgaggugcacaaugccaagaccaaaccuagagaggaacaguacaacagcaccuaucggguugugucuguccucacagugcugcaucaagacuggcugaauggcaaggaauacaaaugcaagguuuccaacaaagcgcucccggccagcaucgagaagacgauuucuaaggcuaaagggcagccccgcgagccucagguguauacccugcccccuuccagagaagagaugacaaagaaucaggucagccuuaccugucuggugaaaggauucuaccccuccgauaucgccguggaaugggagucuaacggccaaccggaaaauaacuauaagacaaccccucccguucucgacagcgacggcuccuuuuuccuguacucuaaacuuacggucgauaagagccgguggcagcaggggaacguguucuccugcagcgugaugcacgaggcucugcacaaucauuacacacaaaagucucucucccugagcccuggaaaa

SEQ ID NO: 38439 - RNA, 645 nt, Artificial Sequence
  derived and/or modified sequence opt5 from Durvalumab_LightChain1
gagaucgugcugacccagagccccggcacacucagccugucuccuggggaaagagccacgcuuagcugccgggcuucccaacgcgucucuagcuccuaccuggccugguaucagcagaagccgggacaggcgcccagacuccugauuuacgacgcuucuagccgggccaccggcaucccugaucgcuucuccgggagcggaucuggcacagacuuuacccuuacaauuuccagacuggagcccgaagauuucgccguuuauuacugucaacaguaugggagccucccuuggaccuuuggacagggcacaaaaguggagaucaagcggaccguggcugcccccucugucuucauuuuuccuccguccgacgaacagcugaaaagcggcacggcuucugugguuugccugcucaacaauuucuacccccgcgaggccaaggugcaauggaaagucgauaacgcgcugcaguccgggaauagccaggaguccgugaccgaacaggacucuaaggauagcacauauucccuuagcucuacccugacacucuccaaggccgacuacgagaaacacaagguuuacgcuugugaagugacccaucaaggacugagcucuccugucacgaaauccuuuaacagaggcgagugc

SEQ ID NO: 38440 - RNA, 1338 nt, Artificial Sequence
  derived and/or modified sequence opt5 from Dusigitumab_HeavyChain1
caggugcaacugguccagagcggcgccgagguuaagaaacccggggcuuccgugaaggugucuugcaaagccagcggauacaccuucacauccuaugacaucaacugggucagacaggcgacgggccaggggcucgaauggaugggauggaugaauccuaacucuggcaauaccggguacgcucaaaaguuucagggacgggugacaaugacccgcaacacaagcauuuccaccgccuauauggagcugucuagccuuagauccgaagauacagccguuuacuauugugcucgggacccguacuauuacuacuauggcauggauguguggggccaggggaccacggucaccgugagcucugccuccacaaaaggacccagcguuuucccucuggcucccugcucucgcuccaccagcgagucuacagccgcgcucggcugucuggugaaggacuacuuuccugaacccgucaccguguccuggaauagcggggcccuuacguccggagugcacacauucccugcuguccugcagucuagcggccucuauucccugagcucuguugugaccgugccguccagcaacuuugggacacaaaccuauaccugcaaugucgaucauaagcccucuaacacaaaaguggacaagacgguugagagaaaauguugcguggaguguccucccugcccugcucccccggucgccggaccuagcguguuccuguuucccccuaagcccaaagauacccucaugaucucccggacacccgaaguuaccuguguggucguggacgucucucacgaggauccugaagugcaguucaauugguacguugacggcguggagguccauaacgccaagacaaagccgcgcgaggaacaguuuaauagcaccuucagagugguuuccgugcugacggucgugcaccaggauuggcuuaacggcaaagaguacaagugcaaagugagcaauaaggggcugcccgcgccuauugaaaagacaaucucuaagaccaaaggacaaccccgggagccucagguuuauacccugcccccgucccgcgaagagaugacaaagaaccaggucagccucaccugucuugugaagggcuuuuacccuucugacauugccguggagugggaauccaaugggcaacccgagaacaacuacaaaacaacgccucccaugcuggauagcgacggauccuucuuucucuauucuaagcugaccgucgacaaaagcagauggcagcagggcaauguguucuccugcucuguuaugcaugaagcucugcacaaccacuacacacagaaaagccucucccugagcccugggaaa

SEQ ID NO: 38441 - RNA, 651 nt, Artificial Sequence
  derived and/or modified sequence opt5 from Dusigitumab_LightChain1
cagagcgugcugacccaacccccuuccgucucugccgcuccgggccagaagguuacaaucagcugcuccgggucuagcuccaacauugagaauaaccacgugucuugguaccagcagcuccccggaacggccccuaaacugcuuaucuaugacaauaacaagagacccagcggcauuccugaucgguucuccgggagcaaaucuggaaccuccgcgacacugggcaucaccgggcuccaaacaggagacgaagcugauuacuauugugagaccugggacacaagccugucugccggccgcguguuuggcgggggaaccaaacuuacgguccugggccagcccaaagccgcuccuuccgugacccucuucccgcccagcucugaggaacugcaggccaauaaggcuacacugguuugccucauuuccgauuuuuacccuggggccgugaccgucgcguggaaggccgacagcucccccgugaaagcuggaguugaaacaaccacgccuucuaagcagagcaacaauaaauaugccgcuuccagcuaccugucucuuacacccgagcaauggaagucccauagaagcuauucuugucaggugacccacgagggcagcacagucgaaaagaccguggccccgaccgagugcucc

SEQ ID NO: 38442 - RNA, 1347 nt, Artificial Sequence
  derived and/or modified sequence opt5 from Ecromeximab_HeavyChain1
gaggugacccuggucgaaagcggcggggacuucguuaagcccggaggcucccucaaagugucuugcgccgcuagcggguuugccuucucccacuacgcgaugucuugggugagacagacgccugcuaagcggcuggagugggucgccuauaucagcuccggaggcucugggacauacuauagcgauuccgugaaaggacgcuuuaccauuagcagagacaacgccaagaauacacuuuaccugcaaaugcggucucuccgcuccgaagauagcgcuauguauuucuguaccagaguuaaacugggcacauacuauuuugacucuuggggccaggggaccacacuuaccguguccagcgccucuacgaagggaccguccgucuucccccuggcuccuagcuccaagucuaccagcggcgggacagccgcgcucggaugccuggugaaagauuacuuucccgagccuguuaccguguccuggaacagcggcgcccugacaucugggguccauaccuuccccgcugugcuccaguccagcggacuguacucucuuagcuccguggucacgguuccuucuagcucccugggcacacagaccuauaucuguaaugugaaccacaagccgagcaauacaaaaguggacaagaaagucgaacccaagucuugcgauaagacccauaccuguccucccugcccugcccccgagcuccugggcgggccguccguguuucuuuucccucccaaaccuaaggacacacugaugauuagccggacgcccgagguuaccuguguggucguggauguuucucacgaagaccccgaggugaaauuuaacugguacgucgauggaguggaaguccauaaugcuaagacaaaaccucgcgaggagcaauauaacuccaccuacagagugguuagcgugcucacaguccugcaccaggacuggcugaauggcaaggaauauaaaugcaagguguccaacaaggcccucccggcgcccaucgagaaaaccauuucuaaggccaaagggcagccucgggaaccccagguuuacacgcugccucccagccgcgaugagcuuacaaagaaucaagugucccugaccugucucgucaaaggauucuauccgucugacaucgcuguggaaugggagagcaacggccagccugagaauaacuacaagaccacacccccugugcuggacuccgaugggagcuuuuuccuuuacucuaagcugaccguugacaaauccagauggcagcagggaaaugucuucagcugcucugugaugcacgaagcccuccauaaccacuauacacaaaagucccugagccugucucccggcaaa

SEQ ID NO: 38443 - RNA, 642 nt, Artificial Sequence
  derived and/or modified sequence opt5 from Ecromeximab_LightChain1
gacauccagaugacccaaacagccagcucccugcccgcuucucucggcgauagagugacgauuagcugcuccgccucucaggacaucagcaacuaccugaauugguaucagcagaagccugaugggaccgucaaacuucugauuuucuacuccucuaaccuccacagcggaguuccgucccgguuuagcggcgggggaucuggcacagacuauucccugaccaucagcaaucuugagcccgaagauauugcgacauacuucugucaucaauauucuaagcugccuuggaccuuugggggaggcacaaaacucgagaucaagcgcaccguggcugcccccuccguguucaucuuuccucccagcgacgaacagcugaaaucuggcacggccuccgucgugugccugcucaacaauuucuacccuagagaggcuaagguucaguggaagguggauaacgcccugcagagcggaaauucccaagaaucugucaccgagcaggacagcaaagauuccacauauagccuuucuuccacccugacacucagcaaggcugacuacgagaaacacaagguguacgccugugaaguuacccaucaggggcugucuagcccggugacgaaauccuuuaaccggggcgagugc

SEQ ID NO: 38444 - RNA, 1341 nt, Artificial Sequence
  derived and/or modified sequence opt5 from Eculizumab_HeavyChain1
gugcagcugguccaaagcggcgccgagguuaagaaacccggggcuuccgugaaggugucuugcaaagccagcggauacaucuucuccaacuauuggauucagugggucagacaggcgccuggccaggggcucgaauggaugggagagauccugccgggcucugggagcaccgaauacacagagaauuuuaaggaccgggugacgaugacccgcgauacauccaccucuacaguuuauauggaacuuagcucccugagaagcgaggacaccgcuguguacuauugugcccgguacuucuuuggaucuucccccaacugguauuucgaugucuggggccaaggcacacucgugaccguuagcucugccuccacgaaagggccuagcguguuuccccuggcuccuugcucucgcuccaccagcgaguccacagccgcucuuggaugucuggucaaggacuacuuccccgaaccugugaccgugucuuggaauagcggcgcccucacauccgggguccacaccuuuccggcgguucugcagagcucuggacuguacucccucagcucuguggugacgguccccagcuccaacuucggcacacagaccuauacaugcaauguggaucauaagccuucuaacaccaaaguugacaagaccguggagagaaaauguugcgucgaaugucccccuugccccgccccgccuguggcugggcccagcguuuuucuguucccucccaagcccaaagauacacuuaugauuucccggacgccugaggugaccugugucguggucgacgugagccaggaggauccggaaguucaauuuaauugguacguggacggagucgaggugcacaacgccaagacaaagccccgcgaggaacaguucaauucuaccuauagaguuguguccguccugacagugcuccaucaggauuggcugaacggcaaagaauacaagugcaaagugagcaauaagggccuuccuucuuccaucgagaaaaccauuagcaaggcuaaagggcagccccgggagccucaaguuuauacgcugcccccgucccaggaagagaugacaaagaaccaggucucucucaccugucuggugaagggauuuuacccuagcgacaucgccguggaaugggaguccaauggccaacccgaaaacaauuauaaaaccacaccucccguccuggauucugacgggagcuucuuccucuacucccgccugaccguggacaagagcagauggcaggagggaaacguguuuucuugcuccguuaugcacgaggcgcuucauaaccacuacacacagaaaagccugucucucucccugggcaag

SEQ ID NO: 38445 - RNA, 642 nt, Artificial Sequence
  derived and/or modified sequence opt5 from Eculizumab_LightChain1
gacauccagaugacccaaagccccuccucucugagcgccuccgugggcgaucgggucacaauuacgugcggggcuucugagaacaucuacggagcccucaauugguaucagcagaagccuggcaaagcgccgaagcugcuuauuuacggggcuaccaaccuggccgacggaguucccagccgguucuccggcucugggagcggaacagauuuuacccucacaaucuccagccugcagccugaagacuucgccaccuauuacugucaaaaugugcuuaacacaccccugaccuuuggccagggcacgaaaguggagauuaagcgcaccgucgcugccccuucuguguucaucuuucccccuuccgaugaacagcucaaaagcgggacagcuucuguugugugccugcugaauaacuucuauccgagagaggccaagguccaguggaagguggacaaugcgcuccaauccggaaacagccaggaaucuguuaccgagcaggauuccaaagacagcacauacucccugucuagcacccuuacgcuguccaaggccgauuaugagaaacacaagguguacgcuugugaagucacacaucagggccucagcucucccgugaccaaauccuuuaauagaggggagugc

SEQ ID NO: 38446 - RNA, 375 nt, Artificial Sequence
  derived and/or modified sequence opt5 from Efalizumab_HeavyChain
gaggugcagcuggucgaaagcggcgggggacucguucaacccggcgggucccugagacuuucuugcgccgcuagcggauacuccuucaccggccacuggaugaacugggugcggcaggccccugggaagggacuggagugggugggcaucaugauucauccgucugacagcgaaacacgcuauaaucagaaauuuaaggauaucagauucacgauuuccgucgacaaaucuaagaacacccucuaccugcagaugaauagccuucgggcggaggauacagcuguguauuacugugcccgcaucggcauuuauuuuuacgggaccacauauuucgacuacaucuggggacaaggcacccugguuacaguguccagc

SEQ ID NO: 38447 - RNA, 324 nt, Artificial Sequence
  derived and/or modified sequence opt5 from Efalizumab_LightChain
gacauccagaugacccaaagccccuccucucugagcgccuccgugggcgauagagucacaauuacgugccgggcuucuaagaccaucagcaaauaccucgccugguaucagcagaagccugggaaagcgccgaagcugcuuauuuacuccggaucuacacugcagagcggcguucccucccgcuucagcgggucuggauccggcaccgacuuuacacucaccaucagcucucugcaaccugaggauuucgcuacauauuacugucagcagcacaacgaauauccccuuaccuuugggcagggaacgaaaguggagauuaagaga

SEQ ID NO: 38448 - RNA, 768 nt, Artificial Sequence
  derived and/or modified sequence opt5 from Efungumab_SingleChain_variable_fragment
auggccgaggugcagcuggucgaaagcggcgcugagguuaagaaacccggggaaucccucagaaucucuugcaagggaagcggcuguauuaucuccucuuacuggauuagcugggugcggcaaaugccugggaaaggacuggaguggaugggcaagaucgacccgggggauuccuauauuaacuacucucccagcuuccagggacacgugaccaucuccgccgacaaaagcaucaauacagcguaucuucaguggaacucucugaaggcuuccgauacggccauguacuauugcgcccgcggcggcagagacuuuggggauagcuucgacuacuggggacagggcacccucgucacagugucuuccgggggaggcgggagcggaggcggcgggucuggaggcgggggauccgauguugugaugacccaaagcccuuccuuucugucugcuuucgucggcgaccggauuacaaucaccugucgcgccagcuccgggauuagcagauaucuugcuugguaccagcaggcccccggaaaggcgccuaaacugcucaucuacgccgcuucuacacugcagaccggcgugcccucccgguuuagcggcucugggagcggaacggaguucacccugacaauuaauucccuccaaccugaagauuuugccaccuauuacugccagcaucugaacucuuauccgcuuacauucggcgggggaaccaagguugacaucaaacgcgcugccgcgcuggagcaccaucaccaucaccac

SEQ ID NO: 38449 - RNA, 1362 nt, Artificial Sequence
  derived and/or modified sequence opt5 from Eldelumab_HeavyChain1
cagaugcaacugguggagagcggcgggggagucguucagcccggcagaucccuccggcugucuugcaccgccagcggguucacauuuuccaacaauggaaugcacugggugcgccaggcuccuggcaaggggcuugaauggguggccgucaucugguucgacggaaugaacaaauuuuacguggauucuguuaagggcagauucacgauuagccgggacaauuccaaaaacacccuguaucucgagaugaauagccugcgcgcggaagauacagcuaucuacuauugugccagagagggcgacgggucuggaauuuacuauuacuauggcauggaugugugggggcagggaaccacagucaccguguccagcgccucuacaaagggcccguccguuuuuccccuugcuccuagcucuaaauccaccagcgggggaacggccgcucugggcugccucgugaaggacuacuuccccgaaccugucaccgugucuuggaacuccggcgcccugacaagcggggugcauaccuuucccgcgguccugcaauccucuggacucuacagccuguccagcguugugacagugccuucuuccagccuuggcacccagacguauaucuguaaugucaaccacaagccgucuaauacaaaaguggauaagcggguugagcccaaaagcugcgacaagacccauacauguccucccugcccugcccccgagcugcucgggggaccguccguguuccuguuuccucccaaaccuaaggauacccuuaugauuucucgcacccccgaagucacaugugugguuguggacgucagccacgaggaucccgaagugaaguucaacugguacgucgacggcguggagguucauaaugcuaaaacgaagccuagagaggaacaguauaacuccaccuaccggguggucagcgugcugacaguucuccaccaggauuggcugaaugggaaagaguauaagugcaaagugucuaacaaggcccugccggcucccaucgagaaaaccaucuccaaggccaagggacaaccucgcgaaccccaggucuacacacucccucccagcagagaagagaugaccaaaaaucaggugucucugacgugucuugugaagggcuuuuauccguccgacauugcgguugagugggaaagcaacggccagccugagaacaauuacaaaacaacacccccuguccuggacuccgaugggucuuucuuucucuacagcaagcugaccguggacaaaucccgguggcaacagggaaacguguucucuugcagcgucaugcacgaagcccuucauaaucacuauacccagaagucccugagccucucucccggcaag

SEQ ID NO: 38450 - RNA, 648 nt, Artificial Sequence
  derived and/or modified sequence opt5 from Eldelumab_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccuaucuuuaccuucggccccggcacaaaaguggauauuaagagaaccguggcugccccuagcgucuuuaucuucccgcccucugacgagcagcucaaauccgggacggcuagcgugguuugccugcugaacaauuuuuacccucgggaagccaaggugcaguggaaagucgauaacgcgcuccaauccggaaauucucaggagagcgugaccgagcaggacuccaaggauagcacauauucucuguccagcacccuuacacugucuaaggccgacuacgaaaaacacaagguuuacgcuugugaggugacccaucagggccucagcucccccgucacgaaaucuuucaaccgcggggaaugc

SEQ ID NO: 38451 - RNA, 1341 nt, Artificial Sequence
  derived and/or modified sequence opt5 from Elgemtumab_HeavyChain1
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccgcuaucaacucucagggaaaaagcacauauuacgccgacuccgugaagggccgcuucacgauuagcagagauaauucuaaaaacacccuguaucuucagaugaacucccugcgggccgaagacacagcugucuacuauugugcccgcuggggcgaugagggguuugacaucuggggacaaggcacccucgugacaguuagcucugcuuccaccaaggggccgagcguguucccccuggccccuucuuccaaaagcacauccggaggcaccgcggcccuggggugccucgucaaggauuacuuucccgaaccugugacgguuucuuggaauagcggagcucugaccuccggcgugcacacauuccccgccguccuucagagcucuggccuguauucccucagcucuguggugaccgucccuagcuccucucuggggacacagaccuacauuuguaauguuaaccauaagccgagcaauacgaaaguggacaagagaguggagcccaaauccugcgauaagacacacaccuguccucccugcccugcucccgagcuucugggaggcccgagcgucuuucucuucccucccaaaccuaaggacacacugaugaucucucggacccccgaagugaccuguguuguggucgaugugucccaugaggaccccgaaguuaaguuuaacugguacguggauggggucgaggugcacaaugccaaaacaaagccucgcgaggaacaguauaacagcacguacagagucgugucuguucugaccgugcuccaucaagacuggcugaauggaaaagaguauaagugcaaagucuccaacaaggcgcuuccggcccccauugagaaaacaaucagcaaggcuaagggccagccucgggaaccccagguguacacccugccucccucccgcgaagagaugaccaaaaaucagguuucucucacaugucuggugaagggguucuauccgagcgauaucgccgucgagugggaauccaacggacaaccugagaauaacuacaaaacgacacccccugugcuugacucugacggcagcuuuuuccuguauuccaagcucaccguggauaaaagcagauggcagcagggcaacgucuuuucuugcuccguuaugcacgaagcucugcacaaucauuacacccaaaagagccugucucucucccccgggaag

SEQ ID NO: 38452 - RNA, 642 nt, Artificial Sequence
  derived and/or modified sequence opt5 from Elgemtumab_LightChain1
gacauccagaugacccaaagccccuccucucugagcgccuccgugggcgauagagucacaauuacgugccgggcuucucaggggaucagcaacuggcucgccugguaccagcagaaaccuggaaaagcgccgaagcugcuuauuuauggcgcuuccucucugcaaagcgggguucccucccgcuucagcggaucuggcuccgggaccgacuuuacacucaccaucagcucucugcagccugaggauuucgccacauacuauugucagcaguacuccagcuuucccaccacauucggacaaggcaccaaaguggaaauuaagagaacgguggccgcuccuucugucuuuaucuuucccccuuccgacgagcagcuuaaaagcggcaccgccuccgugguuugccugcucaauaacuucuauccgcgggaagcuaaggugcaguggaaggucgauaaugcccugcagucugggaacagccaagaguccgugacagaacaggacagcaaagauucuaccuacucccugagcucuacacucacccugagcaaggcggacuaugagaaacacaagguuuacgccugugaggugacgcaucagggacuuuccucucccgucacaaagagcuucaaucgcggcgaaugc

SEQ ID NO: 38453 - RNA, 1347 nt, Artificial Sequence
  derived and/or modified sequence opt5 from Elotuzumab_HeavyChain1
gaggugcagcuggucgaaagcggcgggggacucguucaacccggcgggucccugagacuuucuugcgccgcuagcggauucgacuuuucccgguacuggaugucuugggugcgccaggccccuggcaaggggcuggaguggaucggagaaauuaacccggauagcuccaccaucaauuaugcgcccucucucaaagacaaguucauuaucagcagagauaacgcuaaaaauucccuguaccuucagaugaacagccugcgggccgaggacacagccguguauuacugugcucgcccugauggcaauuauugguacuuugacgucuggggccaggggacgcucgugaccguuucuuccgccagcacaaagggacccucuguguucccucuggcucccuccagcaaaucuaccuccggcgggacagccgcgcugggaugccucgucaaggauuauuuuccugaaccggugaccguuagcuggaacuccggcgcccugacaucuggggugcacaccuuccccgcuguccuucaaagcuccggacuguacagccucucuuccguggugacggucccuagcucuagccugggcacccagacauacauuuguaauguuaaccauaagcccuccaauaccaaaguggacaagaaaguggagccuaagucuugcgauaaaacacacaccugucccccgugcccugcccccgagcuucugggcgggccuagcgucuuucucuucccgcccaagccuaaggacacgcugaugaucuccagaacaccggaagugaccuguguuguggucgaugugagccaugaggaccccgaaguuaaauuuaacugguauguggauggagucgaggugcacaaugcuaagacaaaaccucgggaggaacaguacaacucuaccuaucgcgucguguccguucugaccgugcuccaucaggacuggcugaauggcaaggaguacaaaugcaaggucagcaacaaagcccuucccgcgccuaucgaaaagacaauuucuaaggccaaagggcaacccagagagccccagguguauacgcugccucccucccgggacgaacucaccaagaaucagguuagccugacaugucuugugaaaggauucuacccuuccgauaucgcugucgagugggagucuaacggccagcccgaaaacaauuauaagaccacaccucccgugcuggacagcgauggguccuuuuuccucuacucuaaacugaccguggacaagagccgcuggcaacagggaaacgucuuuuccugcagcguuaugcacgaggcccugcacaaucauuacacgcagaagucucucucccugagcccgggcaaa

SEQ ID NO: 38454 - RNA, 642 nt, Artificial Sequence
  derived and/or modified sequence opt5 from Elotuzumab_LightChain1
gacauccagaugacccaaagccccuccucucugagcgccuccgugggcgauagagucacaauuacgugcaaggcuucucaggacguugggaucgccguggcgugguaccagcagaaaccuggaaaggugccgaaacuccugauuuauugggcuagcacccggcacacaggcguccccgaucgcuucuccgggucuggaagcggcaccgacuuuacacuuaccaucuccagccugcaaccugaggauguggccacauacuauugucagcaguacucuuccuaucccuacaccuucgggcagggaacgaagguugaaauuaaaagaaccguggccgcuccuagcgucuuuaucuuucccccuucugacgagcaacucaaguccggcacagccagcgugguuugccugcuuaacaauuucuauccgcgggaagcuaaggugcaguggaaagucgauaacgcccugcagucuggcaauucccaggagagcgugaccgaacaagacuccaaggauucuacauacagccucuccagcacccugacgcugucuaaagcggacuacgagaagcauaaaguguaugccugugaggucacacaccaggggcucuccagccccguuaccaagucuuucaaccgcggagaaugc

SEQ ID NO: 38455 - RNA, 1338 nt, Artificial Sequence
  derived and/or modified sequence opt5 from Emactuzumab_HeavyChain1
caggugcaacugguccagagcggcgccgagguuaagaaacccggggcuuccgugaaggugucuugcaaagccagcggauacaccuucacauccuaugacaucucuugggucagacaggcgccuggccaggggcucgaauggaugggagugauuuggacggauggcgggaccaacuacgcucaaaagcugcagggacggguuacaaugaccacagacaccagcacauccaccgccuauauggagcuucgcucucugagaagcgaugacacggccguguacuauugugcucgggaucagcgccucuacuuugacgucuggggccagggcaccacagugaccguuuccagcgccucuacaaaagggccguccguguucccccuggcuccuagcucuaaguccaccagcggaggcacggccgcgcuugggugccuggucaaggauuauuuucccgaaccugugacagugucuuggaacuccggagcccucaccagcggcguccacacauuccccgcuguucugcaauccucugggcuguacagccucuccagcguggugaccgucccuucuuccagccugggaacccagacauacaucuguaaugugaaucauaaaccgucuaacacgaagguugacaaaaagguggagcccaaaagcugcgauaagacccacacauguccucccugcccugcccccgaacuucugggcggcccguccgucuuucucuucccucccaagccuaaagacacccugaugauuucuagaacacccgaggugaccuguguuguggucgaugugagccaugaggaccccgaagucaaguuuaauugguauguggaugggguugaggugcacaacgcuaaaacgaagccucgggaggaacaguacaauuccacauaucgcgucgugagcguucuuaccgugcugcaucaggacuggcucaacggaaaagaguacaagugcaaagucucuaauaaggcccugccggcgcccaucgaaaagaccauuuccaaagccaagggccaaccuagagagccccagguguauacacugccucccagccgggacgaacucaccaaaaaccaggugucucugacaugucuuguuaagggguucuacccguccgauaucgcugucgagugggaaagcaauggacaaccugagaacaauuauaaaacgacacccccugugcuggacuccgauggcagcuuuuuccucuacucuaagcugaccguggacaagucccgcuggcagcaggggaacgucuuuucuugcagcgugaugcacgaggcccuucacaaucauuacacccagaaaucccugagccucucucccggaaag

SEQ ID NO: 38456 - RNA, 639 nt, Artificial Sequence
  derived and/or modified sequence opt5 from Emactuzumab_LightChain1
gacauccagaugacccaaagccccuccucucugagcgccuccgugggcgauagagucacaauuacgugccgggcuucugaggacguuaacaccuacgugagcugguaucagcagaagccugggaaagccccgaagcuccugaucuacgcggcuuccaaucgcuauacaggagugcccucuagauucagcggcuccgggagcggaaccgauuuuacacuuaccauuucuucccugcagccugaagacuucgccacauacuauugucaacagagcuuuucuuaccccaccuucggccaggggacgaaacucgagaucaagcggaccgucgccgcuccuuccguguuuauuuuucccccuagcgaugaacagcugaaaucuggaacagccuccguugugugccuucugaacaauuucuauccgcgcgaggcuaagguccaauggaagguggacaacgcccuccagagcggcaauucccaggaaucuguuaccgagcaggauagcaaagacuccacauacagccugucuuccacccugacgcucagcaaggcggauuacgagaaacacaagguguaugccugugaagucacacaucaaggccugucuagccccgugaccaaauccuucaacagaggggagugc

SEQ ID NO: 38457 - RNA, 1323 nt, Artificial Sequence
  derived and/or modified sequence opt5 from Emibetuzumab_HeavyChain1
caggugcaacugguccagagcggcgccgagguuaagaaacccggggcuuccgugaaggugucuugcaaagccagcggauacaccuucacagacuauuacaugcacugggucagacaggcgccuggccaggggcucgaauggaugggacgggugaacccgaaucgcagaggcacgaccuauaaccaaaaguuugaggggcggguuacaaugaccacagauaccuccacaucuaccgcuuacauggaacugcgcagccuuagauccgacgauacggccguguauuacugugcccgggcuaauuggcuggacuauuggggacagggcaccacagucaccgugucuagcgccuccacaaaaggccccagcguuuucccucucgcucccugcucucgcuccaccagcgagucuacggccgcgcuggggugucuugugaaggauuacuuuccugaacccgucacaguguccuggaacagcggagcccugaccucuggcgugcauacauucccugcuguccuccaguccagcgggcuguacucccugucuagcguugugaccgugccguccagcucucucggaaccaagacauauacgugcaaugucgaccacaaacccuccaacaccaagguggauaaaagaguugagagcaaguacggcccucccuguccucccugcccggccccugaggcugccgggggacccucuguguuucuguucccucccaaacccaaggacacacuuaugaucagccggaccccugaagucacaugugugguuguggaugucucccaggaggacccggaagugcaauuuaauugguaugucgauggcguggagguucauaacgcgaagaccaaaccccgcgaggaacaguucaauucuacguacagaguggucagcgugcugacaguucuccaccaggacuggcugaacggcaaggaguauaaaugcaagguguccaauaaagggcuuccuagcucuauugaaaagaccaucuccaaagccaagggacagccccgggagccucaagucuacacccugcccccgagccaggaagagaugacaaagaaccaggugucucucaccugucuggugaaaggcuuuuauccuuccgauauugcuguugagugggaaagcaaugggcaacccgagaacaauuacaagacaacgccucccguccuggacuccgacggaucuuucuuucucuacagccgccugaccguggauaaauccagauggcaggaaggcaacguguucucuugcagcgucaugcaugaggcccuucacaaccacuauacacagaagucccugagccucucucugggg

SEQ ID NO: 38458 - RNA, 645 nt, Artificial Sequence
  derived and/or modified sequence opt5 from Emibetuzumab_LightChain1
gacauccagaugacccaaagccccuccucucugagcgccuccgugggcgauagagucacaauuacgugcucuguuagcuccucugugagcuccaucuaccuccacugguaucagcagaagccugggaaagcuccgaagcugcuuauuuacagcaccucuaaccuggccuccggagugcccagccgguucucuggcuccgggagcggaacagacuuuacccucacaaucucuucccugcagccugaggauuucgcgaccuauuacugucaagucuauagcggcuacccccuuacauuugggggaggcaccaaaguggaaauuaagcgcacgguugcugccccuuccguguucaucuuucccccuucugacgagcagcugaaaagcggcaccgccuccgucgugugccuccugaauaacuucuauccgagagaagcuaagguucaguggaagguggauaaugcccugcagagcgggaacucucaagaguccgucacagaacaggacagcaaagauucuaccuacagccucuccucuacacugacccuuagcaaggcugacuacgagaaacauaagguguaugccugugaggugacgcaccagggacuguccagccccgucacaaaaucuuuuaaucggggcgaaugc

SEQ ID NO: 38459 - RNA, 1344 nt, Artificial Sequence
  derived and/or modified sequence opt5 from Emicizumab_HeavyChain1
caggugcaacuggucgagagcggcgggggacucguucagcccggcgggucccugagacuuucuugcgccgcuagcggauucaccuuuuccuacuaugacauccagugggugcggcaggccccuggcaaggggcuggaaugggugucuagcauuuccccgucuggacaaagcacauacuaucgcagagaggucaaaggccgguucacgaucucccgcgauaacagcaagaauacccucuaccugcagaugaacucucuuagagcggaagacacagcuguguauuacugugcccggcgcaccggcagagaguaugggggaggcugguacuuugauuacugggggcagggaacacugguuaccguguccagcgccucuacaaaaggccccuccgucuucccucucgcucccugcagccggucuaccuccgaaagcacggccgcucuggggugucuggugaaggacuauuuuccugagcccguuaccguguccuggaacucuggagcccucacaagcggcguccacaccuucccugcggugcugcaguccagcggccuuuacucucuguccagcguggucacaguuccgucuagcucccucgggacccaaacguauacaugcaauguggaucauaaacccucuaauaccaagguggacaagcgcgucgagagcaaauacggaccucccuguccucccugcccggccccugaauuucugggcgggcccuccguguuccuuuuuccucccaagcccaaagauacacugaugauuagcagaaccccugagguuaccuguguggucguggacguuucucaggaagauccggaggugcaguucaacugguaugucgacggaguggagguccacaaugcuaagacaaaaccccgggaggaacaguacaacuccacguaucgcgugguuagcgugcucaccguccugcaucaagauuggcugaauggcaaggaauacaagugcaaagugucuaacaaggggcucccuuccagcaucgagaaaacaauuuccaaggccaaaggacagcccagagaaccucagguuuacacccugcccccgucucaaaaggagaugaccaaaaaucaggugagccuuacaugucuggucaagggcuuuuauccuuccgacaucgcuguggagugggaaucuaacggccagcccgagaauaacuacaagacgacaccucccgugcucgauagcgacggguccuucuuucuguauagcaaacuuaccguugacaagucucgguggcaggaaggaaaugucuucuccugcagcgugaugcacgaggcccugcauaaccgcuacacccaaaaaucucucucccugagcccu

SEQ ID NO: 38460 - RNA, 1332 nt, Artificial Sequence
  derived and/or modified sequence opt5 from Emicizumab_HeavyChain2
caggugcaacugguccagagcggcuccgagcucaagaaacccggggccucuguuaaggugagcugcaaggcuuccggauacaccuucacagacaacaauauggauugggugagacaggccccuggccaggggcuggaauggaugggagacaucaacacgcggucuggcgggagcauuuauaaugaggaauuucaagaucgcgucaucaugaccguggacaaauccacagauaccgcguacauggagcuuucuagccugagauccgaagacacagcuaccuaucacugugcccggcgcaaaagcuacggauauuaccucgaugaguggggcgagggcacacugguuaccgugucuuccgccagcacgaaggggccgucugucuucccccuugcuccuugcuccagaagcaccucugaauccacagccgcucugggaugucucgugaaggacuauuuucccgagccuguuaccgugagcuggaacuccggcgcccugacaucugggguccauaccuuccccgcggugcugcagagcuccggacucuacagccugucuuccguggucacgguuccuagcucuagccuuggcacacagaccuacacaugcaauguggaucacaaaccguccaacaccaagguggacaaacgggucgaaucuaaguaugggcccccuugucccccuugccccgccccggaguuucugggaggcccuagcguguuccucuuucccccuaaacccaaggauacccugaugauuucccgcacacccgagguuacguguguggucguggacguuagccaggaagauccugaggugcaauucaauugguacgucgacggcguggaaguccauaacgcuaagaccaaaccgagagaggaacaguauaauucuacauaccgggugguuuccgugcuuaccguccugcaccaggacuggcucaacgggaaggaguauaaaugcaaggugagcaauaaaggacugcccucuuccaucgagaagacaauuagcaaagccaagggccagccucgcgaaccccaaguuuacacccugccucccucccaggaggaaaugacgaagaaccaggugucucucacaugucuggucaaaggguuuuauccgagcgauaucgcuguggagugggaauccaauggacaaccugagaacaauuacaagaccacacccccugugcuugacucugauggcagcuucuuucuguacuccaaacucaccguugacaagagcagauggcaggaggggaacgucuucucuugcuccgugaugcaugaagcccugcacaaccacuauacccaggagagccuuucucuguccccc

SEQ ID NO: 38461 - RNA, 642 nt, Artificial Sequence
  derived and/or modified sequence opt5 from Emicizumab_LightChain1
gacauccagaugacccaaagccccagcucucugagcgccuccgugggcgauagagucacaauuacgugcaaggcuucucggaacaucgagcgccagcucgccugguaccagcagaaaccugggcaagcgccggaacugcuuauuuaucaggcuagcagaaaggaguccggaguucccgaccgguucucuggcagccgcuacgggaccgauuuuacacugaccaucuccagccuccagccugaagacauugccacauauuacugucagcaauauucugaucccccucugaccuucggaggcgggacaaaaguggagaucaagagaaccguggccgcucccuccgucuuuaucuucccuccgagcgacgaacagcuuaaaucuggaacggccuccgugguuugccugcucaauaacuuuuacccccgggaggcuaaggugcaguggaaggucgauaaugcccugcagagcggcaacucucaagaguccgugaccgaacaggacagcaaagauuccacauauucucugagcuccacccucacacugagcaaggcggacuacgagaaacacaagguuuacgccugugaagugacccaucagggccuuucuuccccugucacgaaauccuucaaucgcggggagugc

SEQ ID NO: 38462 - RNA, 1347 nt, Artificial Sequence
  derived and/or modified sequence opt5 from Enavatuzumab_HeavyChain1
gaggugcagcuggucgaaagcggcgggggacucguucaacccggcgggucccugagacuuucuugcgccgcuagcggauucaccuuuuccucuuacuggaugagcugggugcggcaggccccuggcaaggggcuggaguggguggcggaaauccgccucaaauccgacaacuaugcuacacacuacgccgagucugucaagggaagauucacgauuagccgggaugacuccaaaaauagccuguaucuucagaugaacucucugcgcgccgaagauaccgcuguguacuauuguacaggcuacuaugccgacgcuauggauuacuggggccaggggacccucguuacaguguccagcgccucuaccaagggaccguccgucuuuccccuggcgccuagcucuaaauccacaagcggcgggaccgccgcucugggaugccucgugaaggacuacuuccccgagccuguuacgguguccuggaacucuggcgcccugaccagcgggguccauacauuucccgcugugcuucaauccagcggacuguauucucucuccagcguggucaccguuccuucuagcucccugggcacacagaccuacaucuguaaugugaaucacaagccgucuaacacgaaaguggauaagaaagucgagcccaagagcugcgacaaaacacauaccuguccucccugcccugcccccgaacuucugggcgggccguccguguuccucuuuccucccaagccuaaggauacacugaugauuagcagaacccccgagguuaccuguguggucguggacguuucucacgaagaucccgaggugaaauucaauugguaugucgacggaguggagguccauaacgcgaagacaaaaccucgggaggaacaguacaauuccacguaucgcgugguuagcgugcugaccguccuccaccaggauuggcugaacggcaaggaauacaaaugcaaggugucuaauaaagcccuuccggcucccaucgagaagacaauuuccaaggccaaagggcaaccuagagaaccccagguuuauacccugccucccagccgggaggagaugacaaagaaccaggugucccucaccugucuggucaaaggauuuuacccgucugacaucgcuguggaaugggagagcaauggccagccugaaaacaauuacaagacgacacccccugugcuugacuccgaugggucuuucuuucuguauagcaaacucaccguugacaagucccgcuggcaacagggaaacgucuucagcugcucugugaugcacgaggcccugcauaaccacuacacccagaagucccugagccucucucccggcaaa

SEQ ID NO: 38463 - RNA, 654 nt, Artificial Sequence
  derived and/or modified sequence opt5 from Enavatuzumab_LightChain1
gacauccagaugacccaaagccccuccucucugagcgccuccgugggcgauagagucacaauuacgugccgggcuucucagagcguuuccaccucuagcuacuccuauaugcacugguaccagcagaagccugggaaagccccgaagcuccugaucaaauaugcgagcaaccuugagucuggagugcccucccgcuucagcggcucuggguccggaacagacuuuacccugacaauuagcucucuccaaccugaagauuucgcuaccuacuauugucagcauuccugggagauccccuacacauuuggcgggggaaccaagguggaaauuaaaagaacggucgccgccccuagcguguucaucuuucccccuuccgacgagcagcugaagucuggcaccgcuagcguugugugccuucugaauaacuucuauccgcgggaagccaagguccaguggaaaguggauaaugcucuccaauccggcaacagccaggagucuguuacagagcaggacuccaaggauagcaccuacucucugagcuccacacugacccucucuaaagccgacuacgaaaagcacaaaguguaugcgugugaggucacgcaucaggggcugagcucccccgugacaaagagcuuuaaucgcggagaaugc

SEQ ID NO: 38464 - RNA, 1341 nt, Artificial Sequence
  derived and/or modified sequence opt5 from Enfortumab_HeavyChain
gaggugcagcuggucgaaagcggcgggggacucguucaacccggcgggucccugagacuuucuugcgccgcuagcggauucaccuuuuccucuuacaacaugaauugggugcggcaggccccuggcaaggggcuggagugggugagcuauaucuccucuagcuccagcacaauuuacuaugcggacucugucaaaggacgcuucacgaucuccagagauaacgcuaagaauagccucucucugcagaugaacucccuucgggacgaagauaccgccguguacuauugugcccgcgcuuacuauuacggcauggacguuuggggccaggggacaaccgugacagucagcucugccuccaccaaaggaccgagcguguuuccccuggcuccuuccucuaagagcacauccggcgggaccgccgcgcucggaugccugguuaaagauuacuuccccgagccugugacggucagcuggaacucuggcgcccugaccuccggggugcacacauuucccgcugugcuccaaagcucuggacuguauagccuuuccucugucguuaccgugccuagcuccagccugggcacacagaccuacauuuguaaugugaaucauaagccgucuaacacgaaggucgacaaaagaguggaacccaaguccugcgauaaaacacacaccuguccucccugcccugcccccgagcuccugggcgggccgagcguuuuccuuuuuccucccaagccuaaagacacacugaugaucucucggacccccgaggugaccugugucgugguugaugugucccaugaagaccccgaggucaaguucaauugguauguggauggagucgaagugcacaacgcuaagacaaaaccucgcgaggagcaguacaauagcacguauagaguuguguccguccucaccgugcugcaucaggacuggcugaacggcaaggaauacaaaugcaagguuucuaauaaagcccucccggcgcccauugagaagacaaucagcaaagccaaggggcaaccucgggaaccccagguguauacccugccucccucccgcgaggaaaugacaaagaaccaggucucucuuaccugucuggugaaaggauuuuacccgagcgauaucgcuguggagugggaguccaauggccagccugaaaacaacuacaagacgacacccccuguucucgacagcgacgggucuuucuuucuguauuccaaacuuaccgucgauaagagcagauggcaacagggaaauguguucucuugcuccgugaugcacgaggcccugcacaaccauuacacccagaaaagccucucucugagccccggcaag

SEQ ID NO: 38465 - RNA, 642 nt, Artificial Sequence
  derived and/or modified sequence opt5 from Enfortumab_LightChain
gacauccagaugacccaaagccccuccucugugagcgccuccgucggcgauagaguuacaauuacgugccgggcuucucaggggaucagcggauggcuggccugguaccagcagaagccuggcaaagcgccgaaguuccucauuuaugcugccuccacccugcaaucuggggugcccagccgcuuuuccggaagcggcucugggacagacuucacccuuacaaucuccagccugcagccugaggauuuugccaccuacuauugucagcaggcuaacucuuuucccccuacauucggaggcggcaccaaaguggaaauuaagagaacggucgccgcucccuccguguucaucuuuccuccgagcgacgagcaacucaaaucugggaccgccuccguugugugccugcuuaauaacuucuacccccgggaagcgaagguccaguggaagguggauaaugcccugcagagcggaaacucccaggagucuguuacagaacaagacagcaaagauuccaccuauagccucucuuccacacugacccugagcaaggcugacuacgagaaacacaagguguaugccugugaggucacgcaucagggccucucuagcccugugacaaaauccuuuaaucgcggggaaugc

SEQ ID NO: 38466 - RNA, 1341 nt, Artificial Sequence; identical to SEQ ID NO: 38464
  derived and/or modified sequence opt5 from Enfortumab_vedotin_HeavyChain1

SEQ ID NO: 38467 - RNA, 642 nt, Artificial Sequence; identical to SEQ ID NO: 38465
  derived and/or modified sequence opt5 from Enfortumab_vedotin_LightChain1

SEQ ID NO: 38468 - RNA, 1356 nt, Artificial Sequence
  derived and/or modified sequence opt5 from Enoblituzumab_HeavyChain
gaggugcagcuggucgaaagcggcgggggacucguucaacccggcgggucccugagacuuucuugcgccgcuagcggauucaccuuuuccucuuucggcaugcacugggugcggcaggccccugggaagggacuggaguggguggcguacaucagcuccgacucuagcgcuauuuauuacgccgauacagucaaaggccgcuuuacgaucuccagagacaacgccaagaauagccucuaucugcagaugaacucucuucgggaugaagacaccgcuguguacuauuguggccgcgggagagagaauauuuacuauggaucccggcuggauuacuggggccaggggacaaccguuacagugagcucugccuccaccaaaggaccgagcgucuucccccucgcuccuucuuccaagagcacauccggcgggaccgccgcgcugggaugccuggugaaagacuacuuucccgaaccuguuacggugucuuggaacagcggcgcccucaccuccggcguccauacauuccccgcugugcugcaaagcucugggcuuuauucccugagcucuguggucaccguuccuagcuccucucucggaacacagaccuacaucuguaaugugaaccacaagccgagcaauacgaagguggauaaacgcgucgagcccaaguccugcgacaaaacacauaccuguccucccugcccugcccccgagcuggugggcgggccgagcguuuuucuucugccucccaagccuaaagauacacucaugauuucuagaacccccgaagugaccugugucgugguugacgugucccacgaggaucccgaagucaaguucaacugguauguggacggagucgaggugcauaaugcuaagacaaaaccuccggaggaacaguacaacagcacgcugcggguugugucuguccugaccgugcuccaccaggauuggcugaauggcaaggaguauaaaugcaagguuuccaacaaagcccuucccgcgccuaucgaaaagacaaucagcaaagccaaggggcaaccccgcgagccucagguguacacccugcccccguccagagaagagaugacaaagaaucaggucucucucaccugucuggugaaaggauuuuauccuagcgacauugcuguggagugggaauccaacggccagcccgagaauaacuacaagacgacaccucuuguucuggacucugauggcagcuucuuucucuacuccaaacugaccgucgacaagagccgguggcaacaggggaacguguucucuugcuccgugaugcacgaagcccugcauaaucacuauacccagaaaagccucucucugucccccggaaag

SEQ ID NO: 38469 - RNA, 642 nt, Artificial Sequence
  derived and/or modified sequence opt5 from Enoblituzumab_LightChain
gacauccagcugacccaaagccccuccuuccucucugccagcgugggcgauagagucacaauuacgugcaaggcuucccagaacguugacaccaauguggccugguaccagcagaaaccugggaaggcgccgaaagcucugaucuauucugccagcuaccgguauuccggagugcccucucgcuuuagcggcuccgggagcggaacagauuucacccuuacaauuucuucccugcaaccugaggacuuugccaccuacuauugucagcaguacaacaauuaucccuucacauuuggccaggggaccaagcucgaaaucaaaagaacggucgcugccccuagcguguucauuuuucccccuucugaugagcaacugaaguccggaaccgcuagcguugugugccuucugaacaauuucuacccgcgggaagccaagguccaguggaaaguggacaacgcgcuccagucuggcaauucccaggagagcguuacagaacaagauuccaaggacucuaccuacagccuguccagcacacugacccucucuaaagccgauuaugagaagcacaaaguguacgcuugugaggucacgcaucagggccuguccagccccgugacaaagucuuuuaaccgcggggaaugc

SEQ ID NO: 38470 - RNA, 1356 nt, Artificial Sequence
  derived and/or modified sequence opt5 from Enokizumab_HeavyChain1
caggugcaacugguccagagcggcgccgagguuaagaaacccggguccucugugaaggugagcugcaaggcuuccggaggcaccuucucuuacuauuggaucgaaugggucagacaggccccugggcagggacucgaguggaugggcgaaauucugccggggagcggaacaacgaaccccaaugagaaauuuaaaggccgggugaccaucacagcggacgaauccaccucuacagcuuacauggagcuuagcucccugcgcagcgaggauaccgccguuuauuacugugccagagcugacuauuacggcucugauuaugugaaguucgacuacugggggcaaggaacacucgucaccguguccagcgccucuacgaagggcccuuccguuuuuccccuggcuccuagcucuaaauccaccagcgggggaacagccgcgcuuggcugccuggugaaggauuacuuccccgaaccugucaccguguccuggaacucuggggcccucacaagcggagugcacaccuuuccggcuguccugcaguccagcggccuguauucucucuccagcguugugacggugcccucuagcucccugggcacacagaccuacauuuguaaugucaaccauaaaccuucuaauacaaagguggacaaacggguugagcccaagagcugcgauaagacccacaccuguccucccugcccggccccugaacuucucgggggacccuccguguuccuguuuccucccaaacccaaggacacacugaugaucagccgcacgccugaggucaccugugugguuguggaugucucucaugaggacccggaagugaaauucaacugguaugucgauggcguggagguucacaaugcuaagacaaaacccagagaggaacaguacaacuccaccuaucggguggucagcgugcuuacaguucugcaucaagacuggcucaaugggaaggaauacaaaugcaaggugucuaacaaggcccugccugcgcccauugagaaaaccaucuccaaggccaaaggacagccucgcgagccccaggucuauacgcugccgccuagcagagaagagaugacaaagaaucaggugucccucaccugucuggugaaaggcuuuuaccccucugauaucgcuguugaaugggagagcaacgggcaaccugaaaauaacuacaagaccacacccccuguccuugacuccgacggaucuuucuuucuguauagcaagcucaccguggauaaaucccgguggcagcagggcaauguguucagcugcucugucaugcacgaggcccugcacaaccauuacacacaaaagucccuuagccugucucccggcaaa

SEQ ID NO: 38471 - RNA, 642 nt, Artificial Sequence
  derived and/or modified sequence opt5 from Enokizumab_LightChain1
gacauccagaugacccaaagccccuccucucugagcgccuccgugggcgauagagucacaauuacgugcaaggcuucucagcacguuaucacccaugugacaugguaccagcagaaaccugggaaggccccgaaacuccugauuuauggaaccagcuacuccuauucuggcgugcccagccgguucuccgggagcggaucuggcacagacuuuacccuuacaaucuccagccugcaaccugaggauuucgcgaccuacuauugucagcaguuuuacgaauauccccucacguucgggggaggcaccaaggucgagauuaaacgcacaguggcugccccuucuguuuuuaucuuucccccuuccgacgaacagcuuaagagcggcaccgccucuguggucugccugcugaacaauuucuacccgagagaggcuaaggugcaauggaaaguugauaacgcccuccaguccgggaauagccaggaauccgugacagagcaggacucuaaggauagcaccuacucccugagcucuacgcugacacucuccaaagcugacuaugagaagcacaaagucuacgccugugaagugacccaucaaggacugagcucucccgugacaaagagcuucaaccggggcgagugc

SEQ ID NO: 38472 - RNA, 612 nt, Artificial Sequence
  derived and/or modified sequence opt5 from Enokizumab_LightChain
gacauccagaugacccaaagccccuccucucugagcgccuccgugggcgauagagucacaauuacgugcaaggcuucucagcacguuaucacccaugugacaugguaccagcagaaaccugggaaggccccgaaacuccugauuuauggaaccagcuacuccuauucuggcgugcccagccgguucuccgggagcggaucuggcacagacuuuacccuuacaaucuccagccugcaaccugaggauuucgcgaccuacuauugucagcaguuuuacgaauauccccucacguucgggggaggcaccaaggucgagauuaaacgcacaguggcugccccuucuguuuuuaucuuucccccuuccgacgaacagcuuaagagcggcaccgccucuguggucugccugcugaacaauuucuacccgagagaggcuaaggugcaauggaaaguugaauccgugacagagcaggauagcaaggacuccaccuacucucucagcuccacgcugacacugagcaaagccgauuaugagaagcacaaagucuacgcuugugaagugacccaucaggggcucucuucccccgugacaaagagcuucaaccggggagagugc

SEQ ID NO: 38473 - RNA, 1356 nt, Artificial Sequence
  derived and/or modified sequence opt5 from Enoticumab_HeavyChain1
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucagcuuccugugguaugacggaacaaacaaaaauuacguggaguccguuaagggcagauuuacgaucucucgggauaacagcaaaaauaugcucuaucuggaaaugaacucccuucgcgcggaggacaccgcuguguacuauugugccagagaucaugacuuccggagcggcuacgaagggugguuugauccguggggacagggcacacuggucaccgugucuuccgccagcacaaaggggcccucuguuuucccucucgcucccuccagcaaaucuaccuccggaggcacagccgcucuggggugccuggugaaggacuauuuuccugagcccgucaccgugagcuggaacuccggagcccucacgucuggcgugcacaccuucccugcgguccugcaaagcuccggccuuuacagccugucuuccguugugacagugccgagcucuagccucgggacccagacauacauuuguaaugucaaucauaagcccuccaacaccaaaguggauaagaaaguugagccuaagucuugcgacaaaacgcacacaugucccccuugccccgccccggaacugcuuggaggcccuagcguguuucuguuucccccuaagcccaaggauacccucaugaucucccgcacacccgaggucaccugugugguuguggacgucagccaugaagauccugaggugaaauucaauugguaugucgacgggguggagguucacaacgcuaagaccaaaccgagagaggaacaguacaauucuacauaucggguggucuccgugcugacgguucugcaccaggauuggcucaacggaaaggaauacaaaugcaaggugagcaauaaagcccugcccgcuccuauugagaagaccaucucuaaggccaaaggccaaccccgcgaaccucaggucuauacacuucccccguccagagacgagcugaccaagaaccaggugagccucacaugucuggugaaaggguucuacccuuccgacauugcgguugagugggaaucuaauggacagcccgagaacaacuauaagaccacgccucccguccuugauagcgacggcuccuuuuuccuguacucuaaacucacaguggauaagagccgguggcaacagggcaauguguucuccugcagcgucaugcaugaagcccugcacaaccauuacacccagaagucucugucccucagcccuggg

SEQ ID NO: 38474 - RNA, 642 nt, Artificial Sequence
  derived and/or modified sequence opt5 from Enoticumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacaccgcagcaauuggccucccaccuuuggcgggggaacaaaaguggagaucaagagaaccguggcugccccuucugucuucauuuuuccgcccuccgaugaacagcucaaaagcggcacggcgucugugguuugccugcugaacaauuucuauccucgggaggccaaggugcaguggaaagucgacaacgcucuccaguccggcaauagccaagaguccgugaccgaacaggauucuaaggacagcacauacucccugagcucuacccuuacacuguccaaggccgauuaugagaaacauaagguuuacgcuugugaagugacccaccaggggcucagcucucccgucacgaaauccuuuaaccgcggagagugc

SEQ ID NO: 38475 - RNA, 1329 nt, Artificial Sequence
  derived and/or modified sequence opt5 from Ensituximab_HeavyChain1
caagugcaacugaaggagagcggccccgaccucgucgccccuucccagucucugagcaucacaugcacaguuuccggguucucucuuagcaaauuuggagugaacugggugagacagccgcccggcaaggggcuggaauggcucggagucauuuggggcgauggguccacgucuuacaauagcggacugaucucccggcuuagcauuucuaaagagaacuccaagagccagguguuccugaaacucaauucucugcaagcugacgauaccgccacauauuacuguguuaagccuggcggcgacuauugggggcacggaaccuccgugacagucagcucugcguccaccaagggccccagcguguuuccucuggcucccuccucuaaaagcacauccgggggaaccgccgcccucggcugccugguuaaggauuacuucccugaaccggugacggucagcuggaacucuggggcucuuaccuccggagugcauacauuucccgccgugcugcagagcucuggcccuuauagccucuccucugucguuaccgugcccagcuccagccugggcacacagaccuacaucuguaaugugaaccacaaaccuucuaauacgaaggucgacaaaaagguggagcccaaguccugcgauaaaacacauaccuguccgccuugccccgcuccugaacuucucgggggacccagcguuuuccuguuucccccuaagccgaaagacacacugaugauuucucgcacccccgaggugaccugugucgugguugaugugucccacgaggacccugaagucaaguucaacugguauguggauggcgucgaggugcauaaugccaaaacaaagcccagagaggaacaguacaacagcacguaccggguuguguccguccugaccgugcuccaccaagacuggcugaaugggaaagaguauaagugcaagguuucuaacaaagcgcuuccugcccccaucgaaaagacaaucagcaaagcuaagggacagccgcgcgagccucagguguacacccugcccccuuccagagaugaacucaccaaaaaucaggucucucugaccugucuugugaagggcuuuuaucccagcgacauugccguggagugggaauccaacgggcaaccugagaauaacuacaagacgaugcccccgguucuggacagcgauggaucuuucuuucucuauuccaaacugacagucgacaagagccgguggcagcagggcaacguguucucuugcuccgugaugcacgaggcucugcauaaucacuacacccagaaaagccucucucugagcccuggcaag

SEQ ID NO: 38476 - RNA, 639 nt, Artificial Sequence
  derived and/or modified sequence opt5 from Ensituximab_LightChain1
caggugguccugacccaaagccccguuaucauguccgccucuccuggcgagaaagugacaaugacgugcagcgcuuccucuagcauuuccuacauguauugguaccagcagaaaccggggaccucucccaagagauggaucuaugacacaagcaaacucgccuccggagugccugcgcgguucagcggcucuggguccggaaccagcuacucucugacaauuuccaacauggaagcuggcgaugccgccaccuauuacugucaccagcgcgacagcuaucccuggacauuugggggaggcaccaaucuugagaucaagagaacggucgcugccccuucuguguucauuuuucccccuuccgaugaacaacugaaaagcggcaccgcuuccguugugugccuccugaacaauuucuacccgcgggaggccaagguccaguggaagguggacaacgcgcuucagucugggaauagccaggaauccguuacagagcaagauagcaaagacucuaccuacucccugagcucuacacucacccugagcaaggccgauuaugagaaacauaagguguacgcuugugaagucacgcaccagggacuguccucucccgugacaaagagcuuuaaccgcggcgagugc

SEQ ID NO: 38477 - RNA, 768 nt, Artificial Sequence; identical to SEQ ID NO: 38448
  derived and/or modified sequence opt5 from Ensituximab_SingleChain_variable_fragment

SEQ ID NO: 38478 - RNA, 987 nt, Artificial Sequence
  derived and/or modified sequence opt5 from Entolimod_chain1
augagaggcagccaccaucaccaucaccaugggauggccuccaugaccggaggccagcaaauggggcgggaccuguacgaugacgaugacaaggaucccauggcucaggugaucaacacaaauucucucagccugcuuacgcagaacaaucugaacaaaucccagucuagccucuccucugccauugagcgccugagcuccggacuuagaaucaauagcgcgaaggacgaugcugccggccaagccauugcuaaccgguucaccucuaauaucaaagggcugacacaggccucccgcaacgcuaaugacggaauuagcaucgcccagaccacagaaggcgcgcucaacgagaucaauaacaaucugcagagaguccgggaacugucuguucaagccaccaacggcacaaauuccgauagcgaccucaagucuauucaggaugagauccagcagcgccuggaagagauugacagaguguccaaccaaacccaguuuaacggggugaaaguccuuagccaggauaaucaaaugaagauccaggugggagcuaacgacggcgagacgauuaccaucgaccugcagaagauugauguuaaaucccucgggcuggacggauucaaugugaacucuccuggcaucagcgggggaggcggcgggauccuugauuccaugggaacacugauuaaugaagacgccgcugccgcgaagaaaagcaccgccaacccgcucgcuucuaucgauuccgcccugagcaaggucgacgcugugcggucuagccugggcgccauucagaaucgcuuugauuccgccaucacaaaccucgggaauaccguuacgaaccuuaauucugcuagaagccggauugaggacgcggauuaugccacagaaguguccaacaugagcaaagcucaaauccugcagcaggccggaaccucuguccuggcccaggcuaaucaagugccccagaacgugcucucccugcuucgc

SEQ ID NO: 38479 - RNA, 1338 nt, Artificial Sequence
  derived and/or modified sequence opt5 from Epratuzumab_HeavyChain
caggugcaacugguccagagcggcgccgagguuaagaaacccggguccucugugaaggugagcugcaaggcuuccggauacaccuucacaucuuauuggcuccacugggucagacaggccccuggccaggggcuggaauggaucggauacauuaacccgcggaaugacuauacggaguacaaccaaaauuuuaaagauaaagcgaccaucacagcugacgaaagcaccaacacagccuauauggagcuuuccucucugcgcagcgaagauaccgccuucuacuuuugugcuagacgggacauuacaaccuucuauuggggccaggggacgcucgugaccguuuccagcgccucuacaaagggacccuccguguuuccucuggcucccagcucuaaguccaccagcggcggcacagccgcgcuugggugccuggucaaagauuacuucccugagcccgugaccguuucuuggaacuccggagcccucacgagcggcgugcauacauuuccugcuguccugcaguccucugggcuguacagccucuccagcguggugaccgucccgucuuccagccugggaacacagaccuauaucuguaauguuaaucacaagcccucuaacaccaaaguggacaagaaaguggagccuaagagcugcgauaagacacauacgugucccccuugccccgccccggaacuucugggcgggccuuccgucuuccucuuucccccuaaacccaaggacacccugaugauuucucgcacacccgaggugaccuguguuguggucgaugugagccacgaagacccugagguuaaauucaauugguacguggauggagucgaggugcauaacgcuaagacaaaaccgagagaggaacaauauaauuccaccuaccgggucgugagcguucuuacggugcugcaccaggacuggcucaacggcaaggaauauaaaugcaaggucucuaauaaggcccugcccgcgccuaucgagaaaacaaucuccaaggccaaaggccagccccgcgaaccucagguguacacccugcccccgagcagagaugagcucaccaagaaccaaguuucucugacaugucuugugaaaggguuuuauccuuccgacauugcugucgagugggaaagcaauggacagcccgagaacaacuacaagaccacaccucccgugcuggacuccgauggcucuuucuuucucuacagcaagcugacgguggacaaaucccgguggcagcaagggaauguuuucucuugcagcgucaugcacgaagcccuucauaaccacuauacccagaagucccugagccucucuccuggaaaa

SEQ ID NO: 38480 - RNA, 657 nt, Artificial Sequence
  derived and/or modified sequence opt5 from Epratuzumab_LightChain
gacauccagcugacgcaaagccccuccucucucagcgccuccgugggcgauagagucacaaugucuugcaagagcucccagucuguucuguacagcgcuaaccacaaaaauuaucuugccugguaccagcagaagccugggaaagcgccgaagcugcucauuuauugggcuuccacgcgggagagcggagugcccucucgcuucuccggcagcgggucuggaaccgacuuuacauucaccaucuccagccugcaaccugaagauauugccacauacuauugucaucaguaccuuucuuccuggaccuuuggccaggggacaaaaguggagaucaagagaaccgucgccgcucccagcguguucauuuuuccucccuccgacgaacagcugaagucuggaacggccagcguugugugccuccugaacaauuucuauccucgggaggcuaaaguccaauggaagguggauaacgcccugcaguccggcaauagccaggaaucuguuaccgagcaggacuccaaagauagcacauacucucucagcuccacccugacacuuucuaaggcggacuacgagaaacacaagguguaugccugugaagucacccaucaaggccugagcuccccggugaccaagagcuuuaaccgcggggagugc

SEQ ID NO: 38481 - RNA, 762 nt, Artificial Sequence
  derived and/or modified sequence opt5 from Eptacog_beta_HeavyChain1
aucgugggcgggaaggucugccccaagggagaguguccuuggcagguucugcuccuggugaacggcgcccaacuuugcgggggaacccugauuaauacaaucuggguggucagcgcugcccacuguuucgacaagauuaaaaacuggagaaaucucaucgcggugcugggcgaacaugaucuuuccgagcacgacggggaugaacagucucggcgcguugcucaggugauuaucccgagcacguacguccccggaaccacaaaccaugacaucgcccugcucagacugcaccagccugugguucugaccgaucauguggucccccucugccugccugagcggacauuuuccgaacgcacccuugccuucgugagauuuucucuggugagcggcuggggccaacuccuggaccgcggggcuacagcccuugagcugaugguccucaauguuccccggcugaugacccaggauugucugcagcaguccagaaaggugggagacucuccuaacauuacggaguauauguucugcgcuggcuacagcgauggguccaaagacagcuguaagggagauucuggcgggccgcacgccacccacuaucggggaacaugguaccucaccggcaucguguccuggggccaagggugcgcgacagucggacauuuuggcguguauacccgcguuagccaguacauugaauggcugcagaaacuuaugagaucugagccccggccuggggugcugcuccgcgcccccuucccu

SEQ ID NO: 38482 - RNA, 456 nt, Artificial Sequence
  derived and/or modified sequence opt5 from Eptacog_beta_LightChain1
gccaacgcuuuccuggaggaacucagacccggcagccuggagcgggaaugcaaggaggaacaguguuccuuugaggaggcccgcgaaaucuucaaagacgcggagagaaccaagcuguuuuggauuucuuacagcgauggggaccaaugcgcuuccucuccuugucagaauggaggcagcugcaaagaucagcuucaguccuauaucuguuucugccucccggccuuugaagggcggaacugugagacacacaaggacgaucaacugauuugcgugaaugagaacggaggcugugaacaguacugcucugaccauacggggaccaaacgcagcuguagaugccacgagggauauucccuucuggccgauggcgucagcugcacacccaccguugaauacccuuguggcaagauccccauucucgagaagcggaaugcuucuaaaccucaggggcgc

SEQ ID NO: 38483 - RNA, 708 nt, Artificial Sequence
  derived and/or modified sequence opt5 from Erlizuab_HeavyChain1
gaggugcagcuggucgaaagcggcgggggacucguucaacccggcgggucccugagacuuucuugcgccaccagcggauacacauucacggaguauacccacuggcggcaggcuccuggcaaggggcuggaauggguggccggaaucaacccgaaaaauggcggcacaucccauaaccagcgcuuugacagauucaccauuucuguggauaagagcacauccaccgcguaccagaauagccuccgggcugaggacacagccgucuauuacugugcccgcuggagagggcugaacuauggauuugaugugcgguacuucgacguuuggggccaagggacccuugugacggucagcuccgcuagcaccaaaggacccucuguguuuccucuggcccccuccagcaagucuacauccggcgggaccgcugcccucggaugccugguuaaagauuauuucccugaacccgugacagucagcuggaacucuggcgcgcugaccuccggcgugcacacguuuccugccgugcuccagagcuccgggcuguacucucuuagcuccgucguuacagugccgucuucuucccugggaacccagacauacaucuguaaugugaaucauaagcccagcaacaccaaggucgacaaaaagguggagccuaaaucuugcgauaagacccacacaugucccccuugccccgcuccggagcuc

SEQ ID NO: 38484 - RNA, 639 nt, Artificial Sequence
  derived and/or modified sequence opt5 from Erlizuab_LightChain1
gacauccagacccaaagccccuccucucugagcgccuccgugggcgauagagucacaauuacgugccgggcuucucaggacaucaacaauuaccucaacugguaucagcagaagccugggaaagccccgaagcugcuuauuuacuauaccagcacacugcacuccggaguucccucucgcuucagcggcuccgggagcggaaccgauuacacacucaccaucucuucccugcaaccugaggacuuugcgacauauuacugucagcagggcaauacccuucccccuacguucgggcagggaaccaaaguggaaauuaagagaacaguggcugcccccagcgucuuuaucuucccuccgucugaugagcaacugaaauccggcaccgccagcgugguuugccuccugaacaauuuuuauccccgggaagcuaaggugcaguggaaggucgacaacgcccugcagucuggcaauucccaggagagcgugacagaacaagauuccaaagacucuaccuacagccucuccagcacgcugacacuuucuaaggcugauuacgagaaacauaagguuuaugccugugaggugacccaccaggggcuguccagcccugucacaaaaucuuucaaccgcggagaaugc

SEQ ID NO: 38485 - RNA, 1341 nt, Artificial Sequence
  derived and/or modified sequence opt5 from Etaracizumab_HeavyChain1
caggugcaacuggucgagagcggcgggggaguugugcagcccggcagaucccuccggcugucuugcgccgcuagcggguucaccuuuuccucuuacgacaugagcugggugcgccaggccccuggaaagggccuugaaugggucgcgaaaguguccucugggggaggcagcacauauuaccuggauacgguucagggcagauucaccaucucccgggacaacagcaagaauacacucuaucugcaaaugaacucucuucgcgcugaggauaccgccguguacuauugugccagacaucugcacggguccuuugcuagcuggggacagggcacaaccgucacagugucuuccgccagcaccaaagggccgucuguuuucccccucgcuccuuccagcaaguccacgucuggaggcaccgccgcgcuggggugccuggugaaagacuacuuucccgaaccugucacagugagcuggaacuccggagcccucaccagcggcgugcacacauuccccgcuguccugcagucuuccggccuuuauagccugucuagcguugugaccgugccuuccucuagccucgggacgcagacauacauuuguaaugucaaucauaagccguccaacaccaagguggauaaacggguugagcccaagagcugcgacaaaacacacaccuguccucccugcccugcccccgaacugcuuggaggcccgucuguguuucuguucccucccaagccuaaagauacccucaugaucucccgcacacccgaggucacgugugugguuguggacgucagccaugaggaucccgaagugaaguuuaauugguacgucgacgggguggagguucacaacgcuaagaccaaaccuagagaggaacaauauaauucuacauaccggguggucuccgugcugaccguucugcaccaggauuggcucaacggaaaggaguauaaaugcaaggugagcaauaaagcccugccggcgcccauugaaaagacaaucuccaaagccaagggccagccucgcgagccccaggucuacacccuuccucccucuagagaagagaugacgaagaaccaagugagccugacaugucucgugaaaggguucuauccguccgacauugcuguugaaugggagucuaauggacagccugagaacaauuacaagaccacacccccuguccuggauagcgacggcuccuuuuuccuuuauagcaaacugaccguggacaagucucgguggcagcaaggcaacguguuuuccugcagcgucaugcaugaagcccuccacaaccauuacacccagaaaucucugucccugagccccgggaag

SEQ ID NO: 38486 - RNA, 642 nt, Artificial Sequence
  derived and/or modified sequence opt5 from Etaracizumab_LightChain1
gagaucgugcugacccagagccccgccacacucucccugucuccuggcgaaagagcuacgcuuagcugccaagccucccagucuauuagcaacuuccugcacugguaccagcagcggccggggcaagcgccccgccuccugaucagauaucggucccagucuauuagcggaaucccugcucgcuuuuccggcagcgggucuggaaccgacuucacacuuaccauuuccagccuggagcccgaagauuuugccgucuacuauugucagcagucuggcuccuggccucucacauucgggggaggcaccaagguugagaucaaaagaacaguggccgcucccagcguguuuaucuucccuccgucugacgaacaacugaaguccggcaccgccagcgucgugugccugcucaauaacuuuuacccccgggaggcuaaaguucaguggaagguggauaaugcccugcaguccgggaacucucaggagagcgucacggaacaagacuccaaagauagcaccuauucucuuuccagcacacugacccucucuaaggcggacuacgagaagcauaaaguguaugccugugaaguuacacaccagggacugagcuccccugugaccaagucuuucaaucgcggcgagugc

SEQ ID NO: 38487 - RNA, 1326 nt, Artificial Sequence
  derived and/or modified sequence opt5 from Etrolizuab_HeavyChain1
gaggugcagcuggucgaaagcggcgggggacucguucaacccggcgggucccugagacuuucuugcgccgcuagcggauucuuuaucaccaacaauuacuggggcugggugcggcaggccccugggaagggacuggagugggugggcuauauuuccuacucuggcagcacauccuauaacccgucucucaaaagccgcuucacgaucuccagagacaccagcaagaauacauuuuaccugcagaacucucuucgggcggaagauaccgcugucuauuacugugcccgcacaggguccagcggauauuucgacuuuuggggccaggggacccuggugacaguuucuuccgccagcaccaaaggacccucuguguucccucucgcucccuccagcaaguccacgucuggcgggaccgccgcucugggaugccuggucaaagauuacuuuccugagcccgugacaguuagcuggaacuccggcgcccucaccagcggcgugcacacauucccugcgguccugcaaucuuccgggcuuuacagccugucuagcguggugaccgucccguccucuagccucggaacgcagacauauauuuguaauguuaaucauaagcccuccaacaccaagguggacaaaaagguggaaccuaaaagcugcgauaagacacacaccugucccccuugccccgccccggagcugcuuggcgggccuucugucuuucuguuucccccuaaacccaaggacacccucaucuccagaacacccgaggugacguguguuguggucgaugugagccaugaagacccugagguuaaguucaauugguacguggauggagucgaagugcacaacgcuaaaaccaagccgcgggaggagcaguauaauucuacauaccgcgucguguccguucugaccgugcugcaucaggacuggcucaacggcaaagaauauaagugcaaagucagcaauaaggcccugcccgcuccuauugagaaaacaaucuccaaggccaaggggcaacccagagaaccucagguguacacccuucccccgucucgggaggaaacgaaaaaccagguuagccugacaugucucgugaagggauucuauccuuccgauaucgcggucgagugggagucuaauggccagcccgaaaacaacuacaaaaccaccccucccgugcuggacagcgauggcuccuuuuuccuuuacagcaagcugacaguggacaaaucucgcuggcaacaggggaauguuuucuccugcagcguccacgaggcccuccacaaccauuauacccagaagucucugucccugagcccugga

SEQ ID NO: 38488 - RNA, 1326 nt, Artificial Sequence
  derived and/or modified sequence opt5 from Etrolizuab_HeavyChain2
gaggugcagcuggucgaaagcggcgggggacucguucaacccggcgggucccugagacuuucuugcgccgcuagcggauucuuuaucaccaacaauuacuggggcugggugcggcaggccccugggaagggacuggagugggugggcuauauuuccuacucuggcagcacauccuauaacccgucuaaacucagccgcuucacgaucuccagagacaccagcaagaauacauuuuaccugcagaacucucuucgggcggaagauaccgcugucuauuacugugcccgcacaggguccagcggauauuucgacuuuuggggccaggggacccuggugacaguuucuuccgccagcaccaaaggacccucuguguucccucucgcucccuccagcaaguccacgucuggcgggaccgccgcucugggaugccuggucaaagauuacuuuccugagcccgugacaguuagcuggaacuccggcgcccucaccagcggcgugcacacauucccugcgguccugcaaucuuccgggcuuuacagccugucuagcguggugaccgucccguccucuagccucggaacgcagacauauauuuguaauguuaaucauaagcccuccaacaccaagguggacaaaaagguggaaccuaaaagcugcgauaagacacacaccugucccccuugccccgccccggagcugcuuggcgggccuucugucuuucuguuucccccuaaacccaaggacacccucaucuccagaacacccgaggugacguguguuguggucgaugugagccaugaagacccugagguuaaguucaauugguacguggauggagucgaagugcacaacgcuaaaaccaagccgcgggaggagcaguauaauucuacauaccgcgucguguccguucugaccgugcugcaucaggacuggcucaacggcaaagaauauaagugcaaagucagcaauaaggcccugcccgcuccuauugagaaaacaaucuccaaggccaaggggcaacccagagaaccucagguguacacccuucccccgucucgggaggaaacgaaaaaccagguuagccugacaugucucgugaagggauucuauccuuccgauaucgcggucgagugggagucuaauggccagcccgaaaacaacuacaaaaccaccccucccgugcuggacagcgauggcuccuuuuuccuuuacagcaagcugacaguggacaaaucucgcuggcaacaggggaauguuuucuccugcagcguccacgaggcccuccacaaccauuauacccagaagucucugucccugagcccugga

SEQ ID NO: 38489 - RNA, 639 nt, Artificial Sequence
  derived and/or modified sequence opt5 from Etrolizuab_LightChain1
gacauccagacccaaagccccuccucucugagcgccuccgugggcgauagagucacaauuacgugccgggcuucugagagcguugacgaucuccugcacugguaccagcagaagccugggaaagccccgaaacuucugaucaaguaugcgucccagucuauuagcggagugcccucccgcuucagcggcucuggguccggaaccgacuuuacacucaccaucagcucucugcaaccugaagauuucgcuacauacuauugucagcagggcaacucccuucccaauaccuuugggcagggaacaaagguggagauuaaaagaaccgucgccgccccuagcguguucaucuuucccccuucugacgaacaacugaaguccggcacggcuagcguugugugccuccugaacaauuucuacccgcgggaggccaagguccaguggaaaguggauaacgcucugcaguccggcaauucucaggaaagcguuaccgagcaagacuccaaggauagcacauauucucucuccagcacccugacacuuucuaaagccgacuacgagaagcauaaaguguaugcgugugaagucacccaccaggggcugagcucccccgugacgaagucuuuuaaccgcggagagugc

SEQ ID NO: 38490 - RNA, 1338 nt, Artificial Sequence
  derived and/or modified sequence opt5 from Etrolizumab_HeavyChain1
gaggugcagcuggucgaaagcggcgggggacucguucaacccggcgggucccugagacuuucuugcgccgcuagcggauucuuuaucaccaacaauuacuggggcugggugcggcaggccccugggaagggacuggagugggugggcuauauuuccuacucuggcagcacauccuauaacccgucucucaaaagccgcuucacgaucuccagagacaccagcaagaauacauuuuaccugcagaugaacucucuucgggcggaagauaccgcugucuauuacugugcccgcacaggguccagcggauauuucgacuuuuggggccaggggacccuggugacaguuucuuccgccagcaccaaaggacccucuguguucccucucgcucccuccagcaaguccacgucuggcgggaccgccgcucugggaugccuggucaaagauuacuuuccugagcccgugacaguuagcuggaacuccggcgcccucaccagcggcgugcacacauucccugcgguccugcaaucuuccgggcuuuacagccugucuagcguggugaccgucccguccucuagccucggaacgcagacauauauuuguaauguuaaucauaagcccuccaacaccaagguggacaaaaagguggaaccuaaaagcugcgauaagacacacaccugucccccuugccccgccccggagcugcuuggcgggccuucugucuuucuguuucccccuaaacccaaggacacccucaugaucuccagaacacccgaggugacguguguuguggucgaugugagccaugaagacccugagguuaaguucaauugguacguggauggagucgaagugcacaacgcuaaaaccaagccgcgggaggagcaguauaauucuacauaccgcgucguguccguucugaccgugcugcaucaggacuggcucaacggcaaagaauauaagugcaaagucagcaauaaggcccugcccgcuccuauugagaaaacaaucuccaaggccaaggggcaacccagagaaccucagguguacacccuucccccgucucgggaggaaaugacgaaaaaccagguuagccugacaugucucgugaagggauucuauccuuccgauaucgcggucgagugggagucuaauggccagcccgaaaacaacuacaaaaccaccccucccgugcuggacagcgauggcuccuuuuuccuuuacagcaagcugacaguggacaaaucucgcuggcaacaggggaauguuuucuccugcagcgucaugcacgaggcccuccacaaccauuauacccagaagucucugucccugagcccugga

SEQ ID NO: 38491 - RNA, 642 nt, Artificial Sequence
  derived and/or modified sequence opt5 from Etrolizumab_LightChain1
gacauccagaugacccaaagccccuccucucugagcgccuccgugggcgauagagucacaauuacgugccgggcuucugagagcguugacgaucuccugcacugguaccagcagaagccugggaaagccccgaaacuucugaucaaguaugcgucccagucuauuagcggagugcccucccgcuucagcggcucuggguccggaaccgacuuuacacucaccaucagcucucugcaaccugaagauuucgcuacauacuauugucagcagggcaacucccuucccaauaccuuugggcagggaacaaagguggagauuaaaagaaccgucgccgccccuagcguguucaucuuucccccuucugacgaacaacugaaguccggcacggcuagcguugugugccuccugaacaauuucuacccgcgggaggccaagguccaguggaaaguggauaacgcucugcaguccggcaauucucaggaaagcguuaccgagcaagacuccaaggauagcacauauucucucuccagcacccugacacuuucuaaagccgacuacgagaagcauaaaguguaugcgugugaagucacccaccaggggcugagcucccccgugacgaagucuuuuaaccgcggagagugc

SEQ ID NO: 38492 - RNA, 1359 nt, Artificial Sequence
  derived and/or modified sequence opt5 from Evinacumab_HeavyChain1
gaggugcagcuggucgaaagcggcgggggaguuauccaacccggcgggucccucagacugucuugcgccgcuagcggauucaccuuugacgauuacgccaugaacugggugcggcagggcccugggaagggacuugaguggguguccgcgauuucuggcgacggcgggagcacauauuacgcugauuccgucaaaggacgcuucacgaucucuagagacaauagcaagaacucccuguaucuccagaugaauagccugcgggccgaagauaccgccuuuuucuacugugcuaaagaccuucgcaacacaauuuuuggcgugguuaucccggaugccuucgacauuugggggcagggaaccauggugacagucucuuccgcuagcaccaagggccccucuguguuuccucuggcccccugcuccagaagcacaucugaguccaccgcggcccucgggugucugguuaaagauuauuucccugaacccgugacggucagcuggaauagcggagcucugaccucuggcgugcacacauuuccugccgugcuccaaagcuccggccuguacagccuuucuuccgucguuaccgugccgagcucuagccuggggacaaagaccuauacgugcaacguggaccauaagcccuccaauacaaaagucgauaagcggguggagucuaaauacggaccucccuguccucccugcccggcuccugaguuccucggcgggcccagcguuuuucuguucccucccaagcccaaagacacccuuaugaucucccgcacaccugaagugaccugugucgugguugaugugagccaggaggacccggaaguccaguuuaacugguacguggacggagucgaggugcacaaugccaagaccaagcccagagaggaacaguucaacucuacauaucggguuguguccguccugacggugcuccaucaagauuggcugaauggcaaagaguacaagugcaaaguuagcaacaaggggcugccuucuuccaucgagaaaaccauuagcaaggcgaaaggacagccccgcgaaccucagguguauacacuucccccgucccaggaagagaugaccaagaaucaagucucucugacaugucuugugaagggcuucuacccuagcgacaucgccguggagugggaauccaacggccagcccgagaauaacuauaaaaccacgccucccguucuggauucugacgggagcuuuuuccucuacuccagacugacagucgauaagagccgguggcaggaaggaaacguguuuucuugcuccgugaugcacgaggcucuccauaaucacuauacccaaaaaucccugucucucucccugggcaag

SEQ ID NO: 38493 - RNA, 642 nt, Artificial Sequence
  derived and/or modified sequence opt5 from Evinacumab_LightChain1
gacauccagaugacccaaagccccuccacacugucugccagcgugggcgauagagucacgauuaccugccgggcuucccagucuauccgcagcuggcucgccugguaccagcagaagccugggaaagcgccgaagcugcuuauuuauaaggcuuccucucuggagagcggaguucccuccagauucagcggcucuggguccggaacagaauuuacccucacaaucagcucucugcaaccugacgauuucgccaccuacuauugucagcaguacaacuccuauagcuacacauuuggccaggggaccaaacuugagauuaaacggacgguggccgcucccucuguguucaucuuuccucccuccgacgaacaacucaagagcggaaccgccuccgucgugugccugcugaauaacuucuauccucgcgaggcuaagguucaguggaaaguggauaaugcccugcagucuggcaacagccaggaauccgucacagagcaagacagcaaggauucuaccuacucccucagcucuacacugacccuuagcaaagcggacuacgagaagcacaaaguguaugccugugaaguuacgcaucagggccuguccucuccggugacaaagagcuuuaauagaggggagugc

SEQ ID NO: 38494 - RNA, 1323 nt, Artificial Sequence
  derived and/or modified sequence opt5 from Evolocumab_HeavyChain1
gaggugcagcugguccagagcggcgccgaaguuaagaaacccggggcuuccgugaaggugucuugcaaagccagcggauacacccucacauccuauggcaucucuugggucagacaggcgccugggcagggacuggaguggaugggcugggugagcuucuacaacgggaauacgaacuaugcucagaaacuucaaggacggggcaccaugacaaccgacccguccacaucuaccgccuacauggaacugcgcagccucagauccgaugacacagccguuuauuacugugcucggggcuaugggauggauguguggggacagggcaccacggucaccgugagcucugccuccacaaaagggcccagcguuuuuccucuggcucccugcucucgcuccaccagcgagucuacagccgcgcuuggaugucuggugaaggacuacuucccugaacccgucaccguguccuggaauagcggcgcccucacguccggggugcacacauuuccugcuguccugcagucuagcggacuguacucccucagcucuguugugaccgugccguccagcaacuucggcacacagaccuauaccugcaaugucgaucauaagcccucuaacacaaaaguggacaagacgguugagagaaaauguugcguggaguguccucccugcccugcucccccggucgccggcccuagcguguuucuguuucccccuaagcccaaagauacccuuaugauuucccggacacccgaaguuaccuguguggucguggacgucucucacgaggauccugaagugcaauucaauugguacguugacgggguggagguccauaacgccaagacaaagccgcgcgaggaacaguucaauagcaccuuuagagugguuuccgugcugacggucgugcaccaggauuggcucaacggaaaagaguauaagugcaaagugagcaauaagggccugcccgcgccuaucgaaaagacaauuucuaagaccaaagggcagccccgggagccucaaguuuacacccuucccccgucccgcgaagagaugacaaagaaccaggucagccugaccugucucgugaagggauucuauccuucugacaucgccguggagugggaauccaauggccagcccgagaacaauuacaaaacaacgccucccaugcuggauagcgacggguccuuuuuccuguauucuaagcucaccgucgacaaaagcagauggcaacagggaaacguguuuuccugcucuguuaugcaugaagcucugcacaaccacuacacacaaaagagccuuucccugagcccuggcaaa

SEQ ID NO: 38495 - RNA, 645 nt, Artificial Sequence
  derived and/or modified sequence opt5 from Evolocumab_LightChain1
gagagcgcccugacccagcccgcuuccgugucuggcagcccugggcaauccaucacaauuucuugcacgggaaccagcuccgacgucggcggguacaacucuguuagcugguaucagcagcacccgggaaaggcccccaaacucaugaucuacgaaguguccaauagaccuagcggcgugucuaaccgguucuccgggagcaagucuggaaauacagcgucccugaccauuagcggccuucaggcugaggaugaagccgacuauuacuguaacucuuauacauccaccagcauggucuuuggcgggggaacaaaacugaccgugcucggccaacccaaggccgcuccuuccguuacgcuguuucccccuucuagcgaggaacuucaggccaauaaagcuacccuggugugccucaucuccgauuucuacccgggggccgucacaguggcguggaaggccgacagcucucccguuaaggcuggaguggagaccacaaccccuuccaaacagagcaacaauaaguaugccgcuucuagcuaccugucccugacgcccgagcaguggaaaucucaucgcagcuacuccugucaagucacacacgaaggcagcaccguggagaagacaguggccccuaccgaaugcucu

SEQ ID NO: 38496 - RNA, 1353 nt, Artificial Sequence
  derived and/or modified sequence opt5 from Exbivirumab_HeavyChain1
caggugcaacuggucgagagcggcgggggaguugugcagcccggcgggucccucagacugucuugcgccccuagcggauucguguuucgguccuacggcaugcacuggguccgccagaccccggggaagggacuugaaugggugucucugaucuggcaugacggcagcaacagauucuaugcugauuccguuaaaggccgguuuacaauuucucgcgacaauagcaagaacacgcucuaccugcagaugaauagccuuagagccgaggauaccgcgauguauuucugugcucgggaacgccugaucgccgcccccgcugccuuugaccucugggggcaaggaacacuggugaccgucagcucugcuuccacaaaaggcccuagcguguucccccuggccccuucuuccaagagcaccucugggggaacagcggcccucggcugccugguuaaagauuacuuucccgagccugugaccgucuccuggaacagcggggcucuuacguccggagugcacaccuucccggccgugcugcagucuagcggccucuauucccugagcucugucguuacagugcccuccagcucucuuggcacccagacauacauuuguaaugugaaccauaagccuagcaauaccaaggucgacaaaagaguggaacccaaguccugcgauaaaacgcacacauguccucccugcccggcuccugagcugcucgggggacccucuguuuuucuguucccucccaagcccaaagacacccugaugaucagccggacaccugaggugaccugugucgugguugaugugucccaugaagacccggaggucaaguuuaacugguauguggauggcgucgaagugcacaaugccaagaccaaaccccgcgaggagcaguacaacagcacauacagaguugugucuguccucacggugcugcaccaagacuggcuuaaugggaaggaauauaaaugcaagguuuccaacaaagcgcugccugcccccauugagaagaccaucagcaaagcuaagggacagccucgggaaccccagguguacacacucccgccuucucgcgaggaaaugaccaagaaucaggucucccugacaugucuugugaaaggcuucuaucccagcgauaucgccguggagugggaguccaacgggcaaccugaaaauaacuacaagaccacgcccccuguucuggacucugacggcagcuuuuuccucuauuccaaacugacagucgauaagucuagauggcagcagggaaacguguucagcugcuccgugaugcaugaggcucugcacaaucauuacacccaaaaaucccucucucugucccccggcaag

SEQ ID NO: 38497 - RNA, 642 nt, Artificial Sequence
  derived and/or modified sequence opt5 from Exbivirumab_LightChain1
agcuacgugcugacccagcccccuuccgucucuguugccccgggcaagacagcuagaaucagcugcgggggaaacaauauuggcacgaaaaacgugcacugguaucaacagaagcccgggcaggccccugugcucgucguguacgcggacuccgaucggcccucuggaaucccugagcgcuucagcggcuccaauucugggaacaccgcuacacugaccauuagcagaguugaagccggagacgaggccgauuauuacugucaggugugggacuccgucagcuaucaugugguuuuuggcggcgggacaacccuuacagugcugggacaacccaaagcugccccuucugucacccucuucccgcccuccagcgaggaacugcaggcuaauaaggccacgcuugugugccugaucucugauuuuuacccuggcgcggugaccgucgccuggaaagcugacuccagccccguuaaggccgggguggaaacaaccacaccuucuaagcaguccaacaauaaauaugcugccagcuccuaccucucucugacccccgagcaguggaaaagccaccgguccuacagcugucaagugacgcaugagggaucuacagucgaaaagaccguggcgccgacagagugcucc

SEQ ID NO: 38498 - RNA, 1347 nt, Artificial Sequence
  derived and/or modified sequence opt5 from Farletuzumab_HeavyChain1
gaggugcagcuggucgaaagcggcgggggaguugugcaacccggcagaucccuccggcugucuugcagcgccuccggguucaccuuuucuggauacggccuuagcugggugcgccaggcuccugggaagggacuggagugggucgccaugaucuccucuggcggcagcuauacauacuaugcggacuccgugaaagggagauucgcuauuagccgggauaacgccaagaauacgcucuuucugcagauggacucucuucgcccggaagauaccggaguuuacuucugugccagacacggcgacgaucccgcuugguuugccuauugggggcagggaacaccugugaccgucuccagcgcuucuacaaaaggccccuccguguucccucuggcccccagcucuaaguccaccagcgggggaacagcggcccucggcugccugguuaaagacuacuuuccugagccggugaccgucuccuggaacucuggcgcucugacgagcggggugcauaccuuccccgccgugcuccaauccagcggacuguauucucuuuccagcgucguuacagugccuucuagcucccugggcacccagacauacaucuguaaugugaaccacaagcccucuaauaccaaggucgauaaaaagguggaaccuaaaagcugcgacaagacgcauacaugucccccgugcccugcucccgagcuccuugggggaccuuccguuuuucuguucccgcccaaaccuaaggauacccugaugauuagccggacaccggaggugaccugugucgugguugacgugucucacgaagaucccgaggucaaguuuaacugguacguggacggcgucgaagugcauaaugccaaaaccaagccucgcgaggagcaguauaacuccacauacagaguugugagcguccucacggugcugcaccaggauuggcugaaugggaaagaauauaagugcaaaguuucuaacaaggcgcuccccgccccuaucgagaaaaccauuuccaaggcuaagggacaaccccgggaaccccagguguacacacugccucccagccgcgacgagcuuaccaaaaaucaggucucccugacaugucucgugaagggcuucuauccuucugacaucgccguggaaugggagagcaacggccagcccgagaauaacuacaaaaccacgccucccguucuggauuccgacgggagcuuuuuccuuuauucuaagcugacagucgauaaauccagauggcaacagggaaauguguucagcugcucugugaugcacgaagcucuccauaaccacuacacccagaagucccugagccugucuccgggcaag

SEQ ID NO: 38499 - RNA, 651 nt, Artificial Sequence
  derived and/or modified sequence opt5 from Farletuzumab_LightChain1
gacauccagcugacccaaagccccuccucucucagcgccuccgugggcgauagagucacaauuacgugcucuguuagcuccucuaucagcuccaacaaucugcacugguaccagcagaagccugggaaagcuccgaagcccuggauuuauggaaccagcaaccuugccucuggcgugccuucccgguucagcgggucuggauccggcacagacuacaccuuuacaaucagcucucugcagcccgaggauauugcgaccuauuacugucaacagugguccagcuauccuuacauguauacauucgggcagggaaccaaaguggaaaucaagcgcacggucgcugcccccuccguguuuaucuucccuccgucugacgagcagcucaaaagcggcaccgccuccguugugugccugcuuaauaacuuuuaccccagagaagcuaagguccaauggaagguggauaaugcccugcagagcggcaacucucaggaguccguuacagaacaggacagcaaagauucuaccuacagccucuccucuacacugacccugagcaaggcugacuaugagaaacauaagguguacgccugugaggucacgcaccaagggcucuccagcccugugacaaaaucuuucaaucggggagaaugc

SEQ ID NO: 38500 - RNA, 1338 nt, Artificial Sequence
  derived and/or modified sequence opt5 from Fasinumab_HeavyChain1
caggugcaacugguccagagcggcgccgagguuaagaaacccggggcuuccgugaaggugucuugcaaagucagcggauucacccucacagaacuguccauccacugggugagacaggccccuggcaaggggcuugaguggaugggaggcuuugacccggaagauggggagacgauuuacgcgcagaaauuccaaggacggguuaccaugacagaagacaccucuacagauaccgcuuauauggagcugacaagccuccgcuccgaggacaccgccguguacuauuguucuacgaucuuuggcgucgugaccaacuucgauaauuggggccaggggacacugguuaccgugagcuccgccagcacaaagggacccucugucuuuccucuugcucccugcuccagaagcaccucugaauccacggccgcucugggcugucucgugaaggacuacuucccugagcccgugacagucagcuggaacucuggggcccugaccuccggaguucauacauuuccugcggugcugcagagcuccggccucuauucucugagcuccguggucaccgugccgucuagcucccuugggaccaaaacauacacgugcaauguugaucacaagcccagcaacaccaaaguggacaagcgggucgaaucuaaauauggaccucccuguccucccugcccggccccugaguuccugggcggccccagcguguuucucuucccucccaagcccaaggauacacugaugauuucccgcaccccugagguuacauguguggucguggacgucucucaggaagauccggaggugcaauuuaauugguacguugacgggguggaaguccauaacgcuaaaaccaagcccagagaggaacaguucaauagcacguaccgggugguuuccgugcuuacaguccugcaccaggauuggcucaacggaaaagaguauaagugcaaagugagcaauaagggccugccuucuuccaucgagaaaaccauuagcaaggccaaggggcagccccgcgaaccucaaguguacacccugcccccgucucaggaggaaaugaccaaaaaccagguuucccucacaugucuggucaagggauuuuauccuagcgacaucgcuguggagugggaauccaauggccaacccgagaacaauuacaaaacaacgccucccgugcuugacucugaugggagcuucuuccuguauuccagacucaccgucgacaagucucgguggcaggagggaaacguguuuagcugcuccguuaugcaugaagcccugcacaaucacuacacacagaaaagccuuucucugucccucggcaag

SEQ ID NO: 38501 - RNA, 642 nt, Artificial Sequence
  derived and/or modified sequence opt5 from Fasinumab_LightChain1
gacauccagaugacccaaagccccuccucucugagcgccuccgcuggcgauagagugacaauuacgugccgggccucucaggcgauccgcaacgaccucgggugguaccagcagaagccuggaaaagcuccgaagagacugauuuaugccgccuucaaucuucaaagcggcguccccucccgguuuucugggagcggauccggcaccgaguucacacugaccaucagcucucuccagccugaagaucuggcuuccuacuauugucagcaguacaaccgcuaucccuggacauuugggcaaggaaccaaaguugagauuaagagaacaguggccgcuccuagcguguucaucuuucccccuucugacgaacagcuuaaauccggcaccgccagcgucgugugccugcucaauaacuucuacccgcgggaggcgaagguucaguggaagguggauaaugcccugcagucuggcaacucccaagaaagcgucacggagcaggacuccaaagauucuaccuauagccuguccagcacacucacccugucuaaggcugacuacgagaaacacaagguguacgccugugaaguuacacaucaggggcuuuccagccccgugaccaaaucuuuuaaucgcggagagugc

SEQ ID NO: 38502 - RNA, 1350 nt, Artificial Sequence
  derived and/or modified sequence opt5 from Fezakinumab_HeavyChain1
caggugcaacugguccagagcggcgccgagguuaagaaacccggggcuuccgugaaggugucuugcaaagccagcggauacaccuucacaaacuauuacaugcacugggucagacaggcgccuggccaggggcucgaaugggugggauggaucaauccguauacgggcuccgcuuuuuacgcccaaaaguuccgggggcgcguuaccaugacaagagacaccucuauuagcacagccuauauggagcugucccggcuucgcucugaugacaccgcuguguacuauugugccagagaacccgagaaauuugauagcgacgauuccgacgucuggggacggggcacacuggugaccguuagcucugcuuccacgaagggcccuagcguguucccccucgccccuucuuccaagagcaccucugggggaacagcggcccugggcugccuugucaaagauuacuuucccgaaccugugaccguguccuggaacagcggggcucugacauccggaguccauaccuucccggccguucuccagucuagcggccuguacucccugagcucuguggugacgguccccuccagcucucucgggacacagaccuauaucuguaaugugaaccacaagccuagcaauacaaaaguugacaagaaaguggagcccaaguccugcgauaagacccauaccuguccucccugcccggcuccugagcugcuuggaggccccucugucuuucuguucccucccaaacccaaggacacacucaugauuagccgcacgccugaagugaccuguguuguggucgaugugucccacgaggacccggaagucaaauuuaacugguacguggauggcguugaggugcauaaugccaagacaaaacccagagaggaacaguauaacagcaccuaccgggucgugucuguucugacagugcuucaccaagacuggcugaaugggaaggaguauaaaugcaaggucuccaacaaggcgcucccugcccccaucgagaaaaccauuagcaaggcuaaaggacagccucgcgaaccccagguguacacgcugccgccuucuagagaagagaugacaaagaaucaggugucccugaccugucucguuaaaggcuucuaucccagcgacaucgccgucgagugggaauccaacgggcaaccugagaauaacuacaagaccacacccccugugcuggauucugacggcagcuuuuuccuuuacuccaagcugaccguggauaaaucucgguggcagcagggaaaugucuuuagcugcuccgugaugcacgaagcucuccauaaccacuauacacaaaagagccugucucuuucccccggg

SEQ ID NO: 38503 - RNA, 651 nt, Artificial Sequence
  derived and/or modified sequence opt5 from Fezakinumab_LightChain1
caggccgugcugacccaacccccuagcgucuccggcgcuccggggcagagaguuacaaucucuugcacgggaagcuccucuaacauuggcgccggguacggagugcacugguaucagcagcuccccggcaccgcgccuaagcugcuuaucuacggggacagcaaucggcccuccggagugccugaucgcuucucuggcagcaaauccggcacaagcgcuucucuggccauuaccgggcuccaagccgaggacgaagcugauuauuacugucaguccuaugacaacagccugucuggauacgucuuuggcgggggaacacagcuuaccgugcugggccagcccaaggccgcuccuuccguuacacucuucccgcccagcucugaggaacugcaagccaauaaagcgacccuggugugccucaucuccgauuuuuauccuggggccgucacgguggcuuggaaggccgacagcucccccguuaaagcuggaguggagaccacaaccccuucuaagcagagcaacaauaaguacgccgcguccagcuaccugucucuuacacccgaacaguggaaaucccauagaagcuauucuugucaggucacccacgagggcagcacgguggagaagacaguggccccgaccgaaugcucc

SEQ ID NO: 38504 - RNA, 1347 nt, Artificial Sequence
  derived and/or modified sequence opt5 from FG-3019_HeavyChain1
gagggccagcuggugcaaagcgggggaggccucguccaccccgggggaucccugagacuuucuugcgccggcagcggguucaccuuuuccucuuacggaaugcauuggguucggcaggcuccuggcaagggccuggaaugggugagcgggaucggaacaggcgggggaacguauuccaccgacucugugaaaggccgcuucacaauuagcagagauaacgccaaaaauucccucuaccugcagaugaacagccuucgggcggaggacauggcugucuauuacugugcccgcggggauuauuacggaucuggcuccuuuuucgacugcuggggccaggggacccuggugacaguuagcucugccuccaccaagggaccgagcguguuuccccucgcuccuucuuccaagagcacauccggcgggaccgccgcucugggaugucuggucaaagauuauuuccccgaaccugugacgguuucuuggaauagcggcgcccucaccuccggggugcacacauuucccgcgguccugcaaagcucuggacuuuacucccugagcucuguggugaccgucccuagcuccucucucggcacacagaccuacaucugcaacguuaaucauaagccgagcaacacgaagguggacaaaagaguggagcccaaguccugugauaaaacacauaccugcccucccuguccugcccccgaacugcuuggcgggccgagcgucuuccuguuuccucccaagccuaaagacacacucaugauuucucggacccccgaggugaccugcguuguggucgaugugucccacgaggaccccgaaguuaaguucaauugguauguggauggagucgaggugcacaacgcuaagacaaaaccucgcgaggaacaguacaauagcacguauagagucgugucuguucugaccgugcugcaccaggacuggcucaacggcaaggaguacaaauguaaggucuccaauaaagcccugccggcucccaucgaaaagacaauuagcaaagccaaggggcaaccucgggagccccagguguauacccuuccucccucccgcgaagagaugacaaagaaccagguuucucugaccugccucgugaaaggauuuuacccgagcgauaucgcggucgaaugggaguccaauggccagccugagaacaauuauaagacgacacccccugugcuggacucugacgggagcuucuuucuuuacuccaaacugaccguggauaagagcagauggcaacagggcaacguuuucucuuguuccgucaugcaugaagcccuccacaaccauuacacccagaaaagccugucucugucccccgga

SEQ ID NO: 38505 - RNA, 642 nt, Artificial Sequence
  derived and/or modified sequence opt5 from FG-3019_LightChain1
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccccuaccuuuggccaagggacaaaacuggagauuaagagaaccguggcugcccccuccguguucaucuuuccuccgagcgacgaacagcuuaaauccggaacggcuucugucgugugccugcucaauaacuucuacccccgggaggccaagguucaguggaagguggauaaugcgcugcagagcggcaacucccaagaaagcgucaccgagcaggacucuaaagauuccacauauagccugucuagcacccucacacuguccaaggccgacuacgagaaacacaagguguacgcuugugaaguuacccaucagggccuuucuagcccugugacgaaauccuuuaaucgcggggagugc

SEQ ID NO: 38506 - RNA, 1344 nt, Artificial Sequence
  derived and/or modified sequence opt5 from Fibatuzumab_HeavyChain1
caggugcaacugguccagagcggcgccgagguuaagaaacccggggcuuccgugaaggugucuugcaaagccagcggauacaccuucacaggcuauuggaugaacugggucagacaggcgccugggcagggacucgaauggaugggcgacaucuacccgggguccggaaauacgaacuaugaugagaaguuucaaggccgggugaccaugacacgcgacaccucuauuagcacagcuuacauggaacuguccagacuucggucugaugacaccgccguuuauuacugugcccgcggcggguauuacgaggauuucgacagcuggggacagggcacaaccgugacggucuccagcgcuucuaccaaagggcccuccguguuuccucuggcccccagcucuaaguccacaagcggaggcaccgcugcccucgggugccugguuaaggauuacuucccugaacccgugacagucucuuggaacuccggagcgcuuaccagcggcgugcacacguuuccugccgugcugcaguccucuggccucuauagccuguccagcgucguuacagugccgucuuccagccuggggacccagacauacaucuguaaugugaaucauaaacccucuaacaccaaggucgacaaaagaguggagccuaagagcugcgauaaaacccacacaugucccccuugccccgcuccggagcuccugggaggcccuuccguuuuccuuuuucccccuaagcccaaggacacgcugaugauuucucggacccccgaagugacaugugucgugguugaugugagccaugaggacccugaagucaaauucaauugguauguggauggggucgaggugcacaacgccaagaccaaaccgcgcgaggaacaauacaauuccacauauagaguugugagcguccucaccgugcugcaucaggacuggcuuaacggaaaggaguacaaaugcaagguuucuaauaaagcucugcccgccccuaucgaaaagacgauuuccaaggcgaaaggccagccccgggagccucagguguauacacugcccccgagccgcgaagagaugaccaagaaccaagucucucucaccugucuggugaaaggguuuuacccuuccgacaucgccguggagugggaaagcaauggacagcccgagaacaauuacaagacaaccccucccguucucgauuccgacggcucuuucuuucuguauagcaaacuuacagucgauaaguccagauggcagcaaggcaacguguucucuugcagcgugaugcacgaagcucugcacaaccauuacacgcagaagucccucagccugucuccugggaaa

SEQ ID NO: 38507 - RNA, 642 nt, Artificial Sequence
  derived and/or modified sequence opt5 from Fibatuzumab_LightChain1
gacauccagaugacccaaagccccagcuuccugucugccagcgugggcgauagagucacaauuacgugccgggcuucccaggggaucauuucuuaccucgccugguaucagcagaagccugagaaagcgccgaagcgccugaucuacgcugccagcucccuucaaucuggaguucccagcagauuuuccggcagcgggucuggaaccgaguucacacugaccauuuccagccuccagccugaagacuuugccacauauuacuguggccaguaugcuaacuaccccuauaccuucgggcagggaacaaaacuggaaaucaagcggaccguggccgcuccuucuguguuuaucuuucccccuuccgaugagcaacuuaaaagcggcacggccucugucgugugccugcucaauaacuucuacccgcgcgaagcgaagguucaguggaagguggacaaugcccugcaguccggcaacagccaggaguccgucaccgagcaagauucuaaagacagcacauacucccugagcucuacccucacacuguccaaggcugauuaugaaaaacacaagguguacgccugugagguuacccaucaggggcuuagcucucccgugacgaaauccuucaauagaggagaaugc

SEQ ID NO: 38508 - RNA, 1344 nt, Artificial Sequence
  derived and/or modified sequence opt5 from Ficlatuzumab_HeavyChain1
caggugcaacugguccagcccggcgccgagguuaagaaaccugggaccagcgugaagcucuccugcaaagcuagcggauacacauucacgaccuauuggaugcacugggugagacaggccccgggccaggggcuggaauggaucggagagauuaaccccacaaauggccauaccaacuacaaucaaaaguuucaggggcgggcgacacuuaccgucgacaaaagcacauccaccgcuuauauggaacugucuagccuccgcuccgaggauacggccguguacuauugugccagaaacuacguuggaucuaucuucgacuauuggggccagggcacccugcuuacagugagcuccgcuagcaccaaggggccuucugucuuuccccuggccccuuccagcaagucuacauccggaggcaccgcugcccucgggugccuggugaaagauuacuuccccgaaccuguuacggugagcuggaacucuggagcgcugacauccggcguccacaccuuuccggccgugcuccagagcuccgggcuguacucucuuagcuccguggucacaguucccucuucuucccugggaacccaaaccuauauuuguaaugugaaucauaagccuagcaacacaaaaguggacaagcgggucgagcccaaaucuugcgauaagacgcacaccuguccucccugcccggcuccugagcuccugggcggccccagcguguuccuuuuuccucccaagcccaaagacacacugaugaucucccgcaccccugaaguuacauguguggucguggauguuucucaugaggacccggaagugaaguucaauugguacgucgaugggguggagguccacaacgccaaaaccaagcccagagaggaacaguauaauagcacguaccgggugguuuccgugcucacaguccugcaccaggacuggcugaacggaaaagaguauaagugcaaagugagcaauaaggcucucccugcccccauugaaaagaccaucucuaaagcgaagggccagccucgcgagccccaaguuuacacccugccgccuuccagagaagagaugacaaagaaccaggugagccuuaccugucuggucaagggguuuuaucccucugauaucgccguggagugggaauccaauggacagccugagaacaacuacaaaacaacgcccccugugcucgacagcgauggcuccuucuuucuguacucuaaacuuaccguugacaagagccgguggcaacaggggaaugucuucuccugcucugugaugcaugaagcucugcacaaccauuauacacagaaaagccucucccugagccccggaaag

SEQ ID NO: 38509 - RNA, 1341 nt, Artificial Sequence
  derived and/or modified sequence opt5 from Ficlatuzumab_HeavyChain
gugcagcugguccaacccggcgccgagguuaagaaaccugggaccagcgugaagcucuccugcaaagcuagcggauacacauucacgaccuauuggaugcacugggugagacaggccccgggccaggggcuggaauggaucggagagauuaaccccacaaauggccauaccaacuacaaucagaaguuucaagggcgggcgacacuuaccgucgacaaaagcacauccaccgcuuauauggaacugucuagccuccgcuccgaggauacggccguguacuauugugccagaaacuacguuggaucuaucuucgacuauuggggccagggcacccugcuuacagugagcuccgcuagcaccaaggggccuucugucuuuccccuggccccuuccagcaagucuacauccggaggcaccgcugcccucgggugccuggugaaagauuacuuccccgaaccuguuacggugagcuggaacucuggagcgcugacauccggcguccacaccuuuccggccgugcuccagagcuccgggcuguacucucuuagcuccguggucacaguucccucuucuucccugggaacccagaccuauauuuguaaugugaaucauaagccuagcaacacaaaaguggacaagcgggucgagcccaaaucuugcgauaagacgcacaccuguccucccugcccggcuccugagcuccugggcggccccagcguguuccuuuuuccucccaagcccaaagacacacugaugaucucccgcaccccugaaguuacauguguggucguggauguuucucaugaggacccggaagugaaguucaauugguacgucgaugggguggagguccacaacgccaaaaccaagcccagagaggaacaauauaauagcacguaccgggugguuuccgugcucacaguccugcaccaggacuggcugaacggaaaagaguauaagugcaaagugagcaauaaggcucucccugcccccauugaaaagaccaucucuaaagcgaagggccagccucgcgagccccagguuuacacccugccgccuuccagagaagagaugacaaagaaccaagugagccuuaccugucuggucaagggguuuuaucccucugauaucgccguggagugggaauccaauggacagccugagaacaacuacaaaacaacgcccccugugcucgacagcgauggcuccuucuuucuguacucuaaacuuaccguugacaagagccgguggcagcaagggaaugucuucuccugcucugugaugcaugaagcucugcacaaccauuauacacagaaaagccucucccugagccccggaaag

SEQ ID NO: 38510 - RNA, 642 nt, Artificial Sequence
  derived and/or modified sequence opt5 from Ficlatuzumab_LightChain1
gacaucgugaugacccagagccccgauucccuggccaugucucucggcgagagagucacacugaacugcaaggcuagcgaaaauguuguguccuacgugucuugguaucaacagaaaccugggcagagcccgaaacuucugauuuacggagccuccaaccgggagucuggcguccccgaccgcuucagcggguccggaagcgcgacggauuuuacccucacaaucucuuccgugcaggcugaagacguugccgauuaucacuguggccaaagcuacaauuauccuuacaccuucgggcagggaacaaaacuggagauuaagagaaccguggccgcucccucugucuuuaucuucccucccuccgacgaacagcuuaaaagcggcacagccucugugguuugccugcucaacaauuuuuauccucgggaggcuaaggugcaguggaaggucgauaacgcccugcaauccggcaauagccaggaguccgugaccgaacaggacucuaaagauagcacguacucccugagcucuacccucacacuguccaaggcggacuacgagaaacauaagguguaugccugugaagucacccaccaggggcuuagcucuccgguuacaaagagcuucaaccgcggagagugc

SEQ ID NO: 38511 - RNA, 1350 nt, Artificial Sequence
  derived and/or modified sequence opt5 from Figitumumab_HeavyChain1
gaggugcagcugcucgaaagcggcgggggacugguccaacccggcgggucccuuagacugucuugcaccgccagcggauucacauuuuccucuuacgcuaugaacuggguucggcaggccccuggcaaggggcucgagugggugagcgcgaucuccggaucuggcggcacgaccuucuaugcugacagcgugaaagggcgcuuuacaauuuccagagauaauagccggaccacacuguaccuucagaugaacucucugcgcgccgaagacaccgccgucuauuacugugcuaaggaucucggaugguccgacagcuauuacuauuacuacggcauggaugugugggggcagggaacaaccguuacggugucuuccgccagcaccaaaggcccgucugucuucccccuggcuccuugcuccagaagcacauccgagucuaccgccgcgcuggggugucucgugaaggacuauuuucccgaaccuguuacagugagcuggaacuccggagcccugaccagcggcguccacacguuccccgcugugcuucaaucuuccggccuguacagccucucuagcguggucacaguuccuuccucuaauuuugggacccagacauauaccugcaauguggaucauaaaccgagcaacaccaagguggacaagacagucgagcggaaauguugcguggagugucccccuugccccgccccucccguugcuggaccguccguguuccuguuuccucccaagccuaaagauacgcuuaugaucagccgcacccccgaagucacaugugugguuguggacgucucucacgaggaucccgaagugcaguucaauugguacgucgacggcguggagguucauaacgccaagaccaaaccuagagaggaacaguuuaauuccacauuccggguggucagcgugcugaccguugugcaccaagauuggcucaacgggaaggaguauaagugcaaagucucuaauaagggacugccggcgcccauugagaaaacgaucuccaagacaaaaggccagccucgcgaaccccagguguacacccugccucccagcagagaagagaugaccaagaaccaggugucccucacaugucugguuaaaggguuuuauccgucugacauugccgucgagugggaaagcaauggacaaccugagaacaauuacaagaccacacccccuaugcuugacuccgauggcucuuucuuccuguacagcaagcucacgguggacaaaucccgguggcagcagggcaacguguuuagcugcucugucaugcaugaagcucugcacaaccacuauacccaaaagucccuuagccugucucccggg

SEQ ID NO: 38512 - RNA, 642 nt, Artificial Sequence
  derived and/or modified sequence opt5 from Figitumumab_LightChain1
gacauccagaugacccaauuccccagcucccugucugccagcgugggcgauagagucacaauuacgugccgggcuucccaggggauccgcaacgaccucggaugguaccagcagaagccuggcaaagccccgaagagacugauuuaugcggcuucucggcuucaccgcgggguucccagcagauuuuccggaucuggcagcgggaccgaguucacacugaccaucuccagccuccaaccugaagauuuugccacauacuauugucugcagcauaauucuuaccccugcuccuucggacagggcaccaaacuugagauuaagcggacaguggccgcuccuagcguguuuaucuuucccccuucugacgaacagcugaaauccggcaccgccagcgucgugugucuccugaacaauuucuauccgcgcgaggcuaagguucaauggaagguggauaacgcccugcagucuggaaauucccaggaaagcgucacggagcaggacuccaaagauucuaccuacagccucuccagcacacugacccuuucuaaggcggacuaugagaaacacaagguguacgccugcgaaguuacacaucaagggcuguccagccccgugaccaaaucuuucaacagaggcgagugu

SEQ ID NO: 38513 - RNA, 1359 nt, Artificial Sequence
  derived and/or modified sequence opt5 from Firivumab_HeavyChain1
caggugcaacugguccagagcggcgccgagguuaagaugcccggguccucugugaaagugagcugcaagaccuccggagucuucuuuucuagccacgcuaucuccugggugagacaggccccuggccaggggcucgaauggaugggaggcauuucuccgauguucgggacaacgcauuacgcgcaaaaauuucagggacggguuaccaucacagcugaccagagcaccacaaccgccuauauggagcugacaucccuuaccagcgaagauacggccguguacuauugugcucgcgacggcgccggcucuuacuauccccugaacugguucgauccuugggggcagggaacccucgucacaguguccagcgcuucuaccaagggccccuccguuuuuccucuggcccccagcucuaaauccacaagcgggggaaccgcggcccuuggcugccuggugaaggacuacuucccugagccggucacgguguccuggaacucuggggcucucacaagcggagugcacaccuuucccgccguccugcaauccagcggccuguauucucucuccagcguugugacagugccuucuagcucccugggcacccagaccuacauuuguaaugucaaucauaagcccucuaacacaaaaguggauaagagaguugaaccuaaaagcugcgacaagacgcacaccugucccccgugcccugcucccgagcuucucgggggaccuuccguguuccuguuuccucccaaacccaaggauacacugaugaucagccggaccccggaggucacaugugugguuguggacgucucucaugaagaucccgaggugaaguucaauugguacgucgacggcguggaaguucacaacgccaaaaccaagccucgcgaggagcaguauaauuccacguacagaguggucagcgugcuuacaguucugcaccaggauuggcucaacgggaaagaauauaagugcaaagugucuaauaaggcgcugcccgccccuauugagaaaaccaucuccaaggcuaagggacaaccccgggaaccgcaggucuacacccugccucccagccgcgacgagcucaccaaaaaccaggugucccugacaugucuugugaagggcuuuuauccuucugauaucgccguugaaugggagagcaaugggcaacccgagaacaauuacaaaacaacgccucccguccuggacuccgacggaucuuucuuucucuauagcaagcugaccguggauaaauccagauggcagcagggcaacguguucagcugcucugucaugcaugaaggccuucacaaucauuacacacagaagucccugagccucucuccggggaag

SEQ ID NO: 38514 - RNA, 642 nt, Artificial Sequence
  derived and/or modified sequence opt5 from Firivumab_LightChain1
gagaucgugcugacccagagccccgccacacucucccugucuccuggcgaaagagcuacgcuuagcugccgggccuccgagaacauuuggaauaaccuggcgugguaccaacagaagccggggcaggcuccccgccuccugaucucuggagccagcaccggcgccacaggggucccuuccagauuccggggaucuggcagccgcaccgaauuuacacuuaccauuuccagccugcagucugaggacuucgcuaucuauuuuugucaacaguacaauuccuggcccagaacauucgggccuggaaccaaaguugaaauuaagcggacgguggccgcucccagcguguuuaucuucccuccgucugaugagcagcucaaauccggcaccgccagcgucgugugccugcugaacaauuuuuauccccgcgaggcgaagguucaguggaaaguggacaacgcccuccaaucuggcaauucccaggaaagcgucacagagcaggauuccaaggacucuaccuacagccuguccagcacacuuacccugucuaaggcugauuaugaaaaacacaagguguacgccugugagguuacgcaucaggggcucuccagcccugugacaaaaucuuucaacagaggagagugc

SEQ ID NO: 38515 - RNA, 1347 nt, Artificial Sequence
  derived and/or modified sequence opt5 from Flanvotumab_HeavyChain1
caggugcaacugguccagagcggcuccgagcucaagaaacccggggccucuguuaagaucagcugcaaggcuuccggauacaccuucacaucuuaugccaugaacugggugagacaggcgccuggccaggggcuggaaagcaugggauggauuaauacgaacaccggcaauccgacauacgcucaaggguuuaccggacgguucguguuuuccauggacacaucugucagcaccgccuaucuucagaucuccagccugaaagccgaggauacagcuauuuacuauugugcuccccgcuacucuuccagcugguaucucgacuacuggggccagggcacccuggugacgguuucuuccgcuagcaccaaagggccuucuguguucccccuugccccuuccagcaaguccacaucuggaggcaccgcggcccuggggugccucgucaaggauuacuuucccgaaccugugacaguuagcuggaacuccggagcucugaccagcggcgugcacacguucccggccguccugcagucuuccgggcucuauagccugucuagcguggugacaguccccuccucuagccuuggaacccaaacauacaucuguaauguuaaccauaaaccuuccaauaccaagguggacaaaagaguggagcccaagagcugcgauaaaacccacacauguccucccugcccggcuccugaacugcucggcggccccucugucuuucuguucccucccaagcccaaggacacgcuuaugauuucccggaccccugaggugacauguguuguggucgaugugagccaugaggacccggaaguuaaauuuaacugguauguggauggggucgaggugcacaaugccaagaccaaaccccgcgaggaacaguacaacucuacauauagagucguguccguucugaccgugcuccaucaggacuggcugaauggaaaggaguacaaaugcaaggucagcaacaaagcgcugccugcccccaucgaaaagacgaucuccaaggcuaaaggccagccucgggagccccaaguguauacacucccgccuucucgcgaagagaugaccaagaaucagguuagccugaccugucuugugaaaggguucuaccccuccgauauugccgucgaaugggagucuaacggacagccugagaauaacuacaagacaacacccccugugcuggacagcgauggcuccuuuuuccucuauagcaaacugaccguggacaagucuagauggcaacaggggaacgucuuuuccugcagcguuaugcacgaagcccuucacaaucauuacacgcagaagucucugucccucagccccggaaaa

SEQ ID NO: 38516 - RNA, 645 nt, Artificial Sequence
  derived and/or modified sequence opt5 from Flanvotumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggcucauguauaccuuuggccaggggacaaaacuggagaucaagagaaccguggcugccccuucuguguucauuuuucccccuuccgaugaacagcugaaaagcggaacggcgucugucgugugccuccugaacaauuucuacccgcgggaggccaagguucaauggaaaguggacaacgcccuucaguccggcaauagccaggaguccgucaccgaacaggauucuaaggacagcacauauucccugagcucuacccucacacuguccaaggcugauuacgagaaacacaagguguacgcuugugaaguuacccaucaaggccuuagcucucccgugacgaaauccuuuaaccgcggggagugc

SEQ ID NO: 38517 - RNA, 1362 nt, Artificial Sequence
  derived and/or modified sequence opt5 from Fletikumab_HeavyChain1
caggugcaacugguccagagcggcgccgagguuaagagacccggggcuuccgugaaagugucuugcaaggccagcggauacaccuucacaaacgacaucauucacuggguccggcaggcgccuggccagcgccucgaauggaugggguggaucaaugcuggauauggcaacacgcaauacucccagaauuuucaggauagagugucuauuacccgggacacaagcgccuccaccgccuauauggagcugaucucucuucgcagcgaagauacagcuguuuacuauugugccagagagccgcugugguucggggaauccagcccccaugacuacuauggaauggauguguggggccagggcaccacagucaccgugucuuccgcuagcacgaaagggccuucuguuuuuccccucgccccuugcucccggagcaccucugaguccacagcggcccugggaugucuugugaaggacuacuuccccgagccugucaccgugagcuggaacuccggcgcucugacaucuggggugcacaccuuuccggccguccuccaaagcuccggacuguacagccugucuuccguugugacggugcccagcucuagccucggcacaaaaaccuauacaugcaaugucgaucauaagccuuccaacaccaagguggacaaacgcguugaaucuaaguacgggcccccuugucccccgugcccugcucccgaguuccugggaggcccuagcguguuucuuuucccucccaaacccaaggauacccugaugauuuccagaacaccggaagucacgugugugguuguggacgucagccaggaggaucccgaggugcaguuuaauugguaugucgacggcguggaaguucacaacgccaaaaccaagccucgggaggaacaguucaauucuacauaccgcguggucuccgugcucaccguucugcaucaagauuggcuuaacgggaaggaguauaaaugcaaggugagcaauaaaggacugcccucuuccaucgaaaagacaaucagcaaagcgaagggccagccuagagagccccaggucuacacccucccgccuucccaagaggaaaugacgaaaaaccaggugucucugacaugucuggugaagggguuuuaucccagcgacauugccguugagugggaauccaauggacagccugagaacaauuacaagaccacacccccuguccucgacucugauggcagcuucuuucuguacucccggcuuaccguggacaaaagccgcuggcaggaagggaacguguucucuugcuccgucaugcacgaggcucugcacaaccauuauacccaaaagagccucucucugucccuuggaaaa

SEQ ID NO: 38518 - RNA, 642 nt, Artificial Sequence
  derived and/or modified sequence opt5 from Fletikumab_LightChain1
gccauccagcugacccaaagccccagcucucucagcgcuuccgugggcgacagagucacaauuacgugccgggccucucaggggaucagcuccgcgcuggcuugguaccagcagaagccuggaaaagccccgaaacuucugauuuaugaugccucuagccucgaguccggcguucccagccgcuucucuggguccggaagcggcaccgacuuuacacugaccaucucuucccuucaaccugaagauuucgcuacauacuauugucagcaguuuaacagcuacccccugaccuucgggggaggcacaaagguggagauuaagagaaccguggccgcuccuucugucuuuaucuuucccccuuccgacgaacagcucaaaagcggcacggccuccgugguuugccugcugaauaacuucuauccgcgggaggcgaaggugcaauggaaggucgauaaugcccuccagucugggaacagccaggaauccgugaccgagcaggacagcaaagauucuacauacucccugagcucuacccuuacacugagcaaggcugacuaugagaaacacaagguuuacgccugugaagugacccaucaaggacucuccucucccgucacgaaauccuucaaucgcggcgagugc

SEQ ID NO: 38519 - RNA, 1341 nt, Artificial Sequence
  derived and/or modified sequence opt5 from Fontolizumab_HeavyChain1
caggugcaacugguccagagcggcgccgagcucaagaaacccggguccucuguuaaggugagcugcaaggcuuccggauacaucuucaccucuagcuggauuaacugggugaaacaggccccuggccaggggcuggaauggaucggaagaauugacccguccgauggcgagguccacuauaaucaagacuuuaaagauaaggcgacacuuacgguggacaagucuaccaacacagcuuacauggaacugagcucccuccggagcgaggauaccgccguuuauuacugugcccgcggguuccugcccugguuugcugacuggggacagggcacacuugugaccgucucuuccgccagcacaaaaggcccuucuguguucccccuggcuccuuccagcaagucuaccuccgggggaacggccgcgcucggcugccugguuaaagauuauuuucccgaaccugugaccgucagcuggaacuccggggcccugacaucuggagugcauaccuucccggcugugcuccagagcuccggccuguacagccuuucuuccgucguuacagugcccagcucuagccuggggacccagacguauaucuguaaugugaaucacaagccuuccaacacaaaagucgacaagaagguggagcccaaaucuugcgauaagacccauacauguccucccugcccggccccugagcuccugggaggccccagcguuuuucuuuucccucccaaacccaaggacacccugaugauuuccagaaccccugaagugacaugugucgugguugaugugagccacgaggacccggaagucaaauuuaauugguacguggauggcgucgaggugcauaacgcuaagacgaaaccccgggaggaacaauacaauucuaccuaucgcguuguguccguccucacagugcugcaccaggacuggcugaacgggaaggaguacaagugcaaaguuagcaauaaggcccucccugcgcccaucgagaaaaccaucucuaaggccaaaggacagccuagagaaccccagguguauacacugccgccuucccgggacgaacuuaccaagaaccaagucagccugacgugucucgugaagggcuucuaccccuccgauauugcuguggagugggagucuaaugggcagccugaaaacaauuauaaaacaacacccccuguucuggacagcgauggauccuuuuuccuuuacucuaagcugaccgucgacaaaagccgcuggcagcaaggcaacguguuuuccugcagcgugaugcacgaggcccuccauaaccacuauacccagaagucucugucccugagccccgggaaa

SEQ ID NO: 38520 - RNA, 642 nt, Artificial Sequence
  derived and/or modified sequence opt5 from Fontolizumab_LightChain1
gacauccagaugacccaaagccccuccacacugucugccagcgugggcgauagagucacgauuaccugcaaggcuuccgagaacguugacacauacgugucuugguaucagcagaaaccugggaaggccccgaaacuccugaucuacggagcgagcaaucgguauaccggcgugcccucccgcuucucugggagcggauccggcacagauuuuacccuuacaauuagcucucugcagccugacgauuucgcuaccuacuauugugggcaauccuacaacuaucccuuuacguucggacagggcaccaaggucgaagugaaaagaacaguugccgccccuagcguguuuaucuuucccccuucugacgagcagcucaaguccggcaccgcuagcgucgugugccugcuuaauaacuucuacccgcgggaagccaagguucaguggaaaguggauaaugcucugcaaucugggaacucccaggagagcgucacagaacaggacuccaaggauucuaccuacagccucuccagcacgcugacacugucuaaagccgacuaugagaagcacaaaguguacgcgugugaggugacccaucagggacucuccagccccgucacaaagucuuucaaucgcggcgaaugc

SEQ ID NO: 38521 - RNA, 1344 nt, Artificial Sequence
  derived and/or modified sequence opt5 from Foralumab_HeavyChain1
caggugcaacuggucgagagcggcgggggaguugugcagcccggcagaucccuccggcugucuugcgccgcuagcggguucaaguuuuccggauacggcaugcacugggugcgccaggccccugggaaaggacuugaaugggucgcggugaucugguaugacggcucuaagaaauacuauguugauagcgugaagggcagauucaccauuucccgggacaacucuaaaaauacacuguaccuccagaugaacagccugcgcgcugaggauacggccgucuauuacugugccagacaaaugggguauuggcauuuugaccuuuggggacggggcacccuggugacaguuuccagcgcuucuaccaaggggccguccguguucccccucgccccuagcucuaaguccacaagcggaggcaccgcugcccuggggugccuggucaaagauuacuuucccgaaccugugacagugucuuggaacuccggagcgcucaccagcggcguccacacguuccccgccguucugcaguccucuggccuuuacagccuguccagcguggugaccgucccuucuuccagccucgggacacagaccuauaucuguaaugugaaucauaagccgucuaacacaaaaguugacaagcgcguggagcccaaaagcugcgauaagacccacacguguccucccugcccugcucccgaagccgagggaggcccguccgucuuucuguucccucccaagccuaaagacacacuuaugauuucuagaacccccgaggugacauguguuguggucgaugugagccaugaagaccccgaggucaaguuuaauugguacguggaugggguugaagugcacaacgcuaaaaccaagccucgggaggagcaguauaauuccaccuaccgcgucgugagcguucugacagugcuccaccaagacuggcugaacggaaaagaauauaagugcaaagucucuaauaaggcccugccggcgcccaucgagaagacgauuuccaaagccaagggccagccuagagaaccccagguguacacccucccucccagccgggaggaaaugaccaaaaaccaggugucucugaccugucuuguuaagggguucuauccguccgauaucgcugucgagugggagagcaauggacaaccugaaaacaauuacaaaacaacacccccugugcuggacuccgacggcagcuuuuuccucuacucuaagcugacgguggauaagucccgcuggcagcagggcaacgucuuuucuugcagcgugaugcaugaggcccuucacaaccauuauacacaaaaaucccugagccucucucccgggaag

SEQ ID NO: 38522 - RNA, 645 nt, Artificial Sequence
  derived and/or modified sequence opt5 from Foralumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuccccucaccuuuggcgggggaacaaaaguggagaucaagagaaccguggcugccccuucugucuucauuuuuccgcccuccgaugaacagcugaaaagcggcacggcgucugugguuugccugcucaacaauuucuauccucgggaggccaaggugcaguggaaagucgacaacgcucugcaauccggcaauagccaggaguccgugaccgaacaggauucuaaggacagcacauacucccuuagcucuacccugacacucuccaaggccgauuaugagaaacacaagguuuacgcuugugaagugacccaucaggggcugagcucucccgucacgaaauccuuuaaccgcggagagugc

SEQ ID NO: 38523 - RNA, 1344 nt, Artificial Sequence
  derived and/or modified sequence opt5 from Foravirumab_HeavyChain1
caggugcaacuggucgagagcggcgggggagccguucagcccggcagaucccuccggcugucuugcgcugccagcggguucaccuuuuccucuuacggaaugcacugggugcgccaggcgccuggcaaggggcuugaauggguggcugucauccuguaugacggaagcgauaaauucuacgccgacuccgugaagggcagauuuacaauuucucgggauaacagcaaaaauacgcucuaucugcagaugaacucccuucgcgccgaggacaccgcuguuuacuauugugccaagguggcugucgccggcacacauuucgauuacugggggcaaggaacccuggugacaguuagcucugcguccaccaaaggcccgagcguguuuccccucgccccuucuuccaagagcacaucugggggaaccgcugcccugggcugccuggucaaggacuauuuccccgaaccugugacgguguccuggaauagcggggcucucaccuccggaguccacacauuucccgccguucugcagucuagcggccuuuacucccugagcucuguggugaccgucccuuccagcucucucggcacacagaccuacaucuguaacgugaaucauaaaccgagcaacacgaagguugauaaaagaguggagcccaaguccugcgacaaaacacacaccuguccucccugcccugcgcccgaacugcuugggggaccgucugucuuccuguuuccucccaagccuaaggauacacucaugauuagccggacccccgaggugaccuguguuguggucgacgugucccaugaggaucccgaagucaaauucaauugguauguggacggcguugaggugcacaacgccaagacaaaaccucgcgaggaacaguacaauagcacguauagagucgugucuguucugaccgugcugcaccaagauuggcucaacgggaaggaguacaaaugcaaggucuccaauaaagcucugccggcccccaucgaaaagacaauuagcaaggcuaaaggacagccucgggagccccagguguauacccuuccucccucucgcgaagagaugacaaagaaccaggugucccugaccugucucguuaaaggcuuuuacccgagcgacaucgccgucgaaugggaguccaaugggcaaccugagaacaauuauaagacgacacccccugugcuggacucugauggcagcuucuuucuuuacuccaaacugaccguggacaagucuagauggcagcagggaaacgucuucagcugcuccgugaugcaugaagcccuccacaaccauuacacccaaaagagccugucucugucccccggc

SEQ ID NO: 38524 - RNA, 1344 nt, Artificial Sequence
  derived and/or modified sequence opt5 from Foravirumab_HeavyChain
gaggugcagcuggucgaaagcggcgggggagccguucagcccggcagaucccuccggcugucuugcgcugccagcggguucaccuuuuccucuuacggaaugcacugggugcgccaggcgccuggcaaggggcuugaguggguggcugucauccuguaugacggaagcgauaaauucuacgccgacuccgugaagggcagauuuacaauuucucgggauaacagcaaaaauacgcucuaucugcagaugaacucccuucgcgccgaagacaccgcuguuuacuauugugccaagguggcugucgccggcacacauuucgauuacugggggcagggaacccuggugacaguuagcucugcguccaccaaaggcccgagcguguuuccccucgccccuucuuccaagagcacaucugggggaaccgcugcccugggcugccuggucaaggacuauuuccccgagccugugacgguguccuggaauagcggggcucucaccuccggaguccacacauuucccgccguucugcaaucuagcggccuuuacucccugagcucuguggugaccgucccuuccagcucucucggcacacagaccuacaucuguaacgugaaucauaaaccgagcaacacgaagguugauaaaagaguggaacccaaguccugcgacaaaacacacaccuguccucccugcccugcgcccgagcugcuugggggaccgucugucuuccuguuuccucccaagccuaaggauacacucaugauuagccggacccccgaggugaccuguguuguggucgacgugucccaugaagaucccgaggucaaauucaauugguauguggacggcguugaagugcacaacgccaagacaaaaccucgcgaggagcaguacaauagcacguauagagucgugucuguucugaccgugcugcaccaggauuggcucaacgggaaggaauacaaaugcaaggucuccaauaaagcucugccggcccccaucgagaagacaauuagcaaggcuaaaggacaaccucgggaaccccagguguauacccuuccucccucucgcgaggaaaugacaaagaaccaggugucccugaccugucucguuaaaggcuuuuacccgagcgacaucgccgucgagugggaguccaaugggcagccugaaaacaauuauaagacgacacccccugugcuggacucugauggcagcuucuuucuuuacuccaaacugaccguggacaagucuagauggcaacagggaaacgucuucagcugcuccgugaugcaugaggcccuccacaaccauuacacccaaaagagccugucucugucccccggc

SEQ ID NO: 38525 - RNA, 642 nt, Artificial Sequence
  derived and/or modified sequence opt5 from Foravirumab_LightChain1
gacauccagaugacccaaagccccuccucucugagcgccuccgugggcgauagagucacaauuacgugccgggcuucucaggggauccgcaacgaccucggaugguaccagcagaagccuggcaaagccccgaagcugcuuauuuaugcggcuagcucccugcaaucugggguucccagcagauucuccggaagcggcucugggaccgauuuuacacucaccaucuccagccugcagccugaggacuucgccacauacuauugucagcagcuuaauucuuaucccccuaccuuuggaggcggcacaaaaguggaaauuaagcggaccguggccgcucccuccgucuucaucuuuccuccgagcgaugagcaacugaaaucugggacggccuccgugguuugccuccugaacaauuucuacccccgcgaagcuaaggugcaguggaaggucgacaacgcccugcagagcggaaauucccaggagucugugaccgaacaagauagcaaagacuccacauacagccucucuuccacccugacacuuagcaaggcggauuaugagaaacacaagguuuacgccugugaggugacccaucagggccugucuagcccugucacgaaauccuuuaacagaggggaaugc

SEQ ID NO: 38526 - RNA, 1341 nt, Artificial Sequence
  derived and/or modified sequence opt5 from Fresolimumab_HeavyChain1
caggugcaacugguccagagcggcgcugagguuaagaaacccggguccucugugaaggugagcugcaaggcuuccggauacaccuucucuagcaacgucaucuccugggugagacaggccccuggccaggggcucgaauggaugggaggcguuauuccgaucguggacauugcgaauuaugcucaacgguuuaaggggcgcgucacaaucacggccgaugagucuaccagcacaaccuacauggaacuguccagccuuagaucugaggacacagccguguauuacugugcuuccacccugggacucguucuggaugccauggacuauuggggccagggcacacuugugaccgucagcucugcuuccacgaaagggcccagcguguucccucuggcccccugcucucgguccaccagcgaauccacagcggcccucggaugucuggugaaggauuacuuuccugagcccgucaccguuucuuggaacagcggcgcucugacauccggggugcacaccuucccugccgugcuccagagcucuggacuguauucccuuagcucugucgugacgguuccgagcuccucucugggcacaaagaccuacacaugcaauguggaccauaaacccagcaacaccaaggucgauaaacgcguggaguccaaguacgggccucccuguccuagcugccccgcuccggaauuucucggaggcccuucuguuuuccuguuucccccuaaacccaaggacacccuuaugauuuccagaacacccgaggugacgugugucguggucgaugugagccaggaagacccugagguucaauucaauugguauguggauggcgucgaggugcacaacgccaagaccaaaccgcgggaggaacaguuuaauucuacauaccgcguuguguccguccugaccgugcuccaucaggacuggcugaacgggaaggaauauaaaugcaaggugagcaauaaaggacugcccuccucuaucgagaagacaaucagcaaagcgaagggccagccuagagaaccccaaguuuacacccucccucccucccaggaggagaugacgaagaaccaggucucucugacaugucuugugaaaggguucuauccgagcgauauugccguggaaugggaguccaauggacaaccugaaaacaauuacaagaccacacccccuguccuggacagcgacggcuccuuuuuccucuauucucggcugaccguggauaaaagccgcuggcaggaggggaacguguuuucuugcuccguuaugcacgaagcccuucauaaucacuacacccagaaaagccugucucucagccugggaaaa

SEQ ID NO: 38527 - RNA, 645 nt, Artificial Sequence
  derived and/or modified sequence opt5 from Fresolimumab_LightChain1
gagacggugcugacacagagccccggcacgcucucccugucuccuggggaaagagccacccuuagcugccgggcuucccaaucucugggaagcuccuaccucgccugguaucagcagaagccgggccaggcgccccgccugcuuaucuacggggcuucuagcagagccccuggcauucccgaccgguucuccggaagcgggucuggaacagauuuuacccugacaaucucccgccucgagccugaagacuucgccgucuauuacugucaacaguaugcugauagccccauuaccuuuggccagggcacaagacuggagaucaaacggaccguugccgcuccuucuguguucauuuuuccgcccuccgacgaacagcucaagagcgggacggccucuguggucugccugcugaacaauuucuacccucgcgaggcgaaagugcaauggaagguugauaacgcccuucaguccggaaauagccaggaguccgugaccgaacaggacucuaaagauagcacauauucccugagcucuacccucacacuguccaaggcugacuacgagaagcacaaagucuacgccugugaagugacccaucaaggccuuagcucucccguuaccaagagcuuuaacagaggggagugc

SEQ ID NO: 38528 - RNA, 1347 nt, Artificial Sequence
  derived and/or modified sequence opt5 from Fulranumab_HeavyChain1
gaggugcagcuggucgaaagcggcgggggacucguucaacccggcgggucccugagacuuucuugcgccgcuagcggauucacccugcgguccuacucuaugaacugggugcgccaggccccuggcaaggggcucgagugggugagcuauaucuccagaucuagccacacaaucuuuuacgcggacuccgucaaaggacgguucacgauuagccgcgauaaugcuaagaacucucuguaucuucagauggacucccugagagaugaagacaccgccauguacuauugugcccggguguacagcucuggcuggcauguuuccgauuauuuugacuacuggggccaggggauucucgugacagucagcucugcuuccaccaaaggaccgagcguguucccccuggccccuugcucccgcucuacaagcgaguccaccgcugcccugggcugucucguuaaggauuacuuucccgaaccugugacagucagcuggaacucuggggcgcugaccuccggagugcacacguuccccgccgugcuucaaagcucuggccuguauagccucuccucugucguuaccgugccuagcuccaauuuugggacacagaccuacacaugcaauguggaccauaaaccgagcaacaccaaggucgauaagacgguggagagaaaauguugcguugagugucccccuugccccgcuccucccguggccggaccgucugucuuccuguuuccucccaagccuaaagacacacuuaugaucucccggacccccgaagugacauguguuguggucgaugugagccacgaggaccccgaaguccaguucaauugguauguggauggcguugaggugcauaacgcuaagaccaaaccucgcgaggaacaguuuaauucuaccuucagagucguguccguucugacagugguccaccaagacuggcucaacggcaaggaguacaagugcaaagugagcaauaaggggcugccggcccccauugagaaaacgaucuccaagaccaaaggacagccucgggaaccccagguguauacacugccucccucucgcgaagagaugaccaagaaccagguuagccucacaugucuggucaaaggcuuuuacccguccgacaucgcgguggagugggaaucuaaugggcaaccugagaacaauuauaagaccacgcccccuaugcuugauagcgacggauccuucuuccuguacagcaagcucacaguggauaaaucuagauggcagcagggcaacgucuuuuccugcagcgugaugcacgaagcccugcauaaccacuacacccaaaagucucuuucccugagccccgggaaa

SEQ ID NO: 38529 - RNA, 642 nt, Artificial Sequence; identical to SEQ ID NO: 38518
  derived and/or modified sequence opt5 from Fulranumab_LightChain1

SEQ ID NO: 38530 - RNA, 1356 nt, Artificial Sequence
  derived and/or modified sequence opt5 from Futuximab_HeavyChain1
gaggugcagcugcaacagcccggcagcgaacucgucagaccuggggccuccguuaagcugucuugcaaagcuagcggauacaccuucacauccuauuggaugcacugggugaagcagcggccgggccaggggcuugaguggaucggaaacauuuaccccggcucucgcagcacgaauuaugacgaaaaauuuaaguccaaagccacccugacaguggauaccucuagcuccacagcguacaugcaacucagcucucugaccuccgaggacagcgcugucuauuacuguacaagaaacggggauuauuacgugucuuccggagacgccauggauuacuggggccagggcaccagcguuacggugucuuccgccagcaccaaggggccuuccgucuucccccuugcuccuucuagcaaguccacaagcggaggcaccgccgcucuggggugccucgugaaagacuauuuucccgaaccuguuacagugucuuggaacuccggagcccugaccagcggcguccauacguucccggcggugcugcagucuagcgggcucuacucccugucuagcguggucacaguucccuccagcucucuuggaacccagacauauaucuguaaugugaaucacaagccuuccaacaccaaaguggauaagcgggucgagcccaaaagcugcgacaagacccauacauguccucccugcccggccccugagcugcucggcggccccucuguguuucuguucccucccaagcccaaagauacgcuuaugauuucccgcaccccugaaguuacauguguggucguggacguuagccacgaggauccggaagugaaguuuaauugguacgucgacgggguggagguccauaacgcuaaaaccaagcccagagaggaacaauauaauuccacauaccgggugguuucugugcugaccguccuccaccaggauuggcugaacggaaaagaguauaagugcaaagugagcaauaaggcccugccugcucccaucgaaaagacgauuuccaaagccaagggccagccucgcgagccccagguuuacacacucccgccuucuagagaagagaugaccaaaaaccaagugagccugaccugucuugucaagggguucuaccccuccgacaucgcgguggagugggaaagcaauggacagccugagaacaauuauaaaacaacacccccugugcuggacucugauggcuccuuuuuccucuacagcaagcugaccguugacaagucucgguggcagcaagggaacgucuuuuccugcagcgugaugcacgaagcccuucauaaccacuauacgcagaaaucucugagccucucccccgga

SEQ ID NO: 38531 - RNA, 642 nt, Artificial Sequence
  derived and/or modified sequence opt5 from Futuximab_LightChain1
gacauccagaugacccaaacaacgagcucccugucugccagccucggcgauagagugaccauuuccugccggacaucucaggacaucgggaacuaccugaauugguaucagcagaagcccgauggaaccgucaaacuucugauuuacuauacaagccgccuccacuccggcguuccuucuagauucagcggguccggaagcggcaccgacuuuucucugacaaucaacaauguggagcaagaagauguggcuaccuacuucugucagcauuauaacacggucccgcccaccuuugggggaggcacaaaacuugagauuaagcggaccguggccgcgccuuccguuuucaucuuucccccuagcgacgaacagcugaagucuggcacagcuuccguggucugccuccugaauaacuucuacccccgcgaggccaaagugcaguggaagguugauaaugcccugcaaagcgggaacucucaggaauccgugaccgagcaggacagcaaggauuccacguauucucucagcuccacacugacccuuagcaaagcugacuacgagaagcacaaagucuacgccugugaagugacacaucagggacugucuuccccugugaccaagagcuuuaauagaggcgagugc

SEQ ID NO: 38532 - RNA, 1335 nt, Artificial Sequence
  derived and/or modified sequence opt5 from Galcanezumab_HeavyChain1
caggugcaacugguccagagcggcgcugagguuaagaaacccggguccucugugaaggugagcugcaaggcuuccggauacaccuucggcaacuauuggaugcagugggucagacaggccccugggcaaggacucgaauggaugggcgcgaucuacgaggggacaggaaagacgguguauauucagaaauuugcugaccggguuaccaucacagccgauaagucuaccagcacagccuacauggaacuguccucucuucgcagcgaggacaccgcuguguauuacugugccagacuguccgauuaugucagcggcuucggcuacugggggcagggaacaaccgugacgguuucuuccgcuagcaccaagggcccgucuguguuuccccucgccccuugcucccggagcacaucugaauccaccgcggcccuggggugucuugucaaagacuacuuccccgagccugugacagugagcuggaacuccggagcucugaccucuggcguccacacguuucccgccguucuccagagcuccgggcuguauagccugucuuccguggugacagucccuagcucuagccucggaaccaagacauauaccugcaauguggaucauaaaccguccaauaccaagguugacaaacgcguggagucuaaguacggacccccuugucccccuugccccgcuccggaagccgcgggcgggccuagcgucuuccuguuucccccuaagcccaaagauacacuuaugauuuccagaacgcccgaggugaccuguguuguggucgacgugagccaagaagauccugagguccaguucaacugguacguggacggaguugaggugcacaaugccaagacaaaaccgcgggaggaacaguuuaacucuaccuaucgcgucguguccguucugacagugcuccaucaggauuggcugaauggcaaggaauacaaaugcaaggucagcaacaaagggcuucccucuuccaucgagaagaccauuagcaaggcuaaaggacaaccuagagaaccccagguguauacgcugccucccucccaggaggagaugacaaagaaucaagugucucucaccugucugguuaaaggcuucuacccgagcgacaucgccgucgaaugggaguccaacgggcagccugaaaauaacuacaagaccacacccccugugcuggauucugacggcagcuuuuuccucuauucccggcugaccguggacaaaagccgcuggcaggagggcaaugucuuuucuugcuccgugaugcacgaagcccuucauaaccacuacacacagaaaagccugucucucucccugggc

SEQ ID NO: 38533 - RNA, 642 nt, Artificial Sequence
  derived and/or modified sequence opt5 from Galcanezumab_LightChain1
gacauccagaugacccaaagccccuccucucugagcgccuccgugggcgauagagucacaauuacgugccgggcuucuaaggacaucagcaaauaccucaacugguaucagcagaagccugggaaagccccgaagcugcuuauuuacuauaccuccggauaccacucuggcguucccagccgcuucuccgggagcggaucuggcacagauuuuacccugacaaucuccagccuccagccugaggacuucgcgaccuauuacugucaacagggggaugcucugcccccuacauuuggaggcggcaccaaaguggaaauuaagagaacgguggccgcccccucugucuucaucuuuccuccguccgacgagcagcuuaagagcgggaccgcuucugugguuugccugcucaauaacuucuauccccgggaagccaaagugcaguggaaggucgauaaugcucugcaauccggaaacagccaggaguccgugacagaacaggacucuaaagauagcaccuacucccugagcucuacacucacccuguccaaggccgacuacgagaaacauaagguuuaugcgugugaggugacgcaccagggccuuagcucuccugucacaaagagcuuuaaucgcggggaaugc

SEQ ID NO: 38534 - RNA, 1371 nt, Artificial Sequence
  derived and/or modified sequence opt5 from Galiximab_HeavyChain1
caggugcaacugcaggagagcggccccgggcucgucaagccuuccgaaacccugucucuuacaugcgccguuagcggaggcuccaucucugggggauacggcuggggguggauuagacagccgcccggaaaaggccuggaguggaucggcagcuucuauuccucuagcgggaacacguacuauaauccuucccucaagagccaggugaccauuucuacagacaccuccaaaaaccaauuuagccugaaacuuaauucuaugacagcugccgauaccgcgguguacuauuguguccgggaccgccuguucuccgugguuggaaugguguacaacaauugguuugaugucuggggccccggggugcucguuacagugagcucugcuuccaccaaaggaccuagcgucuucccccuggccccuuccucuaagagcacguccggcgggaccgccgcucugggaugccucgugaaggacuauuuuccggaacccgugacagucagcuggaacucuggcgcccugaccuccggcguucacacauucccugcugugcuucagagcucugggcuguacagccucuccucuguggucaccgugcccagcuccagccugggaacgcagacauacaucuguaauguuaaccauaaaccuucuaauaccaagguggauaaaaaggccgagcccaaauccugcgacaagacacacaccuguccgccuugccccgcgccugaacuucugggcgggcccagcgucuuucucuuucccccuaagccgaaagauacccugaugauuucuagaacacccgaggugacguguguuguggucgacgugucccaugaggauccugaagucaaguuuaacugguauguggacggaguugaggugcacaaugccaaaaccaagccccgggaggaacaguacaacagcacauaucgcgucguguccguucugaccgugcuccaucaagauuggcugaauggcaaagaguacaagugcaaagucucuaacaaggcccuuccugcucccaucgaaaagacaaucagcaaagcuaaggggcagccgagagagccucagguguauacccugcccccuucccgggacgaacucacgaaaaaucaggugucucugacaugucuuguuaagggauucuaccccagcgauauugccgucgagugggaauccaacggccaaccugagaacaauuauaaaaccacacccccggugcuggacagcgacggcucuuucuuccucuacuccaagcugaccguggauaagagccgcuggcagcaggggaacgucuuuucuugcuccgugaugcacgaggcgcugcacaaucauuacacccaaaagagccucucucugagcccuggaaag

SEQ ID NO: 38535 - RNA, 648 nt, Artificial Sequence
  derived and/or modified sequence opt5 from Galiximab_LightChain1
gagagcgcccugacccagcccccuuccgugucuggcgcuccggggcaaaaggucacaaucagcugcacgggauccaccucuaacauuggcggguacgaccuccacugguaucagcagcugcccggaacagccccuaaacuucugaucuacgauauuaauaagagacccagcggcaucuccgaccgguucucugggagcaaauccggaaccgcggcuagccucgccauuacaggccugcagaccgaagaugaggccgacuauuacugucaaucuuaugauuccagccuuaacgcucagguuuuuggcgggggaacacgccugaccgugcucggccagccuaaggccgcucccacggugacccuguucccuccgucuuccgaggaacugcaggccaauaaagcgacacucgucugccugaucagcgacuuuuaccccggggccgugaccguugcuuggaaggccgauucuuccccugugaaggcuggagucgaaacaaccacgcccagcaaacaauccaacaauaaguaugccgcgucuagcuaccuuucccugacaccugagcaguggaaaagccauagaucuuacuccugucaggugacccacgagggcagcacaguugaaaagaccguggcccccaccgagugcucu

SEQ ID NO: 38536 - RNA, 1347 nt, Artificial Sequence
  derived and/or modified sequence opt5 from Ganitumab_HeavyChain1
caggugcaacugcaggagagcggccccgggcucgucaagccuuccggaacccugucucuuacaugcgccguuagcggcggguccaucucuagcuccaacugguggucuugggugagacagccgcccggaaaaggccuggaauggauuggggagaucuaccacagcggauccacgaauuauaacccuagccucaagucucgggugaccauuuccgucgacaaaagcaagaaucaguucucucugaaacuuuccagcgugacagcugccgauaccgcgguuuacuauugugcucgcuggacaggcagaaccgacgccuuugauaucuggggccaagggacaauggugaccgucucuuccgccagcacgaagggacccuccguguucccucuggcucccucuagcaaguccaccagcggcgggacagccgcucucggaugccugguuaaagacuacuuuccugaaccggugaccgucucuuggaacuccggcgcccugacaagcggggugcauaccuuccccgcggugcuccagucuagcggacuguauucccuuucuagcgucguuacggugccuuccagcucucugggcacacagaccuacauuuguaaugugaaccacaagcccuccaauacaaaagucgauaagaaaguggagccuaagagcugcgacaagacccauaccugucccccgugcccugcccccgaacuccugggcgggccuucuguuuuucuuuucccgcccaaaccuaaggauacacugaugaucucccggacgccggaggugaccugugucgugguugacgugagccacgaggaucccgaagucaaauuuaacugguauguggacggagucgaggugcauaaugcuaagacaaaaccucgcgaagaacaguacaacuccaccuacagaguugugucuguccucacagugcugcaccaagauuggcugaauggcaaggaguauaaaugcaagguuagcaacaaggcccuccccgcuccuaucgagaaaaccauuuccaaggccaaagggcagccccgggagccccagguguacacgcugccucccucucgcgacgaacuuacaaagaaucaggucagccugaccugucucgugaaaggauucuauccuuccgauaucgcgguggagugggaaagcaacggccaacccgagaauaacuacaagaccacaccucccguucuggacucugacggguccuuuuuccuuuauagcaagcugaccgucgauaaaucuagauggcagcagggaaacguguuuuccugcagcgugaugcacgaggcccuccauaaucacuacacacaaaagucucugagccuguccccgggcaaa

SEQ ID NO: 38537 - RNA, 657 nt, Artificial Sequence
  derived and/or modified sequence opt5 from Ganitumab_LightChain1
gacguggucaugacccagagcccccugucccucccuguuacaccgggcgagcccgccucuaucagcugcagauccucucaaagccugcuucacuccaacggguacaauuaucuggauugguaccuccagaagccuggacagucuccccagcugcuuauuuaucugggcagcaaccgggcuuccggggugccugaccgcuucagcggaucuggcuccgggacggauuuuacccucaaaaucagcagaguggaagccgaggacgucggaguguacuauuguaugcaaggcacacauuggccccugaccuucggccaggggacaaagguugaaauuaaacggaccguggcggcuccuucugucuuuaucuucccgcccuccgaugagcagcuuaagagcggaacagccucugugguuugccuccugaauaacuuuuacccucgcgaagccaaagugcaguggaaggucgacaaugcucugcaauccggcaacagccaggaguccgugaccgagcaggauucuaaggacagcacguauucccugagcucuacccucacacuguccaaagccgauuacgaaaagcacaaaguguacgcuugugaggucacccaucaggggcuuagcucucccguuacaaagagcuucaauagaggagaaugc

SEQ ID NO: 38538 - RNA, 1368 nt, Artificial Sequence
  derived and/or modified sequence opt5 from Gantenerumab_HeavyChain1
cagguggagcuggucgaaagcggcgggggacucguucaacccggcgggucccugagacuuucuugcgccgcuagcggauucaccuuuuccucuuacgccaugagcugggugcggcaggcgccuggcaaggggcuggaguggguguccgcuaucaacgccucuggaacacgcacguauuacgccgacagcgucaaaggcagauucaccauuucccgggauaauagcaagaacacacucuaucugcagaugaacucucuucgcgcugaagacaccgccguguacuauugugcuagaggcaaagggaauacacacaagccguacggauauguucgguacuuugauguguggggccaggggacccuggucacaguguccagcgccucuaccaaaggacccuccguuuucccucucgcgcccagcucuaaguccacgagcggcgggaccgccgcucugggaugccuggugaaggacuacuuuccugagcccgucacaguguccuggaacucuggcgcccucaccagcggcgugcauacauucccugcuguccugcaauccagcgggcuuuauucucuguccagcguugugaccgugccgucuagcucccucggaacgcagacauacaucuguaaugucaaucacaaacccucuaacaccaagguggauaaaaagguugaaccuaaaagcugcgacaagacacauaccugucccccuugccccgccccggagcugcuuggcgggccuuccguguuucuguuucccccuaagcccaaagauacccucaugauuagccgcacacccgaggucacgugugugguuguggacgucucucacgaagauccugaggugaaguuuaauugguaugucgacggaguggaaguucauaacgcgaaaaccaagccgagagaggagcaguacaauuccacauaucggguggucagcgugcugaccguucugcaccaggauuggcucaacggcaaagaauacaagugcaaagugucuaauaaggcccugcccgcuccuaucgagaagacaauuuccaaagccaaggggcaaccccgcgaaccucaggucuauacccuucccccgagcagagacgagcugacgaaaaaccaggugucccucacaugucuggugaagggauucuacccuucugauaucgcuguugaaugggagagcaauggccagcccgagaacaacuacaaaaccaccccucccguccuugacuccgacggcucuuucuuccuguauagcaagcucacaguggauaagucccgguggcaacaggggaauguguuuagcugcucugucaugcacgaagcccugcauaaccacuacacccagaaaucccugagccucucuccuggaaag

SEQ ID NO: 38539 - RNA, 645 nt, Artificial Sequence
  derived and/or modified sequence opt5 from Gantenerumab_LightChain1
gacaucgugcugacccagagccccgccacacucucccugucuccuggcgagagagcuacgcuuagcugccgggccucccaaucugucagcuccucuuaccuggcgugguaucagcagaagccggggcaggcuccccgccuccugauuuacggagccagcuccagagccaccggcguuccugcucgguucagcgggucuggauccggcacagauuuuacccuuacaaucagcucucuggaacccgaggacuucgccaccuauuacugucuccaaauuuauaacaugccuaucacauuugggcagggaaccaaaguggaaauuaagcgcacgguggcugcccccuccgucuucaucuuuccuccgagcgaugagcagcugaaaucuggcaccgcguccgugguuugccugcucaauaacuucuaccccagagaagccaaggugcaguggaaagucgacaaugcucugcaaagcggcaacucccaggagucugugacagagcaggauagcaaggacuccaccuauagccuuucuuccacacugacccucagcaaggccgauuacgaaaaacacaagguuuacgcuugugaggugacgcaucaggggcugucuagcccugucacaaaauccuuuaaucggggagaaugc

SEQ ID NO: 38540 - RNA, 348 nt, Artificial Sequence
  derived and/or modified sequence opt5 from Gemtuzumab_HeavyChain1
caggugcaacugcagcagagcggcgccgagcucgcuaagcccggggccuccgucaaaaugucuugcaaggcgagcggauacaccuucacauccuauagaaugcacuggguuaaacagcggccuggccaagggcuggaauggaucggauacauuaacccgucuacgggcuauaccgaguacaaucagaaguuuaaagacaaggcuacacuuaccgccgauaagagcuccucuacagccuauaugcagcugagcucccucaccuucgaagacagcgcuguguacuauugugcccgcgggggaggcguguuugauuacuggggccaggggacaacccugacggucucuucc

SEQ ID NO: 38541 - RNA, 351 nt, Artificial Sequence
  derived and/or modified sequence opt5 from Gemtuzumab_HeavyChain2
caggugcaacugguccagagcggcgccgagguuaagaaacccggguccucugugaaggugagcugcaaggcuuccggaggcaccuucucuagaagcgccaucauuuggguccggcaggcgccugggcagggacucgaauggaugggcgggaucgugccgauguuuggacccccuaacuacgcucaaaaauuccagggccgcguuacaauuacggccgacgaguccaccaauacagccuauauggaacugucuagccuuagauccgaggauaccgcuuuuuacuucugugccggcggguauggaaucuacagccccgaagaguauaacggcgggcuggugacagucucuucc

SEQ ID NO: 38542 - RNA, 321 nt, Artificial Sequence
  derived and/or modified sequence opt5 from Gemtuzumab_LightChain2
gacauccagaugacccaaagccccuccacacugucugccagcgugggcgauagagucacgauuaccugccgggcuucccagucuaucaacacauggcucgccugguaccagcagaagccugggaaagcgccgaagcugcuuauguauaaagcuagcucccuggagucuggaguucccagccgcuucauuggcuccgggagcggaaccgaauuuacacucaccaucucuucccugcaaccugacgauuucgccacauacuauugucagcaguacaauagcgacucuaagauguuuggccaggggaccaaaguggaggugaag

SEQ ID NO: 38543 - RNA, 318 nt, Artificial Sequence
  derived and/or modified sequence opt5 from Gemtuzumab_ozogamicin_LightChain1
cagaucgugcugacccaaagccccgccauuauguccgcuucuccuggcgagaaggucacaaucacgugcagcgccuccucuagcauuuccuacaugcacugguuccagcagaaaccggggaccucucccaagcucuggaucuauacaaccagcaaccuggcguccggaguuccugcuagauuuagcggcucuggguccggaacaagcuacucucuuaccauuucccggauggaagccgaggacgccgcuacauauuacugucaucagcgcagcaccuauccccugacguucggcucugggaccaaacucgaacugaag

SEQ ID NO: 38544 - RNA, 1335 nt, Artificial Sequence
  derived and/or modified sequence opt5 from Gevokizumab_HeavyChain1
caggugcaacugcaggagagcggccccgggcucgucaagccuucccagacccugucucuuacaugcagcuucuccggauuuucucugagcacguccggcauggggguuggauggaucagacagccgucuggcaaagggcucgaauggcuggcccacauuuggugggacggagaugagagcuacaaccccucccuuaagagccggcugaccaucucuaaagacacauccaagaaucaagugagccucaaaauuaccucugugacagcugccgauaccgcggucuauuucugugcucgcaacagauacgacccucccugguuuguggauuggggccagggcacacugguuaccguguccagcgccucuacgaaggggccuuccgucuucccccuggccccuugcagccgguccaccucugaaagcacagcugcccucggaugucuggugaaggacuauuuuccggagcccguuaccguguccuggaauagcggcgcucuuacaucugggguccauaccuucccugccgugcugcaguccagcggacucuacucucugagcuccguggucacgguuacaucuagcaacuuuggcacccagacauauaccugcaauguggaucacaaacccuccaacaccaagguggacaaaacagucgaacgcaaguguugcguggaguguccucccugcccggcgccucccguugccgggccuagcguguuccuuuuuccucccaaacccaaggauacgcugaugaucucuagaaccccggaggucacaugugugguuguggacgucucccaugaagaucccgaggugcaauucaauugguacgucgacggaauggaagugcacaacgcuaagaccaaaccucgggaggagcaguuuaauagcacauuccgcguugugucuguccucaccgugguucaucaggauuggcugaacggcaaggaauauaaaugcaagguguccaauaaaggccugcccgccccuauugagaagacgaucagcaaaacaaaggggcagcccagagaaccgcaagucuacacccucccucccucccgggaggaaaugaccaagaaccaggugucucugacaugucuugugaaaggauuuuacccuagcgacaucgcuguugagugggaguccaauggccagcccgaaaacaauuauaagaccacaccucccaugcuggacucugaugggagcuucuuccucuacuccaaacugacggucgacaagagccgcuggcaacagggaaacguguuuucuugcuccgugaugcacgaggcccuucacaaccauuauacccagaaaagccugucucucuccccgggc

SEQ ID NO: 38545 - RNA, 642 nt, Artificial Sequence
  derived and/or modified sequence opt5 from Gevokizumab_LightChain1
gacauccagaugacccaaagcacauccucucugagcgccuccgugggcgauagagucacgauuaccugccgggcuucucaggacaucagcaacuaccucuccugguaucagcagaagcccgggaaagccguuaagcugcuuauuuacuauacaucuaaacugcacagcggagugccuucccgcuucagcggcucuggguccggaaccgauuacacacucaccaucagcucucugcaacaggaggacuuugcgacauauuucugucuucagggcaagaugcugccguggaccuuugggcagggaacgaaacucgaaauuaagagaaccguggcugcccccuccgucuucaucuuuccucccagcgaugagcaacugaagucuggcacagccuccgugguuugccugcucaauaacuucuacccucgggaagcuaaagugcaguggaaggucgacaaugcccugcagagcggcaacucccaggagucugugaccgaacaagauagcaaagacuccacauauagccuuucuuccacccugacgcucagcaaggcugauuacgagaaacauaagguuuacgccugugaggugacacaccaggggcugucuagccccgucaccaaguccuuuaaucgcggagaaugc

SEQ ID NO: 38546 - RNA, 1347 nt, Artificial Sequence
  derived and/or modified sequence opt5 from Girentuximab_HeavyChain1
gacgugaagcuggucgagagcggcgggggacucguuaaacugggcgggucccuuaagcugucuugcgccgcuagcggauucaccuuuuccaacuacuauaugucuugggugagacaaacacccgaaaaacggcucgagcugguggccgcgaucaauagcgauggcgggauuacguacuaucuugacaccgucaagggacgcuucacaaucuccagagauaacgcuaaaaauacccuguaccuccaaaugucuagccugaaguccgaagacacagcccuguuuuauugugcccggcaccgcagcggcuacuucucuauggauuauuggggccaggggaccuccgugacaguuagcucugcuuccaccaagggaccuagcguguuuccgcucgcccccucuuccaaaagcacguccggcgggaccgcugcccugggaugccuugucaaggacuacuucccugagcccgugacaguuucuuggaacagcggcgcgcugaccuccggggugcauacauuuccugccguccuccagagcucuggacuguacucccuuagcucuguggugaccguccccagcuccucucugggcacgcagacauauauuuguaauguuaaccacaaaccuagcaauaccaagguggauaaaaagguggaaccgaaguccugcgacaaaacacauaccugucccccuugccccgcuccugagcuccugggcgggcccagcgucuuccuguuuccgccuaagcccaaagauacccucaugaucucuagaacaccugaggugacguguguuguggucgacgugucccacgaagaucccgagguuaaguucaacugguacguggacggagucgaagugcauaaugccaaaaccaagccccgggaggagcaauauaacagcacauaccgcgucgugucuguucugaccgugcuucaccaggauuggcugaauggcaaagaauauaagugcaaggucuccaacaaagcucucccugccccgauugagaagacaaucagcaaagcgaaggggcagcccagagaaccucagguguacacccugcccccuucccgggacgagcuuacgaaaaaucaaguuucucugacaugucucgugaagggauuuuaucccagcgacaucgccgucgaaugggaguccaacggccagccggagaauaacuacaagaccaccccucccgugcuggauucugacgggagcuucuuucuguacuccaaacucacaguggauaagagccgcuggcagcagggaaacguuuucucuugcuccgucaugcacgaagcucugcauaaucacuauacccagaaaagccuuucucuguccccuggcaag

SEQ ID NO: 38547 - RNA, 642 nt, Artificial Sequence
  derived and/or modified sequence opt5 from Girentuximab_LightChain1
gacaucgugaugacccagagccaaagauucauguccacaacggucggcgaucggguuucuauuaccugcaaagccagccagaacgugguguccgcugucgccugguaccagcagaaacccgggcaaucuccuaagcugcucaucuauagcgcguccaaucgcuacacaggagugccggacagauuuaccggcucugggagcggaacagauuucacccugacaauuuccaacaugcagagcgaggaccuugcugacuuuuucugucagcaguauucuaauuaccccuggaccuuuggcgggggaacgaaacuggaaaucaagcggaccguugccgccccuuccguguucauuuuucccccuagcgaugagcaacucaaaucuggcacagcuuccgucgugugccugcuuaacaauuucuauccccgcgaagccaagguucaguggaagguggauaacgcucugcagagcggcaauucucaggaguccgucaccgaacaagacagcaaagauuccacauacucucucagcuccacccugacgcugagcaaggccgacuaugagaaacacaagguguacgcgugugaggugacacaucaggggcucucuuccccugucaccaagagcuuuaacagaggagaaugc

SEQ ID NO: 38548 - RNA, 1335 nt, Artificial Sequence
  derived and/or modified sequence opt5 from Glembatumumab_HeavyChain1
caggugcaacugcaggagagcggccccgggcucgucaagccuucccagacccugucucuuacaugcacgguuagcggaggcuccaucucuagcuucaacuacuauugguccuggauuagacaccauccggggaaaggacuggaauggaucggcuacauuuauuacucugggagcaccuauuccaaucccagccucaagucucgggugacaaucuccguggacaccagcaaaaaccaguuuucucugacacuuuccagcgucaccgccgcugauacagccguguacuauugugcgcgcggauacaauuggaacuacuucgacuauuggggccaaggcacccugguuacggugucuuccgcuagcaccaaggggccuuccgucuuuccccucgccccuugcucuagaagcacauccgagagcaccgccgcucugggaugucuggugaaagauuacuuccccgaaccuguuacagugucuuggaacuccggcgcccucaccagcgggguccacacguuuccggcugugcugcagucuagcggacuuuauucccugucuagcguggucacaguucccuccagcaauuucggcacccagacauauaccugcaauguggaccauaagccuucuaacaccaagguggauaaaacagucgagcggaaguguugcguggaaugucccccuugccccgccccgccuguugcggggcccuccguguuucucuucccucccaaacccaaggacacgcugaugauuagccgcaccccugaggucacaugugugguuguggaugucucucacgaggacccggaagugcaguuuaauugguacgucgauggaguggagguucauaacgccaaaaccaagcccagagaggaacaauucaauuccacauuucggguggucagcgugcuuaccguugugcaccaggacuggcugaacggcaaggaguacaaaugcaaggucuccaauaaaggccucccugcucccaucgaaaagacgaucucuaaaacaaaggggcagccucgcgagccccagguguauacccugccgccuagcagagaagagaugaccaaaaaccaagugucccugacaugucucguuaagggauucuaccccucugauauugccgucgaaugggagagcaauggccagccugagaacaacuacaagaccacacccccuaugcuggacuccgaugggagcuuuuuccuuuauucuaaacugacgguggacaagucccgguggcagcaaggaaauguguucagcugcucugucaugcacgaagcucuccauaaccacuacacccagaaaucccugagccuuucucccggcaag

SEQ ID NO: 38549 - RNA, 645 nt, Artificial Sequence
  derived and/or modified sequence opt5 from Glembatumumab_LightChain1
gagaucgugaugacccagagccccgccacacuguccgucucuccuggcgaaagagcuacgcucagcugccgggccucccaaucuguugacaacaaucuggugugguaccagcagaaaccggggcaggcgccccgccuucugauuuauggagcuagcaccagagccacaggcaucccugcccgguucuccgggucuggaagcggcaccgaguuuacacucaccauuuccagccugcaaucugaagauuucgcuguguacuauugucagcaguacaacaauuggcccccuuggacauuugggcagggaaccaaagucgagaucaagcgcacgguggccgcucccuccguuuucauuuuuccuccgagcgacgaacaacuuaaaucuggcaccgccuccguggucugccugcucaacaauuucuaucccagagaggcgaaggugcaguggaaaguugauaacgcccugcagagcggcaauucucaggaguccgugacagaacaagacagcaaggauuccaccuacucucugagcuccacacucacccugagcaaggcugacuaugagaaacacaaggucuacgccugugaagugacgcaucaggggcuuucuuccccugugacaaagagcuuuaaccggggagagugc

SEQ ID NO: 38550 - RNA, 1332 nt, Artificial Sequence
  derived and/or modified sequence opt5 from Goilixiab_HeavyChain1
gaggugcagcuggucgaaagcggcgggggacucgccaagcccggcgggucccugagacuuucuugcgcugccagcggauuccgguuuaccuucaacaauuacuaugacuggguucgccaagcgccuggccaggggcuggaguggguguccagaaucucuagcuccggagauccgacaugguacgcugacucugugaaaggccgguuuacgauuagccgcgaaaacgccaagaauacccucuuccugcagaacucccuuagagccgaggauacagcugucuauuacugugccagccugaccacaggcucugacuccugggggcagggagugcucguuaccgugagcucugcuuccacaaaaggccccagcgucuuuccucuggcccccucuuccaagagcaccuccgggggaacggcggcccugggcugccucgugaaagauuauuucccugaacccguuaccgugucuuggaauagcggggcucugacauccggaguccacaccuuuccugccgugcuucaaagcucuggccuguacucccucagcucuguggucacaguuccgagcuccucucugggcacccagacguauaucuguaacgugaaucauaagcccagcaacacaaagguggacaaaaaggucgagccuaaauccugcgauaagacccacacaugucccccuugccccgcuccggagcuucugggaggaccuagcguguuccucuuucccccuaaacccaaggacacccugauuucucggacccccgaaguuacauguguggucguggauguuucccaugaggacccugaagugaaguucaauugguacgucgauggcguggagguccacaacgccaaaacgaagccgcgcgaggaacaguacaauagcaccuauagagugguuucugugcugacaguccuccaucaggacuggcugaacgggaaagaguacaagugcaaaguguccaauaaggcgcuucccgccccuaucgaaaagaccauuagcaaggcuaagggacaaccccgggagccucagguuuauacacugcccccgucccgcgaugaacucaccaaaaaccaggugucucugacgugucuugucaagggcuuuuacccuagcgacaucgccguggagugggaguccaaugggcagcccgaaaacaacuauaaaacaaccccucccgugcuggacucugaugggagcuucuuucucuacuccaagcugaccguugacaaaagcagauggcaacagggcaaugucuucucuugcuccgugcacgaggcucugcacaaccauuauacacagaaaagccucucucuguccccuggcaag

SEQ ID NO: 38551 - RNA, 639 nt, Artificial Sequence
  derived and/or modified sequence opt5 from Goilixiab_LightChain1
gacauccagacccaaagccccuccucucugagcgccuccgugggcgaucgggucacaauuacgugccgggcuucucaggacauccgcuacuaucucaacugguaccagcagaagccugggaaagccccgaagcugcuuauuuauguugcgagcucccugcaaucuggagugcccagcagauucuccggcagcgggucuggaaccgaguuuacacucaccguguccagccugcagccugaagauuucgcuacauacuauugucuucaggucuacucuacaccccggaccuuuggccaggggaccaaaguggagaucaagcgcacgguugccgccccuuccguguucauuuuucccccuagcgacgaacaacugaaaucuggaaccgcuuccgucgugugccuccugaauaacuucuauccgagagaggccaagguucaguggaagguggauaaugcucugcagagcggcaacucccaggaaucugucacagagcaagacagcaaagauuccaccuacagccucucuuccacacugacccuuagcaaggccgacuacgagaaacacaagguguaugcgugugaagugacgcaucagggccugucuagccccgucacaaaauccuuuaauagaggggagugc

SEQ ID NO: 38552 - RNA, 1338 nt, Artificial Sequence
  derived and/or modified sequence opt5 from Guselkumab_HeavyChain1
gaggugcagcugguccaaagcggcgccgaaguuaagaaacccggggagucccucaagaucucuugcaaaggaagcggcuacuccuucucuaacuauuggauugggugggugagacagaugccuggaaagggccuggaauggauggggaucauugacccgagcaauuccuacacccgguauucucccagcuuucagggacaggugacaaucuccgcugauaaaagcauuucuacggccuaccuucaaugguccagccugaaggcgucugacaccgcuauguauuacugugcccgcugguauuacaagccuuucgaugucuggggccagggcacacucgugaccguuuccagcgccucuacaaaagggcccuccguguuuccucuggcucccagcuccaagucuaccagcggaggcacagccgcucuugggugccuggucaaagacuacuucccugagccggugaccguuuccuggaacagcggagcccucacgucuggcgugcacaccuuucccgcgguccugcaguccagcgggcuguauucucucagcuccguggugacagucccuucuagcucccugggaacccagacauacaucuguaauguuaaccauaagcccagcaauaccaaaguggauaagaagguggaaccuaaaucuugcgacaagacgcacacaugucccccgugcccugcccccgagcuucugggcggcccuuccgucuuccucuuuccgcccaaaccuaaggauacccugaugaucagcagaacaccggaggugaccuguguuguggucgacgugucucaugaagaucccgagguuaaauucaacugguauguggacggggucgaagugcacaaugcuaagaccaaaccucgggaggagcaauacaacuccacauaucgcgucgugagcguucuuacggugcugcaucaggauuggcucaauggaaaggaauacaagugcaaagucuccaacaaggcccugcccgcuccuauugagaaaaccaucucuaaggccaaaggccagcccagagaaccccagguguauacacugccucccagccgggacgagcucaccaagaaucaaguuucccugacaugucuugugaagggguuuuacccuucugauauugcggucgaaugggagagcaacggacagcccgagaauaacuacaaaaccacgccucccgugcuggacuccgacggcagcuucuuucucuauucuaagcugacaguggauaaaucccgcuggcagcaagggaauguuuucagcugcucugucaugcacgaagcccuucacaaccauuacacccagaagucccugagccucucuccggga

SEQ ID NO: 38553 - RNA, 651 nt, Artificial Sequence
  derived and/or modified sequence opt5 from Guselkumab_LightChain1
cagagcgugcugacccaacccccuuccgucucuggcgccccggggcagagaguuacaaucagcugcacgggauccucuagcaacauuggcuccggguacgacgugcacugguaucagcagcuccccggaaccgcuccuaagcugcuuaucuacggcaauucuaaacggcccagcggggugccugaucgcuucuccggaagcaagucuggcacauccgccagccuggcgauuaccggccuccaaucugaggacgaagcugauuauuacugugccuccuggacagacgggcugagccuugucguguuuggaggcgggaccaaacugacaguucucggacagcccaaggccgcuccuucugugacccuguucccgcccuccagcgaggaacugcaggccaacaaagcuacgcucgucugccugaucuccgauuuuuauccuggcgccgugaccguugcguggaaggccgacucuagccccgugaaggcuggggucgagacaaccacaccuuccaaacagagcaauaacaaguacgccgcuucuuccuaucuuagccugacccccgaacaauggaaaucucauagaagcuacuccugucaggugacgcacgagggaucuacaguggagaagaccgucgccccgacagaaugcagc

SEQ ID NO: 38554 - RNA, 360 nt, Artificial Sequence
  derived and/or modified sequence opt5 from HuMab-001_HeavyChain_VDJ-Region
caggugcaacugcagcaguggggcgccgggcuccugaagcccagcgagacccuuucccugacaugcgcugucuacggaggcucuuucagcggguauuacuggaacuggaucagacagccuccgggaaaaggccucgaauggauuggggagaucaaucacuccggaucuacgaacuauaaucccagccugaagucccggguuaccauuucuguggacacaagcaaaaaccaauuuucccuuaagcugagcucugugaccgccgcggauacagcugucuacuauugugcccgcggcaauuacggcuccggguauuacuacuucgaccucuggggaagaggcacccaggugacaguuagcucu

SEQ ID NO: 38555 - RNA, 321 nt, Artificial Sequence
  derived and/or modified sequence opt5 from HuMab-001_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuucgcugccagcucccuucaaagcggaguucccucucgcuuuuccggcagcgggucuggaaccgacuucacacugaccaucuccagccuccagccugaagauuuugccacauauuacugucagcaguauauuucuuuccccaucaccuuuggccaagggacaagacuggagaucaaa

SEQ ID NO: 38556 - RNA, 366 nt, Artificial Sequence
  derived and/or modified sequence opt5 from HuMab-005_HeavyChain_gamma-Chain_VDJ-Region
gaggugcagcugguccaaagcggcgccgaaguuaagaaacccggggagucccucaagaucucuugcaaagcuagcggauacuccuuccacuuuuauuggauuggcugggugagacagaugccugggaagggacuggaauggaugggcucuaucuacccgggggacagcgauacccgguaucgccccuccuuccagggacaggugacaauuucugccgacaaaagcaucuccacggcguaccuucaauggaccagccugaaggcuucugauacagccauuuauuacugugccagacagcggggcgacuauuacuacuuuuauggcauggaugucugggggcagggaaccacagugaccguuuccagc

SEQ ID NO: 38557 - RNA, 321 nt, Artificial Sequence
  derived and/or modified sequence opt5 from HuMab-005_LightChain_VJ-Region
gagaucgugcugacccagagccccggcacacucucccugucuccuggggaaagagccacgcuuagcugccgggcuucccaaucugucagcuccucuuaccuggccugguaucagcagaagccgggacagguuccccgccuccugauuuacggcgcgagcuccagagcuaccgggaucccugaccgguucagcggaucuggcuccgggacagauuuuacccuuacaauuagccgccuggagcccgaagacuucgccguguauuacugucaacaguauggaucuucccucaccuuuggcggcgggacaaaaguggagaucaag

SEQ ID NO: 38558 - RNA, 357 nt, Artificial Sequence
  derived and/or modified sequence opt5 from HuMab-006_HeavyChain_VDJ-Region
gaggugcagcugcucgaaagcggcgggggacugguccaacccggcgggucccuuagacugucuugcgccgcuagcggauucaccuuuuccaauuacgcccucaucuggguucggcaggcgccuggcaaggggcuggagugggugucuauuauccgcggaggcgcuggcagcacauauuacgccgacuccgugaaagggagauucacgauuucucgggauaauagcaagaacacccuuuaucugcagaugaacucccuccgcgccgaagacacagcugucuacuauugugccaaagcuagaaucuggggaccgcuguuugauuacuggggccaggggacccuggugacaguuagcucu

SEQ ID NO: 38559 - RNA, 324 nt, Artificial Sequence
  derived and/or modified sequence opt5 from HuMab-006_LightChain_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuccccucaccuuuggcgggggaacaaaaguggagaucaag

SEQ ID NO: 38560 - RNA, 360 nt, Artificial Sequence
  derived and/or modified sequence opt5 from HuMab-019_HeavyChain_VDJ-Region
caggugcaacugcagcaguggggcgccgggcuccugaagcccagcgagacccuuucccugacaugcgcugucuacggaggcucuuucagcgacuauuacuggaacuggaucagacagccuccggggaaaggacucgaauggauuggcgagauccaccauguuggguccacgaauuauaaccccucucuuaagagccgggugaccauuuccguggauacaucuaaaagccaauuuucccugaagcugagcucugucaccgccgcggacacagcuguguacuauugugcccgcggauacuaugauuccggcguuuacuacuucgacuauugggcccagggcacccucgugacagucagcucu

SEQ ID NO: 38561 - RNA, 360 nt, Artificial Sequence
  derived and/or modified sequence opt5 from HuMab-021_HeavyChain_VDJ-Region
caggugcaacugcagcaguggggcgccgggcuccugaagcccagcgagacccuuucccugacaugcgcugucuacggaggcucuuucagcgacuauuacuggaacuggaucagacagccuccggggaaaggacucgaauggauuggcgagauccaccauuccgggucuacgaauuauaaccccagccugaagucccggguuaccauuucuguggauacaagcaaaaaucaauuuucccuuaagcugagcucugugaccgccgcggacacagcugucuacuauugugcccgcggauacuaugccuccggcguguacuacuucgauuauuggggccaggggacccucguuacagugagcucu

SEQ ID NO: 38562 - RNA, 321 nt, Artificial Sequence
  derived and/or modified sequence opt5 from HuMab-021_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccauuaccuuuggccaagggacaagacuggagaucaaa

SEQ ID NO: 38563 - RNA, 360 nt, Artificial Sequence
  derived and/or modified sequence opt5 from HuMab-025_HeavyChain_VDJ-Region
caggugcaacugcagcaguggggcgccgggcuccugaagcccagcgagacccuuucccugacaugcgcugucuacggaggcucuuucagcgacuauuacuggaacuggaucagacagccuccggggaaaggacucgaauggauuggcgagauccaccauuccgggucuacgaauuauaaccccagccugaagucccggguuaccauuucuguggauacaagcaaaaaucaauuuucccuuaagcugagcucugugaccgccgcggacacagcugucuacuauugugcccgcggauacuaugauuccggcguguacuacuucgacuauugggcccagggcacccucguuacagugagcucu

SEQ ID NO: 38564 - RNA, 321 nt, Artificial Sequence
  derived and/or modified sequence opt5 from HuMab-025_LightChain_VJ-Region
gacauccagaugacccaaagccccuccucucugagcgccuccgugggcgauagagucacaauuacgugccgggcuucucaggggaucagccgcuggcucgccugguaccagcagaagccugagaaagcgccgaagucccugauuuaugcugccucuagccuuagauccggaguucccagccgguucucuggcuccgggagcggaaccgacuuuacacugaccaucucuucccuccaaccugaagauuucgccacauacuauugucagcaguacaacagcuaucccauuaccuuuggccaggggacacgccuggagaucaaa

SEQ ID NO: 38565 - RNA, 360 nt, Artificial Sequence
  derived and/or modified sequence opt5 from HuMab-027_HeavyChain_VDJ-Region
caggugcaacugcagcaguggggcgccgggcuccugaagcccagcgagacccuuucccugacaugcgcugucuacggaggcucuuucagcgacuauuuuuggaacuggaucagacagccuccggggaaaggacucgaauggauuggcgagauccaccauuccgggucuacgaauuacaaccccagccugaagucccggguuaccauuucuguggauacaagcaaaaaucaauucucccuuaaccugagcucugugaccgccgcggacacagcugucuauuacugugcccgcggacucaucggcuccggcuauuacuauuuugauuacugggaccaggggacccuggugacaguuagcucu

SEQ ID NO: 38566 - RNA, 360 nt, Artificial Sequence
  derived and/or modified sequence opt5 from HuMab-032_HeavyChain_VDJ-Region
caggugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagaucaaccacucuggagacacgaauuauaaccccagccugaccucccggguuacaauuucuguggauaccagcaagaaucaauuuucccuuaaacugagcucugugacagccgcggacaccgcugucuacuauugugcccgccucuucuacggcuccggcaucuauuacuuugauuacugggggcagggaacacuggugaccguuagcucu

SEQ ID NO: 38567 - RNA, 321 nt, Artificial Sequence
  derived and/or modified sequence opt5 from HuMab-032_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcuaccuuccgccuucaaagcggaguucccuccagauuuagcggcucuggguccggaacagacuucacccugacaaucagcucucuccagccugaagauuuugccaccuacuauugucagcaguacaacuccuuucccccuacauucggccaagggaccaaaguggagauuaag

SEQ ID NO: 38568 - RNA, 363 nt, Artificial Sequence
  derived and/or modified sequence opt5 from HuMab-033_HeavyChain_VDJ-Region
caggugcaacuggucgagagcggcgggggaguugugcagaccggcagaucccuccggcugucuugcgccgcuagcggguucacauuuuccucucacgccaugcauugggugcgccaggcgcccggaaagggccuugaaugggucgcugccaucagcuacgacggguccaacaaauauuacgccgauucugugaagggaagauucacgauuagccgggacaauuccaaaaacacccuguaucuccagaugaauagccugcgcgcugaggauacagccguuuacuauugugcuagaggcgacuacaucucuuccagcggcguguuugauuauugggggcaaggaacccuugucacagugucuucc

SEQ ID NO: 38569 - RNA, 360 nt, Artificial Sequence
  derived and/or modified sequence opt5 from HuMab-035_HeavyChain_VDJ-Region
caggugcaacugcagcaguggggcgccgggcuccugaagcccagcgagacccuuucccugacaugcgcuaucuacggaggcucuuucagcggguauuacugguccuggauuagacagccuccgggaaaaggccucgaauggaucggggagauuaaccacucuggagacacgaauuauaaccccagccugaccucccgggucacaaucucuguugauaccagcaagaaucaauuuucccuuaaacugagcucugugacagccgcggacaccgcuguguacuauugugcccgccucuucuacggcuccggcauuuauuacuuugauuacugggggcagggaacacuggucaccgugagcucu

SEQ ID NO: 38570 - RNA, 360 nt, Artificial Sequence
  derived and/or modified sequence opt5 from HuMab-036_HeavyChain_VDJ-Region
caggugcaacugcagcaguggggcgccgggcuccugaagcccagcgagacccuuucccugacaugcgcugucuacggaggcucuuucagcgacuauuacugguccuggaucagacagccuccggggaaaggacucgaauggauuggcgagaucaaccacucugggagcacgaauuauaaccccucccugaagucucggguuaccauuagcguggauacauccaaaaaucaauuuagccuuaagcugucuuccgugaccgccgcggacacagcugucuacuauugugcccgccucuacuauggaagcggcaccuacuacuucgauuauuggggccaggggacacuggugaccguuucuucc

SEQ ID NO: 38571 - RNA, 321 nt, Artificial Sequence
  derived and/or modified sequence opt5 from HuMab-036_LightChain_VJ-Region
gacauccagaugacccaaagccccuccucucugagcgccuccgugggcgauagagucacaauuacgugccgggcuucucaggggaucagcuccuggcucaccugguaccagcagaagccugagaaagccccgaagucucugauuuaugcggcuagccgccuucaauccggaguucccagcagauucucuggcuccgggagcggaacagacuuuacccugacaaucucuucccuccagccugaagauuucgccaccuacuauugucagcaguacaacagcuuucccccuacauucggccaagggaccaaaguggagauuaag

SEQ ID NO: 38572 - RNA, 366 nt, Artificial Sequence
  derived and/or modified sequence opt5 from HuMab-041_HeavyChain_VDJ-Region
gaggugcagcugguccaaagcggcgccgaaguuaagaaacccggggagucccucaagaucucuugcaaaggaagcggcuacuccuucaccucuuauuggauugggugggugagacagaugccuggaaagggccuggaauggauggggagcaucuacccgggagacucccacacacgguaucgccccucuuuucagggccaggugacgauuagcgcugauaaauccaucagcaccgccuaccuucaauggucuucccugaaggcgagcgacacagcuauguauuacugugccagacagaagggcgauuucuauuacuuuuucgggcucgacgucuggggacagggcaccgccauuacagugucuucc

SEQ ID NO: 38573 - RNA, 366 nt, Artificial Sequence
  derived and/or modified sequence opt5 from HuMab-044_HeavyChain_VDJ-Region
gaggugcagcugguccaaagcggcgccgaaguuaagaaacccggggagucccucaagaucucuugcaaaggaagcggcuacagauucuccucuuauuggauugggugggugcggcagaugccuggaaagggccuggaauggauggggagcaucuuuccgggagacuccgauacccgcuacucucccagcuuccagggccaggugacaauuuccgcugacaaaagcaucacgaccgccuaucuucaauggucuucccugaaggcgagcgauacagcuauguacuauugugccagacaggccggcgacuacuauuacuacaacgggauggaugucuggggacagggcaccacagugaccguuucuucc

SEQ ID NO: 38574 - RNA, 357 nt, Artificial Sequence
  derived and/or modified sequence opt5 from HuMab-049_HeavyChain_VDJ-Region
gaggugcagcugcucgaaagcggcggggaccugguccaacccggaggcucccuuagacugucuugcgccgcuagcggguucaccuuuuccucuuacgccaugagcuggguucggcaggcgccuggaaagggccucgaguggguguccgcuaucucugggcgcggaggcacaacguauuacgccgauagcgugaaaggcagauucaccauuucccgggacaacagcaagucuacacugugucuucagaugaacucccugcgcgccgaagauaccgcugucuauuacugcgccaaagcuagagccaauugggacuauuuugauuacugggggcagggaacacucgugaccguuagcucu

SEQ ID NO: 38575 - RNA, 321 nt, Artificial Sequence
  derived and/or modified sequence opt5 from HuMab-049_LightChain_VJ-Region
gacauccagaugacccaaagccccuccucugugagcgccuccgucggcgauagaguuacaauuacgugccgggcuucucaggggaucagcuccuggcuggccugguaccagcacaagccuggaaaagcgccgaagcuccugauuuaugcugccucuauccuucagagcggcgugcccucccgcuucagcgggucuggauccggcaccgacuuuacacugaccauuagcucucucagaccugaggauuucgccacauacuauugucaacaggcuaacuccuuucccaucaccuucgggcagggaacacggcuggaaaucaaa

SEQ ID NO: 38576 - RNA, 357 nt, Artificial Sequence
  derived and/or modified sequence opt5 from HuMab-050_HeavyChain_VDJ-Region
gaggugcagcugcucgaaagcggcgggggacugguccaacccggcgggucccuuagacugucuugcgccgcuagcggauucaccuuuuccucuuacgccaugaacuggguucggcaggcgccuggcaaggggcucgagugggugagcgcuaucuccggacgcggcggcacaacguauuacgccgacucugugaaagggagauucaccauuagccgggauaauuccaagaacacacuguaucuucagaugagcucucugcgcgccgaagacaccgcugucuacuauugugccaaagcuagagccaauugggauuacuuugacuauuggggacagggcacacucgugaccguuuccagc

SEQ ID NO: 38577 - RNA, 321 nt, Artificial Sequence
  derived and/or modified sequence opt5 from HuMab-050_LightChain_VJ-Region
gacauccagaugacccaaagccccuccucugugagcgccuccgucggcgauagaguuacaauuacgugccgggcuucucaggggaucagcuccuggcuggccugguaccagcacaagccuggaaaagcgccgaagcuccugauuuaugcugccucuauccuucagagcggcgugcccucccgcuucagcgggucuggauccggcaccgacuuuacacugaccauuagcucucuccaaccugaggauuucgccacauacuauugucagcaggcuaacuccuuucccaucaccuucgggcagggaacaagacuggaaaucaaa

SEQ ID NO: 38578 - RNA, 360 nt, Artificial Sequence
  derived and/or modified sequence opt5 from HuMab-054_HeavyChain_VDJ-Region
caggugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagauccaccauucuggaagcacgaacuauaaucccucccugaagucucggguuaccauuagcguggacacauccaaaaaccaauuuagccuuaagcugucuuccgugaccgccgcggauacagcugucuacuauugugcccgccucugguacggcagcggcucuuauuacuucgacuacugggggcagggaacccuggugacaguuuccagc

SEQ ID NO: 38579 - RNA, 321 nt, Artificial Sequence
  derived and/or modified sequence opt5 from HuMab-054_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuuucccccuaccuucggcgggggaacaaaaguggagauuaag

SEQ ID NO: 38580 - RNA, 357 nt, Artificial Sequence
  derived and/or modified sequence opt5 from HuMab-055_HeavyChain_VDJ-Region
gaggugcagcugcucgaaagcggcgggggacugguccaacccggcgggucccuuagacugucuugcgccgcuagcggauucaccuuuuccucuuacgccaugaacuggguucggcaggcgccuggcaaggggcucgagugggugagcgcuaucuccggacgcggcggcacaacguauuacgccgacucugugaaagggagauucaccauuagccgggauaauuccaagagcacacugugucuucagaugaacucucugcgcgccgaagacaccgcugucuauuacugcgccaaagcuagagccaauugggauuauuuugacuacuggggacagggcacacucgugaccguuuccagc

SEQ ID NO: 38581 - RNA, 366 nt, Artificial Sequence
  derived and/or modified sequence opt5 from HuMab-059_HeavyChain_VDJ-Region
caggugcaacugguccagagcggcgccgagguuaagaaacccggggcuuccgugagagugccuugcaaggccucuggauacaccuucacacgguauggcaucagcuggguccgccaggcgccggggcagggacucgaauggaugggcuggauuuccgcuuacaacgggaaaacguauuacgcccaaaagcugcagggaagagugaccaugacaaccgacacaucuaccagcacagccuauauggagcuucggucccugcgcucugaugacaccgcuguuuacuauugugccagaagcccccuccugugguuugaggaacuuuacuucgauuacuggggccagggcacgcuggugaccgucuccagc

SEQ ID NO: 38582 - RNA, 324 nt, Artificial Sequence
  derived and/or modified sequence opt5 from HuMab-059_LightChain_VJ-Region
gagaucgugcugacccagagccccggcacacucucccugucuccuggggaaagagccacgcuuagcugccgggcuucccaaucugucagcuccaccuaccuggccugguaucagcagaagccgggacaggcgccccgccuccugauuuacggcgcuucuagcagagccacagggaucccugaccgguucuccggaagcggcucugggaccgauuuuacacuuaccauuucccgccuggagcccgaagacuucgccguuuauuacugucaacaguauggaacaagccucuuuaccuucggcccuggcacgaaaguggauaucaag

SEQ ID NO: 38583 - RNA, 366 nt, Artificial Sequence
  derived and/or modified sequence opt5 from HuMab-060_HeavyChain_VDJ-Region
gaggugcagcugguccaaagcggcgccgaaguuaagaaacccggggagucccucaagaucucuugcaaaggaagcggcuacagauucaccuccuauuggauugggugggugcggcagaugccuggaaagggccuggaauggauggggucuaucuacccgggagacagcuauacacgcaacucccccucuuuucagggccaggugacgauuagcgcugauaaauccaucgccaccgcguaccuucaauggaauagccugaaggcuucugacacagccauguauuacugugccagacacgcuggcgauuucuauuacuuugacgggcucgaugucuggggacagggcaccacagugaccguuuccagc

SEQ ID NO: 38584 - RNA, 327 nt, Artificial Sequence
  derived and/or modified sequence opt5 from HuMab-060_LightChain_VJ-Region
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccucccaucaccuuuggccagggcacaagacucgagauuaaa

SEQ ID NO: 38585 - RNA, 366 nt, Artificial Sequence
  derived and/or modified sequence opt5 from HuMab-067_HeavyChain_VDJ-Region
gaggugcagcugguccaaagcggcgccgaaguuaagaaacccggggagucccucaagaucucuugcaaaggaagcggcuacuccuucaccucuuauuggauugggugggugagacagaugccuggaaagggccuggaauggauggggaucauuuacccgggagacagcgauacacgguauucccccucuuuucagggccaggugacgaucagcgucgacaaauccauuagcaccgcuuaccuucaauggucuucccugaaggccagcgauacagcgauguauuacugugcucgccagaagggcgacuauuacuaccacuaugggcucgauguguggggacagggcaccacaguuaccgugucuucc

SEQ ID NO: 38586 - RNA, 366 nt, Artificial Sequence
  derived and/or modified sequence opt5 from HuMab-072_HeavyChain_VDJ-Region
gaggugcagcugguccaaagcggcgccgaaguuaagaaacccggggagucccucaagaucucuugcaaaggaagcggcuacuccuucaccucuuauuggauugggugggugagacagaugccuggaaagggccuggaauggauggggaucauuuacccgggagacagcgauacacgguauucccccucuuuucagggccaggugacgaucagcgcugacaaauccauuagcaccgccuaccuucaauggucuucccugaaggcgagcgauacagcuauguauuacugugcccgccagaagggcgacuauuacuacuucaacgggcucgaugucuggggacagggcaccacagugaccguuucuucc

SEQ ID NO: 38587 - RNA, 327 nt, Artificial Sequence
  derived and/or modified sequence opt5 from HuMab-072_LightChain_VJ-Region
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccuagacucaccuuuggcggcgggacaaaaguggagaucaag

SEQ ID NO: 38588 - RNA, 363 nt, Artificial Sequence
  derived and/or modified sequence opt5 from HuMab-084_HeavyChain_VDJ-Region
caggugcaacugguccagagcggcgccgagguuaagaaacccggguccucugugaaggugagcugcaaggcuuccggaggcaccuucagaacauacgccaucaacuggguccggcaggcgccugggcagggacucgaauggaugggccgcauuaauacggugcuggggaucguuaaccacgcucaaaaauuucagggaagagugaccauuacagccgacaaaucuaccaauacagccuauauggagcuuaacagccugcgguccgaagauaccgcugucuacuauugugcccgcgagaagggcguggacuacuauuacggcaucgaaguuugggggcagggaacaaccgugacggucucuagc

SEQ ID NO: 38589 - RNA, 321 nt, Artificial Sequence
  derived and/or modified sequence opt5 from HuMab-084_LightChain_VJ-Region
gacauccagaugacccaaagccccuccucugugagcgccuccgucggcgauagaguuacaauuacgugccgggcuucucaggggaucagcuccuggcuggccugguaccagcacaagccuggaaaagcgccgaagcuccugauuuauguggcuucuacccuucagagcggcgugcccucccgcuucagcgggucuggauccggcacagacuuuacccugacaaucagcucucuccaaccugaggauuucgccaccuacuauugucagcaggccaacuccuuuccccugacauucgggggaggcaccaaagucgaaauuaag

SEQ ID NO: 38590 - RNA, 360 nt, Artificial Sequence
  derived and/or modified sequence opt5 from HuMab-091_HeavyChain_VDJ-Region
caggugcaacugcagcaguggggcgccgggcuccugaagcccagcgagacccuuucccugacaugcgcugucucuggaggcagcuucuccggguacuauuggacguggaucagacagccuccgggaaaaggccucgaauggauuggggagaucuaccacucuggagacaccaacuauaaucccagccugaagucccggguuacaauuucuguggauaccagcaaaaaccaauuuucccuuaagcuguacagcgugacagccgcggacaccgcugucuauuacugugcccgccucuauuucggcucuggcaucuacuaccuggauuauugggggcagggaacacuggugaccguuuccagc

SEQ ID NO: 38591 - RNA, 321 nt, Artificial Sequence
  derived and/or modified sequence opt5 from HuMab-091_LightChain_VJ-Region
gacauccagaugacccaaagccccuccucucugagcgccuccgugggcgauagagucacaauuacgugccgggcuucucaggggaucagcuccuggcucguuugguaccagcagaagccugagaaagccccgaagucucugauuuaugcggcuagcucccuucaaagcggagugcccucucgcuucuccggcagcgggucuggaaccgacuuuacacugaccaucuccagccuccagccugaagauuucgccacauacuauugucagcaguacaacucuuuucccccuaccuucggccaagggacaaaaguggagauuaag

SEQ ID NO: 38592 - RNA, 366 nt, Artificial Sequence
  derived and/or modified sequence opt5 from HuMab-093_HeavyChain_VDJ-Region
gaggugcagcugguccaaagcggcgccgaaguuaagaaacccggggagucccucaagaucucuugcaaaggaagcggcuacuccuucaccucuuauuggauugggugggugagacagaugccuggaaagggccuggaauggauggggcggaucuacccgggagacagcgauacacgcuauucccccucuuuucagggccaggugacgauuagcgcugacaaauccaucaccacagccuaccuucaauggagcucucugagagcguccgauaccgcuauguauuacugugcccggcagcgcggcgacuauuacuacuucuuugggcucgauauuuggggacagggcacaaccgucacagugagccug

SEQ ID NO: 38593 - RNA, 372 nt, Artificial Sequence
  derived and/or modified sequence opt5 from HuMab-098_HeavyChain_VDJ-Region
gaggugcagcugcucgaaagcggcgggggacugguccaacccggcgggucccuuagacugucuugcgccgcuagcggauucaccuuuuccaauuacggcaugucuuggguucggcaggccccugggaagggacucgagugggugagcgcgaucuccggcucugcuuauagcacauacuaugccgacuccgugaaaggccgcuucacgauuagcagagauaauucuaagaacacccuguggcuucagaugaacucccugcgggccgaagacacagcugucuacuauugugccaaagcucacuaccaugggagcggaucuuauuacacccucuuugauuacuggggccaggggacacuggugaccguuuccagc

SEQ ID NO: 38594 - RNA, 321 nt, Artificial Sequence
  derived and/or modified sequence opt5 from HuMab-098_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccuacaccuuuggccaagggacaaaacuggagauuaag

SEQ ID NO: 38595 - RNA, 372 nt, Artificial Sequence
  derived and/or modified sequence opt5 from HuMab-100_HeavyChain_VDJ-Region
gaggugcagcugcucgaaagcggcgggggacugguccaacccggcgggucccuuagacugucuugcgccgcuagcggauucaccuuuaauaauuacggcaugaacuggguucggcaggccccugggaagggacucgaguggguguccgcgaucucuggcacaggcuauagcacguacuaugcugacuccgugaaagggcgcuucaccauuucuagagauaauagcaagaacacacuguaccuucagaugaacucccugcgggccgaagacaccgccgucuauuacugugcuaaagcccacuauuuuggaagcggcucuuacuacacacucuucgauuauugggggcagggaacccuggugacaguuuccagc

SEQ ID NO: 38596 - RNA, 372 nt, Artificial Sequence
  derived and/or modified sequence opt5 from HuMab-106_HeavyChain_VDJ-Region
gaggugcagcugguccaaagcggcgccgaaguuaagaaacccggggagucccucaagaucucuugcaaaggaagcggcuacuccuucaccagauauuggauugggugggugcggcagaugccuggaaagggccuggaauggauggggaucauuuacccgggagacucugauacacgcuauagccccuccuuucagggccaggugacgaucucugcugacaaaagcauuuccaccgccuaccuucaauggagcucucugaaggcguccgauacagcuauguauuacugugccagacucaccggcgaccggggguucgauuauuacagcggaauggacgucuggggccaggggacaaccgugacaguuucuucc

SEQ ID NO: 38597 - RNA, 321 nt, Artificial Sequence
  derived and/or modified sequence opt5 from HuMab-106_LightChain_VJ-Region
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccuuuaccuucggcccuggcacaaaaguggauaucaag

SEQ ID NO: 38598 - RNA, 351 nt, Artificial Sequence
  derived and/or modified sequence opt5 from HuMab_10F8_HeavyChain_V-Region
caggugcaacuggucgagagcggcgggggaguugugcagcccggcagaucccuccggcugucuugcaccgccagcggguucacauuuucccacuacggaauguauugggugcgccaggcuccuggcaaggggcuugaaugggucgccgugaucugguacgacggaucuuaugaguacaacgaagauagcguuaaaggcagauucacgauuucccgggacaauucuaagaacacccuguaucuccagaugaauagccugcgcgcggaggauacagcuguguacuauugugccagagaccgggucggccuuuuugauuacugggggcaaggaacccuggugacaguuuccagc

SEQ ID NO: 38599 - RNA, 408 nt, Artificial Sequence
  derived and/or modified sequence opt5 from HuMab_10F8_HeavyChain_V-Region_Precursor
auggaguucggccugagcuggguguuucucgucgcccugcuuagagggguucagugccaagugcagcugguggaauccggaggcggggucgugcagcccggacggucucuccgccugagcuguaccgcuuccggcuucacauuuucucacuacgggauguauuggguuagacaggccccuggaaagggccuugaguggguggcggucaucugguacgacggcagcuaugaauacaaugcugauuccgugaaagggcgguucacgauuucucgcgacaauagcaagaacacccuguaucuccaaaugaacucccugagagccgaggauacagccguuuacuauugcgcucgggaccgcgugggacuguuugauuacuggggccaggggacccucgucacagugagcucu

SEQ ID NO: 38600 - RNA, 321 nt, Artificial Sequence
  derived and/or modified sequence opt5 from HuMab_10F8_LightChain_V-Region
gagaucgugcugacccagagccccggcacacucucccugucuccuggggaaagagccacgcuuagcugccgggcuucccaaucuauuagcuccucuuaccuggccugguaucagcagaagccgggacaggcgccccgccuccugaucuacggcccuagcuccagagcuaccgggauucccgaccgguucagcggaucuggcuccgggacagauuuuacccuuacaaucagccgccuggagccugaagacuucgccgucuauuacugucaacaguaugccggaucucucaccuuuggccccggcacaaaaguugauauuaag

SEQ ID NO: 38601 - RNA, 381 nt, Artificial Sequence
  derived and/or modified sequence opt5 from HuMab_10F8_LightChain_V-Region_Precursor
auggagacccccgcccagcuccuguuccugcuucugcucuggcugccugacacaacgggcgaaaucgugcuuacccaaagcccggggacacugucccucucucccggagagagagcuacccugagcugccgggccucccagucuauuagcuccucuuaccuggcgugguaucagcagaagccuggccaagcuccccgccuccugaucuacgggccuagcuccagagccacaggcauucccgaucgguuuagcggaucuggguccggaaccgacuucacacuuaccaucagccgccuggaaccugaggauuuugccgucuauuacugucagcaguaugcuggcucucucacguucggcccggggaccaaaguugacauuaag

SEQ ID NO: 38602 - RNA, 357 nt, Artificial Sequence
  derived and/or modified sequence opt5 from HuMab-111_HeavyChain_VDJ-Region
caggugcaacugguccagagcggcgccgagguuaagaaacccggguccucugugaaggugagcugcaaggcuuccggaggcaccuucucuagcuacgggaucuccugggucagacaggccccuggaccgggccucgaauggauggggcggauuauccccauucugggaaucgcgaacuaugcucagaaauuucaaggccgcgugacaauuacggccgacaaaucuaccaauacagccuacauggagcuuagcucccugagaagcgaagauaccgcuguuuauuacugugcccgggaccaggaguauucuuccaacugguacuauuggggccaggggacacucgugaccgucagcucu

SEQ ID NO: 38603 - RNA, 321 nt, Artificial Sequence
  derived and/or modified sequence opt5 from HuMab-111_LightChain_VJ-Region
gagaucgugcugacccagagccccggcacacucucccugucuccuggggaaagagccacgcuuagcugccgggcuucccaaucuguccgcagcuccuaccuggccugguaucagcagaagccgggacaggcgcccagacuccugauuuacggcgcuucuagccgggccaccgggaucccugaccgcuucuccggaagcggcucugggacagauuuuacccuuacaauuuccagacuggagcccgaagacuucgccguuuauuacugucaacucuauggaagcucuccuaccuuuggccccggcacaaaaguggauaucaag

SEQ ID NO: 38604 - RNA, 363 nt, Artificial Sequence
  derived and/or modified sequence opt5 from HuMab-123_HeavyChain_VDJ-Region
caggugcaacugguccagagcggcgccgagguuaagaaacccggggcuuccgugaaggugucuugcaaagccgcgggauacaccuucacaaacuauggcaucagcugggucagacaggcuccugggcaggcccucgaauggaugggauggauuacgaccuacuccucuaauacaaucuaugcccaaaagcugcagggccgggugaccaugacaaccgacacaagcaccuccacggcuuacauggagcuucgcucucugagaagcgaugacaccgccguuuauuacugugcucgggaucgcguggucgugagaccggacuauuuugauuacugggggcagggaacacucguuaccguguccagc

SEQ ID NO: 38605 - RNA, 321 nt, Artificial Sequence
  derived and/or modified sequence opt5 from HuMab-123_LightChain_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacaccucuaacagagccacaggaaucccugcccgguucagcggcuccgggagcggaaccgauuuuacacuuaccauuucuucccuggagcccgaagacuucgcuguuuauuacugucaacagcgcagccacuggccuagaacauuuggccaggggaccaaaguggagaucaag

SEQ ID NO: 38606 - RNA, 363 nt, Artificial Sequence
  derived and/or modified sequence opt5 from HuMab-124_HeavyChain_VDJ-Region
caggugcaacugguccagagcggcgccgagguuaagaaacccggggcuuccgugaaggugucuugcaaagccgcgggauacaccuucacaaacuauggcaucagcugggucagacaggcuccugggcagggacucgaauggaugggcuggauuaucacguacaaugggaacaccauuuaugcccaacgguuucaggaccgcgugacaaugaccacagauaccuccacaucuaccgccuacauggagcugagaagccuucgguccgacgauacggcuguuuauuacugugcccgcgacagaaucauugugcggccggauuauuucgacuacuggggacagggcacccuggucacagugucuagc

SEQ ID NO: 38607 - RNA, 372 nt, Artificial Sequence
  derived and/or modified sequence opt5 from HuMab-125_HeavyChain_VDJ-Region
gaggugcagcugcucgaaagcggcgggggacugguccaacccggcgggucccuuagacugucuugcgccgcuagcggauucaccuuuacagacuacgccaugaacuggguucggcaggcgccuggcaaggggcucgaguggguguccacgaucucuggaagcggcuaugcuaccuacuaugccgauuccgugaaaggccgcuucacaauuucuagagacaauagcaagaccacacuguaccuucagaugaacucccugcgggccgaagauaccgcugucuauuacugugccaaagggcacacacucggaagcggcucuuauuacacccuguuugacuacugggggcagggaacgcuggugaccguuuccagc

SEQ ID NO: 38608 - RNA, 321 nt, Artificial Sequence
  derived and/or modified sequence opt5 from HuMab-125_LightChain_VJ-Region
gacauccagaugacccaaagccccuccucucugagcgccuccgugggcgauagagucacaauuacgugccgggcuucucaggggaucaacagcuggcucgccugguaccagcagaagccugagaaagcgccgaagucccugauuuaugcugccucuagccuucaauccggaguucccagccgcuucucuggcuccgggagcggaaccgacuuuacacugaccaucucuucccuccagccugaagauuucgccacauacuauugucagcaguacaauagcuaucccuacaccuuuggccaagggacaaaacuggagauuaag

SEQ ID NO: 38609 - RNA, 369 nt, Artificial Sequence
  derived and/or modified sequence opt5 from HuMab-127_HeavyChain_VDJ-Region
gaggugcagcugguccaaagcggcgccgaaguuaagaaacccggggagucccucaccaucucuugcaagggaagcggcuacuccuucucuauuuauuggaucgggugggugagacagaugccuggaaaaggccuggaauggauggggauuaucuuuccgggagacagcgauauucgguacucccccucuuuccagggccaggugacaaucagcgcugacaaguccaucagcacggccuaucuucaauggucuucccugaaagcgagcgauaccgcuauguacuauugugcccgccagccuggcgacuggucucccagacacugguacuuugaucucugggggcggggaacacuggucaccguguccagc

SEQ ID NO: 38610 - RNA, 321 nt, Artificial Sequence
  derived and/or modified sequence opt5 from HuMab-127_LightChain_VJ-Region
gugaucuggaugacccagagccccucccugcucucugccagcacaggcgacagagucacgauuuccugccggaugucucaagggaucagcuccuaccuggcuugguaucagcagaagccuggaaaagccccggagcuucugauuuacgcggcuucuacccuccagagcggcguucccucccgcuucagcgggucuggauccggcacagauuuuacccugacaaucagcuaucuucaaucugaagacuucgccaccuacuauugucagcaguacuauuccuuuccucugacauucgggggaggcaccaagguggagauuaaa

SEQ ID NO: 38611 - RNA, 357 nt, Artificial Sequence
  derived and/or modified sequence opt5 from HuMab-129_HeavyChain_VDJ-Region
caggugcaacuggucgagagcggcgggggaguugugcagcccggcagaucccuccggcugucuugcgccgcuagcggguucaccuuuuccacauucgccauccacugggugcgccaggcgccuggaaagggccuugaaugggucgcugugauuucuuacgacgggggacauaaauuuuaugccgauagcguuaagggcagauucacgaucucccgggacaacucuaaaaauacccuguaccuccagaugaacagccugcgcgccgaggauacagcuauguauuacugugccagaggccuugggguguggggagcuuuugacuauuggggccaagggacccuggucacaguguccagc

SEQ ID NO: 38612 - RNA, 318 nt, Artificial Sequence
  derived and/or modified sequence opt5 from HuMab-129_LightChain_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauugguggaccuuuggccaggggacaaaaguggagaucaag

SEQ ID NO: 38613 - RNA, 375 nt, Artificial Sequence
  derived and/or modified sequence opt5 from HuMab-132_HeavyChain_VDJ-Region
caggugcaacugguccagagcggcgccgagguuaagaaacccggggcuuccgugaaggugucuugcaaagccagcggauacaccuucacauccuauggcaucucuugggucagacaggcgccugggcagggacucgaauggaugggcuggauuagcgcuuacaacggaaauuccaacuaugugcaaaaguuucaggggcggguuacgaugaccacagacaccacaaccucuacagccuacauggagcugcgcagccuuaccuccgaugacacggccguguauuacugugcuagagaauauagcuacgauucuggcaccuacuucuauuacggcauggacgucugggggcagggaacaaccgugacaguuuccagc

SEQ ID NO: 38614 - RNA, 324 nt, Artificial Sequence
  derived and/or modified sequence opt5 from HuMab-132_LightChain_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuauguauaccuuuggccaggggacaaaacucgagaucaag

SEQ ID NO: 38615 - RNA, 360 nt, Artificial Sequence
  derived and/or modified sequence opt5 from HuMab-143_HeavyChain_VDJ-Region
caggugcaacugcagcaguggggcgccgggcuccugaagcccagcgagacccuuucccugacaugcgcugucuacggaggcucuuucagcggguauuacuggaacuggaucagacagccuccgggaaaaggccucgaauggauuggggagauccaccauuccggaucugccaauuauaaccccagccugaugucccggguuacgauuucuguggacaccagcaagaaucaauuuucccuucagcugagcucugugacagcggcugauaccgccgucuacuauugugcccgcggcuacuauggcuccggguacuacuauuucgacuacuggggacagggcacacucgugaccguuagcucu

SEQ ID NO: 38616 - RNA, 321 nt, Artificial Sequence
  derived and/or modified sequence opt5 from HuMab-143_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagccgccuucaauccggaguucccagcagauucucuggcuccgggagcggaaccgacuuuacacugaccaucucuucccuccagccugaagauuucgccacauacuauugucagcaguacaacagcuaucccauuaccuuuggccaagggacacggcuggagaucaaa

SEQ ID NO: 38617 - RNA, 366 nt, Artificial Sequence
  derived and/or modified sequence opt5 from HuMab-150_HeavyChain_VDJ-Region
gaggugcagcugguccaaagcggcgccgaaguuaagaaacccggggagucccucaagaucucuugcaaaggaagcggcuacuccuucaccucuuauuggauugggugggugagacagaugccuggaaagggccuggaauggauggggagcaucuacccgggagacucccacacacgguaucgccccucuuuucagggccaggugacgauuagcgcugauaaauccaucagcaccgccuaccuucaauggucuucccugaaggcgagcgacacagcuauguauuacugugccagacaggccggcgauuauuacuacuauaacgggauggacgucuggggacagggcaccacagugaccguuucuucc

SEQ ID NO: 38618 - RNA, 321 nt, Artificial Sequence
  derived and/or modified sequence opt5 from HuMab-150_LightChain_VJ-Region
gagaucgugcugacccagagccccggcacacucucccugucuccuggggaaagagccacgcuuagcugccgggcuucccaaucugucagcuccucuuaccugaccugguaucagcagaagccgggacaggcgccccgccuccugauuuacggcgccagcuccagagcuacagggaucccugaccgguucagcggaucuggcuccgggaccgauuuuacacuuaccauuagccgccuggagcccgaagacuucgccguuuauuacugucaacaguauggaucuucccucacauuuggcggcgggaccaaaguggagaucaag

SEQ ID NO: 38619 - RNA, 363 nt, Artificial Sequence
  derived and/or modified sequence opt5 from HuMab-152_HeavyChain_VDJ-Region
caggugcaagucguugagagcggcgggggaguggugcagcccggcagaucccugcggcucucuugcgccgcuagcggguucaccuuuuccucuuacgccaugcacuggguccgccaggcgccuggaaagggccuggaauggguggcuguuaucagcuaugacggguccuacaaauauuacgccgauucugugaagggaagauucacaauuagccgggacaacuccaaaaauacgcuuuaucugcagaugaacagccuccgcgccgaggauaccgcugucuacuauugugccagaggcucuaucacaggcuccaccgggguguuugacuacuggggacaaggcacacugguuaccgugagcucu

SEQ ID NO: 38620 - RNA, 321 nt, Artificial Sequence
  derived and/or modified sequence opt5 from HuMab-152_LightChain_VJ-Region
gacauccagaugacccaaagccccuccucucugagcgccuccgugggcgauagagucacaauuacgugccgggcuucucaggggaucaacagcuggcucgccugguaccagcagaagccugagaaagcgccgaagucccugauuuaugacgcuucuagccuucaauccggaguucccagccgcuucucuggcuccgggagcggaaccgauuuuacacugaccaucucuucccuccagccugaaaauuucgccacauacuauugucagcaguacaacagcuaucccauuaccuuuggccaagggacaagacuggagaucaaa

SEQ ID NO: 38621 - RNA, 363 nt, Artificial Sequence
  derived and/or modified sequence opt5 from HuMab-153_HeavyChain_VDJ-Region
caggugcaacuggucgagagcggcgggggaguugugcagcccggcagaucccuccggcugucuugcgccgcuagcggguucaccuuuuccgacuacgugauccacuggguccgccaggccccuggaaagggccuugaaugggugacaguuauuucuuaugaugggagcaauaaauacuaugcggacuccgugaagggaagauucacgaucucucgggauaauagcaaaaacacccuguaccuccagaugaacucccugagcgcugaggacacagccauguauuacugugcccgcggcggcauuaccgggacaaccggagucuuugauuauuggggccaagggacacuugugaccguuucuucc

SEQ ID NO: 38622 - RNA, 321 nt, Artificial Sequence
  derived and/or modified sequence opt5 from HuMab-153_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugacgcuagcucccuucaaagcggaguucccucucgcuucuccggcagcggguacggaaccgauuuuucucugacaaucuccagccuccagccugaagacuucgccauuuauuacugucagcaguauaaaucuuaccccaucaccuuuggccaagggacaagacuggagaucaag

SEQ ID NO: 38623 - RNA, 378 nt, Artificial Sequence
  derived and/or modified sequence opt5 from HuMab-159_HeavyChain_VDJ-Region
gaggugcagcugguccaaagcggcgccgaaguuaagaaacccggggagucccucaagaucucuugcaaaggaagcggcuacaacuucaccuccuauuggauugggugggugagacagaugccuggaaagggccuggaauggauggggaucauuuacccgggagacucugauacacgguauagccccuccuuucagggccaggugacgaucucugcugacaaaagcauuuccaccgccuaccuucaauggagcucucugaaggcguccgauacagcuauguauuacugugcccgcuggggcaccuauuacgacauccucacaggguacuucaauugguuugauccuuggggacagggcacccuggucacagugagcucu

SEQ ID NO: 38624 - RNA, 321 nt, Artificial Sequence
  derived and/or modified sequence opt5 from HuMab-159_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacuauauuuaccccuggaccuuuggccaagggacaaaaguggagaucaag

SEQ ID NO: 38625 - RNA, 363 nt, Artificial Sequence
  derived and/or modified sequence opt5 from HuMab-160_HeavyChain_VDJ-Region
caggugcaacuggucgagagcggcgggggaguugugcagcccggcagaucccuccggcugucuugcgccgcuagcggguucaccuuuuccucucacgccaugcauugggugcgccaggcgccuggaaagggccuugaaugggucgcugccaucagcuacgacggguccaacaaauauuacgccgauucugugaagggaagauucacaauuagccgggacaauuccaaaaacacgauguaucugcagaugaauagccuccgcgcugaggauaccgccauguguuacugcgcuagaggcucuaucacaggcuccaccgggguuuuugacuauuggggacaaggcacacuggugaccgucagcucu

SEQ ID NO: 38626 - RNA, 321 nt, Artificial Sequence
  derived and/or modified sequence opt5 from HuMab-160_LightChain_VJ-Region
gacauccagaugacccaaagccccuccucucugagcgccuccgugggcgauagagucacaauuacgugccgggcuucucaggacaucagcuccuggcucgccugguaccagcagaagccugagaaagcgccgaagucucugauuuaugcugccagcucccuucaaagcgggguucccucucgcuucuccggaagcggcucugggaccgauuuuacacugaccaucuccagccuccagccugaagacuucgccacauacuauugucagcaguacaacucuuaucccauuaccuuuggacaaggcacaagacuggagaucaaa

SEQ ID NO: 38627 - RNA, 372 nt, Artificial Sequence
  derived and/or modified sequence opt5 from HuMab-162_HeavyChain_VDJ-Region
gaggugcagcugugggaaagcggcgggggauccguccaacccggcgggucucucagacugagcugcgccgcuuccggauucaccuuuucuagcuacggcauguccuggguucggcaggccccugggaagggacuugagugggugucuggcaucagcggcuccggguauagcacauacuaugcggacucugugaaaggacgcuucacgauuuccagagauaacagcaagaauacccuguaccuccagaugaacucucugcgggcugaagacacagccgucuauuacugugccaaaggcuauuaccacggguccggaagcuacuauaccucuuuugauuacuggggccaggggacacuugugaccguuuccagc

SEQ ID NO: 38628 - RNA, 321 nt, Artificial Sequence
  derived and/or modified sequence opt5 from HuMab-162_LightChain_VJ-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuauccccugaccuuuggcgggggaacaaaaguggagauuaag

SEQ ID NO: 38629 - RNA, 366 nt, Artificial Sequence
  derived and/or modified sequence opt5 from HuMab-163_HeavyChain_VDJ-Region
gaggugcagcugguccaaagcggcgccgaaguuaagaaacccggggagucccucaagaucucuugccagggaagcggcuacagauucauuuccuauuggaucgggugggugcggcagaugccuggaaaaggccuggaauggauggggcgcauuuacccgggagacucugauaccagauauagccccuccuuucagggccaagugacaaucucugucgacaagagcauuuccacggcuuaccuucaguggagcucucugaaagccuccgauaccgcgauguauuacugugcucggcagcgcggcgacuauuacuacuucaacgggcucgauguguggggacagggcacaaccguuacagugagcucu

SEQ ID NO: 38630 - RNA, 321 nt, Artificial Sequence
  derived and/or modified sequence opt5 from HuMab-163_LightChain_VJ-Region
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuucccucaccuuuggcggcgggacaaaaguggagaucaag

SEQ ID NO: 38631 - RNA, 363 nt, Artificial Sequence
  derived and/or modified sequence opt5 from HuMab-166_HeavyChain_VDJ-Region
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacgaguacuaugccgauucuguuaaaggaagauucacaauuagccgggacaauuccaagaacacgcuguaccuccagaugaauagccugcgcgccgaagauaccgcuguguauuacugugccagaggcucuaucauuggcuccacaggggucuuugacuauuggggacaaggcacccuugugacaguuagcucu

SEQ ID NO: 38632 - RNA, 321 nt, Artificial Sequence
  derived and/or modified sequence opt5 from HuMab-166_LightChain_VJ-Region
gacauccagaugacccaaagccccuccucucugagcgccuccgugggcgauagagucacaauuacgugccgggcuucucaggggaucagcaacuggcucgccugguaccagcagaagccugagaaagcgccgaagucccugauuuaugacgcuucuagccuucaauccggaguucccagccgcuucucuggcuccgggagcggaaccgauuuuacacugaccaucucuucccuccagccugaagacuucgccacauacuauugucagcaguacaauagcuaucccauuaccuuuggccaagggacaagacuggagaucaaa

SEQ ID NO: 38633 - RNA, 363 nt, Artificial Sequence
  derived and/or modified sequence opt5 from HuMab-167_HeavyChain_VDJ-Region
caggugcaacuggucgagagcggcgggggaguugugcagcccggcagaucccuccggcugucuugcgccgcuagcggguucaccuuuuccucuuacgccauccacugggugcgccaggcgccuggaaagggccuugaaugggucgcugugauuagcuaugacggguccaacaaauacuaugccgauucuguuaagggaagauucacaaucagccgggacaauuccaaaaacacgcuguaccuccagaugaauagccugcgcgccgaggauaccgcuguguauuacugugccagaggcucuauuacaggcuccaccggggucuuugacuauuggggacaaggcacacuugugaccguuagcucu

SEQ ID NO: 38634 - RNA, 363 nt, Artificial Sequence
  derived and/or modified sequence opt5 from HuMab-169_HeavyChain_VDJ-Region
caggugcaacugguccagagcggcgccgagguuaagaagcccggggcuuccgugaaggugucuugcaaagccagcggauacaccuucacaaacuauggcaucuccugggucagacaggcgccugggcagggacucgaauggaugggcuggcugucugcuuacagcgggaauacgauuuaugcccaaaaacuucagggacgggugaccaugacaaccgacacauccaccacaaccgccuacauggagcugcgcucucucagaagcgaugacacggcuguuuauuacugugcccgggaucgcaucguggucagaccggacuauuuugauuacuggggccagggcacccuggugacaguuuccagc

SEQ ID NO: 38635 - RNA, 321 nt, Artificial Sequence
  derived and/or modified sequence opt5 from HuMab-169_LightChain_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuagaaccuuuggccaggggacaaaaguggagaucaag

SEQ ID NO: 38636 - RNA, 366 nt, Artificial Sequence
  derived and/or modified sequence opt5 from HuMab-7D8_HeavyChain_VH-Region
gaggugcagcuggucgaaagcggcgggggacucguucaacccgacagaucccugcggcuuucuugcgccgcuagcggcuucaccuuucacgauuacgccaugcauugggugcgccaggcgccugggaagggacuggaguggguguccacaaucucuuggaacagcggcacgauuggguaugcugacuccgucaaaggaagauucaccaucucucgggauaaugccaagaacagccucuaccugcagaugaacucccuucgcgccgaagacacagcucuguauuacugugccaaagauauucaguauggcaauuacuauuacggcauggacgugugggggcaaggaaccacaguuaccgugagcucu

SEQ ID NO: 38637 - RNA, 366 nt, Artificial Sequence; identical to SEQ ID NO: 38636
  derived and/or modified sequence opt5 from HuMab-7D8_HeavyChain_V-Region

SEQ ID NO: 38638 - RNA, 321 nt, Artificial Sequence
  derived and/or modified sequence opt5 from HuMab-7D8_LightChain_VL-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuaucaccuuuggccaggggacaagacucgagauuaaa

SEQ ID NO: 38639 - RNA, 321 nt, Artificial Sequence; identical to SEQ ID NO: 38638
  derived and/or modified sequence opt5 from HuMab-7D8_LightChain_V-Region

SEQ ID NO: 38640 - RNA, 324 nt, Artificial Sequence
  derived and/or modified sequence opt5 from huMAb-anti-MSP10.1_LightChain_VJ-Region
gagaucgugcugacccagagccccgacauucucucccugucuccuggcgaaagagccacacuuagcugccgggcuucccaagcccugacggcgaaguaccucgcuugguaucagcagaaaccggggcaggucccccgccugcuuaucuacggaucuagcaccagagccacaggcauuccugaucgguuccgcggguccggaucuggcaccgacuuuacacugaccaucagcagacucgagcccgccgauuccgcuguuuauuacugucaacaguaugaagacagcccuuggacauucgggcagggaaccaagcuggagauuaaa

SEQ ID NO: 38641 - RNA, 324 nt, Artificial Sequence
  derived and/or modified sequence opt5 from huMAb-anti-MSP10.2_LightChain_VJ-Region
gagaucgugcugacccagagccccgacacacucucccugucuccuggcgaaacggccacccuuagcugcagagcuucccaaacaguccggcgcaacucucuggccugguaccagcagaagccggggcaggcgcccagacuccugauuuauggagcuagcgaucgggccaccggcaucccugaccgcuucuccgggucuggauuuggcacagauuucacccuuacaguuagcgggcuggagcccgaagacuuugccguguacuauugucaacaguacggaaccuccccuagaacguucggccagggcaccaaacucgagauuaag

SEQ ID NO: 38642 - RNA, 324 nt, Artificial Sequence
  derived and/or modified sequence opt5 from HUMAB-Clone_18_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaaaagagccaccggaaucccugcucgguucagcggcuccgggagcggaacagauuuuacccuuacaauuucuucccuggagcccgaagacuucgccguuuauuacugucaacagcgcagcaaguggccucccuggaccuuuggccaggggacaaaaguggagucuaag

SEQ ID NO: 38643 - RNA, 324 nt, Artificial Sequence
  derived and/or modified sequence opt5 from HUMAB-Clone_22_VJ-Region
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaaauggccucccuggaccuuuggccaggggacaaagguggagaucaaa

SEQ ID NO: 38644 - RNA, 432 nt, Artificial Sequence
  derived and/or modified sequence opt5 from HuMab-L612_Chain_VDJ-Region_Precursor
auggaguucggccugaccuggcucuuucugguggccaaccuuaaggggguccagugcgaaguucaacugcucgacagcggaggcgggcuggugcagcccggaggcugucuuagacuguccugcgcugccucuggguucacauuuagcuccugugcgaugucuugggugcggcaggcuccuggaaaaggccucgagugggucagcgccaucuccggcucugggggaagcacguacuaugccgauuccgugaagggccgcuucaccauuagcagagacaaaucuaagaauacacuguaccugcagaugaacucccuccgggcugaagauaccgccguuuauuacugcgcuaaagggggaaaugacauccugacaggcuauuacgccugggggcaaggaacccuugugacagucagcucuggcuccgcgagcgcc

SEQ ID NO: 38645 - RNA, 321 nt, Artificial Sequence
  derived and/or modified sequence opt5 from HuMab_LC5002-002_LightChain_V-Region
gacauccagaugacccaaagccccuccucucugagcgccuccgugggcgauagagucacaauuacgugccgggcuucucaggggaucagccgcuggguugccugguaccagcagaagccugagaaagcgccgaagucccucauuuaugcugccucuagccugcaauccggagugcccagcagauucucuggcuccgggagcggaaccgacuuuacacuuaccaucucuucccugcagccugaagauuucgccacauacuauugucagcaguacaacagcuaucccuggaccuuuggccaagggacaaaaguggagauuaag

SEQ ID NO: 38646 - RNA, 357 nt, Artificial Sequence
  derived and/or modified sequence opt5 from HuMab_LC5002-002_gamma1-Chain_V-Region
gaggugcagcugcucgaaagcggcgggggacugguccaacccggcgggucccuuagacugucuugcgccgcuagcggauucaccuuuaacaucuacgccaugaauuggguucggcaggcgccuggcaaggggcucgaguggguguccgugauuucuggacgcggcaucacaacguauuacgcugacagcgucaaaggcagauucaccauuucccgggauaacucuaagaauacacuguaucuucagaugaacagccugcgcgccgacgauaccgccguguacuauugugcuaaaggguccagcucuuggacagacuuugauuacuggggacagggcacccucguuacaguguccagc

SEQ ID NO: 38647 - RNA, 321 nt, Artificial Sequence
  derived and/or modified sequence opt5 from HuMab_LC5002-003_LightChain_V-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccuggaccuuuggccaagggacaaaaguggagauuaag

SEQ ID NO: 38648 - RNA, 357 nt, Artificial Sequence
  derived and/or modified sequence opt5 from HuMab_LC5002-003_gamma1-Chain_V-Region
gaggugcagcugcucgaaagcggcggggaccugauccaacccggaggcucccuuagacugucuugcgccgcuagcggguucaccuuuaacauuuacgccaugaauuggguccggcaggcgccuggaaagggccucgaguggguuuccgugaucucugggcgcggaauuacaacguauuacgcugauagcgugaaaggcagauucaccaucucccgggacaacucuaagaauacacuguaucuucagauggauagccugcgcgccgaagacaccgccgucuacuauugugcuaaaggcuccagcuacuggacagauuuugacuauugggggcagggaacccucgugacaguuucuucc

SEQ ID NO: 38649 - RNA, 321 nt, Artificial Sequence
  derived and/or modified sequence opt5 from HuMab_LC5002-005_LightChain_V-Region
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucucacccucccaccuuuggccaagggacaaaacuggagauuaag

SEQ ID NO: 38650 - RNA, 354 nt, Artificial Sequence
  derived and/or modified sequence opt5 from HuMab_LC5002-005_gamma1-Chain_V-Region
gaggugcagguccuggacagcggcgggggacucguucaacccggcgggucccugagacuuucuugcaccgccagcggauucacauuucggcuguacacgauguccugggugcgccagaccccuggcagagggcucgaaugggugucuggaaucagcggcuccggccugucuacauauuucgcugauagcgucaaggggcgguuuaccauuucccgcgacaacagcaaaaauacaguguaccuucagaugaacucucugagagccgaggauaccgcgguuuauuacugugcuaaggaaggagacuggaucuauuucgauuccuggggccaggggacacucgugauugucagcucu

SEQ ID NO: 38651 - RNA, 321 nt, Artificial Sequence
  derived and/or modified sequence opt5 from HuMab_LC5002-007_LightChain_V-Region
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaucgggauuccugaccgguucagcggaucuggcuccgggaccgauuuuacacuuaccaucagccgccuggagcccgaagacuucgccguuuauuacugucaacacuauggaucuucccucacauuuggcggcgggaccaaaguggagauuaag

SEQ ID NO: 38652 - RNA, 369 nt, Artificial Sequence
  derived and/or modified sequence opt5 from HuMab_LC5002-007__gamma1-Chain_V-Region
caggugcaacugguccagagcggcgccgagguuaagaaacccggguccucugugaaggugagcugcaaagucuccggaggcaccuucucuagcuacgcuuuuuccugggugagacaggccccugggcagggacucgaauggaugggccggaucauuccgauccuggggcgcacaaacuaugcgcaaaaguuccagggaagaguuacgauuaccgcugacaaaucuacaagcaccgccuacauggagguguccagccuucggucugaagauacagccgucuauuacugugcucgcgagggcgaaacccuggacuauuuuuacuauggcauggaugugugggggcagggaacaaccguuacgguguccagc

SEQ ID NO: 38653 - RNA, 357 nt, Artificial Sequence
  derived and/or modified sequence opt5 from HuMab_LC5002-018_gamma1-Chain_V-Region
gaggugcagcugcucgaaagcggcgggggacugguccaacccggcgggucccuuagacugucuugcgccgcuagcggauucaccuuuaacaucuacgccaugaauuggguucggcaggcgccuggcaaggggcucgaguggguguccgugauuucuggaagcggcgucacaacguauuacgcugacuccgugaaaggccgcuucaccaucucuagagauaacagcaagaauacacuguaucuucagaugaacucccugcgggccgaagacaccgccguuuacuauugugcuaaagggagcucuugguacguggauuuugacuauuggggacagggcacacucgucaccguguccagc

SEQ ID NO: 38654 - RNA, 1347 nt, Artificial Sequence
  derived and/or modified sequence opt5 from Ibalizumab_HeavyChain1
caggugcagcugcagcagagcggccccgaggucguuaagccuggggccuccgugaaaaugucuugcaaggcuagcggauacaccuucacauccuaugugauccacugggucagacagaaaccgggccaagggcucgacuggauuggauacaucaaccccuauaaugauggcacggacuacgaugaaaaguuuaaagggaaggccacccugacaucugacaccagcacauccaccgcguauauggagcuuucuagccugcgguccgaagauacagcuguguacuauugugcccgcgagaaggacaacuacgccaccggagcuugguucgccuacuggggccagggcacgcucguuaccgugagcucugcuuccacaaaagggccuagcgucuuuccccuggccccuugcucuagauccaccagcgaaucuacagcggcccuuggaugucuggugaaggauuauuuccccgagccuguuaccguguccuggaauagcggcgcucucacguccgggguccauacauuuccggccgugcugcagucuagcggacuguacucccucagcucuguggucaccguucccuccagcucucugggcacaaaaaccuauaccugcaacguggaccacaagccuagcaauacaaaaguggauaagcgggucgaguccaaguacgggcccccuugucccucuugcccggcuccugaguuccuuggaggccccagcguguuucuguucccucccaaacccaaggacacgcucaugauuucccgcaccccugagguuacauguguggucguggauguuagccaggaagacccggaggugcaauuuaacugguaugucgauggcguggagguccauaaugccaaaaccaagcccagagaagaacaguucaacucuacauaccgggugguuuccgugcugaccguccuucaccaggacuggcugaaugggaaagaauauaagugcaaagugagcaacaagggacucccuucuuccaucgagaagacgauuagcaaagcgaagggccagccccgcgaaccucaaguuuacacacugcccccgucccaggaggagaugaccaaaaaucaggugucucugaccugucucgucaagggguuuuacccuagcgacaucgccguggaaugggaguccaacggacaacccgaaaauaacuauaaaacaaccccucccgugcuggauucugacggcagcuucuuucuuuacuccagacugacaguugauaagagccgguggcaggaggggaaugucuucucuugcuccgugaugcaugaagcucuccacaaccacuauacgcaaaagagccugucucuuucccugggaaaa

SEQ ID NO: 38655 - RNA, 657 nt, Artificial Sequence
  derived and/or modified sequence opt5 from Ibalizumab_LightChain1
gacaucgugaugacccagagccccgauucccuggccgucucucucggcgagagaguuacaaugaacugcaagagcucccaaucucugcuuuacagcacgaaucagaaaaacuaucuggcuugguaccagcagaagccugggcaauccccgaaacuccugauuuauugggccucuacccgggaaagcggagugcccgaccgcuucuccggcagcgggucuggaacagauuuuacccuuacaaucuccagcgugcaggcggaggacgucgcuguguacuauugucagcaguacuauucuuacagaaccuucggcgggggaacaaagcuggaaauuaaacggaccguugccgccccuuccguguuuaucuuucccccuagcgaugagcaacucaagucuggcacggcuuccgucgugugccugcugaauaacuucuacccccgcgaagccaagguucaguggaaaguggacaaugcucuccagagcggcaacucccaggagucugucaccgagcaagauagcaaggacuccacauauagccugucuuccacccuuacacugagcaaagccgauuacgaaaagcacaaaguguaugcgugugaggugacccaucaggggcucucuagcccugucacgaaguccuucaauagaggagaaugc

SEQ ID NO: 38656 - RNA, 1329 nt, Artificial Sequence
  derived and/or modified sequence opt5 from Ibritumomab_tiuxetan_HeavyChain
caggccuaccugcaacagagcggcgccgagcucgugagacccggggccuccgucaagaugucuugcaaagcgagcggauauaccuucacauccuacaacaugcacuggguuaagcagacgccucggcagggccuggaauggaucggggcuauuuauccgggaaauggcgacaccucuuacaaccaaaaauuuaaggggaaagccacacuuaccguggauaagagcuccucuacagccuauaugcagcugagcucccucaccagcgaggacucugcuguguacuucugugcccgcgucguguauuacuccaauagcuacugguauuuugauguuuggggaacaggcaccacggugaccgucucugcucccuccguguacccucuggcccccguuugcggcgacacaaccgggagcucugugacacuuggaugucuggucaagggcuauuucccugaacccgugacccucacguggaacuccgggagccuguccucuggagugcauacauuuccugcgguccugcagagcgaucucuacacccuguccagcucuguuacagugaccuccagcaccuggccgucucagagcaucacaugcaauguggcccaccccgcuuccucuacgaaagucgacaagaaaauugagccuagaggccccaccaucaagccuugucccccgugcaaauguccugcccccaaccuucucgggggaccuagcguguucauuuuuccucccaagaucaaggauguucugaugaucucccugagccccauugugacaugcgucgugguugacgugucugaagaugacccggauguccaaaucuccugguucgugaauaacgucgaggugcauaccgcucagacacagacccaccgggaggacuauaauagcacgcuucgcguugugucugcccugcccauucagcaucaagauuggauguccggcaaagaauuuaaguguaaagucaacaauaaggaccucccugcgcccaucgagagaacaauuagcaaaccuaagggcuccgugcgggcuccccagguuuacgugcugccgccucccgaagaggagaugaccaaaaagcaggucacccugacaugcauggugaccgacuucaugccugaagauaucuauguggaguggacaaacaaugggaagacggaacucaacuacaaaaauaccgagcccguucuggacucugauggaagcuacuuuauguauuccaaacuucgcgucgagaaaaagaacuggguggaaagaaacucuuacagcuguuccgugguccacgagggccugcacaaucaucacacaaccaagagcuucucucgg

SEQ ID NO: 38657 - RNA, 627 nt, Artificial Sequence
  derived and/or modified sequence opt5 from Ibritumomab_tiuxetan_LightChain
cagaucgugcugagccaaucccccgccauucucucugcuagcccuggcgagaaagucaccaugacaugcagagccuccucuagcguuuccuacaugcacugguaucagcagaaaccggggucuagccccaagccuuggaucuacgcgcccuccaaccuggcuagcggagugccugcccgguucucuggcuccgggagcggaacgucuuauucccuuaccauuagccgcguggaagccgaggacgcugccacauacuauugucagcaauggucuuuuaaucccccuaccuucggcgcugggacaaaacuggaacucaagagagccgaugcggccccgaccgucuuuaucuuucccccuuccgacgagcagcugaaaagcggaacagcuuccgugguuugccuucugaacaauuucuacccccgggaagccaaggugcaguggaaggucgauaacgcucuccagucuggcaauagccaagaguccgugaccgagcaggacagcaaagauucuacguauucccugagcucuacccugacacucagcaaggccgacuacgaaaaacauaagguuuacgcgugugaggugacccaccagggccuguccucuccugucacaaagagcuucaac

SEQ ID NO: 38658 - RNA, 1368 nt, Artificial Sequence
  derived and/or modified sequence opt5 from Icrucumab_HeavyChain1
caggcccaaguggucgagagcggcgggggaguugugcaguccggcagaucucugcggcucagcugcgcugccuccggguucgcguuuucuagcuacggaaugcacugggugcgccaggcucccggcaaggggcuggaaugggucgccgugaucugguaugacggauccaacaaauacuaugccgauucuguuagaggccgguucaccauuagccgcgacaauuccgagaacacacuuuaccugcagaugaauagccucagagcugaagauacggccguguauuacugugcucgggaccauuauggcucugggguccaccauuacuuuuacuauggacuggauguguggggccaagggaccacaguuaccguguccagcgccucuacaaagggaccuuccgucuucccgcuugcgcccagcucuaaauccaccagcggcgggacagccgcucugggaugccucgugaaggacuacuuuccugagcccgugaccgucuccuggaacucuggcgcccugacgagcggcguucacaccuucccugcugugcugcaguccagcgggcucuauucucuguccagcguggucacagugcccucuagcucccuuggaacccagacauacaucuguaauguuaaccauaaaccuucuaauaccaagguggauaagcgcgucgaaccgaaaagcugcgacaagacgcacacaugucccccuugccccgccccugagcugcucggcgggcccuccguguuucuguucccgccuaaacccaaggauacccuuaugauuagcagaacaccugagguuaccuguguggucguggacgucucucacgaagaucccgaggugaaauuuaacugguauguugacggaguggaaguccauaaugcgaagaccaagccccgggaggagcaguacaacuccacauaucgcgugguuagcgugcugacgguccuccaccaagauuggcugaauggcaaagaauacaagugcaaagugucuaacaaggcccugccugcuccgaucgagaaaaccauuuccaaggccaaagggcagcccagagaaccucagguguacacacugcccccuagccgggaggaaaugaccaagaaucagguuucccucacaugucuugucaagggauucuaucccucugacaucgcuguggagugggagagcaacggccaaccggaaaauaacuacaaaaccacgccucccgugcuggacuccgauggcagcuuuuuccucuauucuaagcugacagucgacaaaucccgcuggcagcaggggaacguguuuagcugcucuguuaugcaugaggcccuucacaaucacuacacccaaaagucccugagccucucuccuggaaaa

SEQ ID NO: 38659 - RNA, 645 nt, Artificial Sequence
  derived and/or modified sequence opt5 from Icrucumab_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccucucaccuuuggcggcgggacaaaaguggagaucaagagaaccguggcugcccccagcgucuucauuuuuccuccgucugaugaacagcugaaauccggaacggcuagcgugguuugccugcucaacaauuucuacccccgggaggccaaggugcaguggaaagucgacaacgcgcugcaauccggcaauucucaggagagcgugaccgaacaggauuccaaggacagcacauauucucuuuccagcacccugacacucucuaaggccgauuacgagaaacacaagguuuacgcuugugaagugacccaucaggggcugagcuccccugucacgaaaucuuuuaaccgcggagagugc

SEQ ID NO: 38660 - RNA, 675 nt, Artificial Sequence
  derived and/or modified sequence opt5 from Idarucizumab_HeavyChain1
caggugcaacugcaggagagcggccccgggcucgucaagccuuccgaaacccugucucuuacaugcacgguuagcggauucucccugaccucuuacaucguggacuggauuagacagccgcccggcaaagggcucgaguggaucggagugauuugggccggcgggagcacaggauauaacuccgcucugcggucucgcgucagcaucaccaaggauacauccaaaaaucaguuuagccuuaagcugucuuccgugaccgccgcggacacagcuguuuacuauugugccagcgccgcuuacuauucuuacuauaacuacgauggcuucgccuacuggggccaagggacccucgugacggucuccagcgcuucuaccaaaggaccuuccguguuuccccuggccccuagcuccaagucuacaagcggcgggaccgcggcccugggaugccucguuaaggacuauuuccccgaaccugugacagucuccuggaauagcggcgcucugaccucuggggugcacacguuuccggccgugcuucaguccagcggacuguacucucucagcuccgucguuacagugcccucuagcucccugggcacccagacauauauuuguaacgugaaucauaaaccuagcaacaccaaggucgauaaaaagguggagcccaaaucuugc

SEQ ID NO: 38661 - RNA, 657 nt, Artificial Sequence
  derived and/or modified sequence opt5 from Idarucizumab_LightChain1
gacguggucaugacgcagagcccccugucccucccuguuacacugggccaaccggccucuaucagcugcaaguccucucagagccuucuguacacggaugggaaaaccuaucucuacugguuccugcagcggcccggacaguccccucggcgccuuauuuaucuggugucuaagcucgacagcggcgugcccgauagauuuuccgggagcggaucuggcacagacuucacccugaaaaucucccgggucgaggcugaagauguggggguuuacuauugucugcaaagcacacacuuuccucauaccuucggaggcggcacaaagguggagauuaaacgcaccgucgccgcgcccucuguguuuaucuucccuccguccgacgaacagcucaagagcgggacggcuucuguugugugccugcuuaacaauuuuuaccccagagaggccaagguccaguggaaaguggauaacgcccugcaguccggaaauagccaagaauccgugaccgagcaggacucuaaggauagcacauauucccucagcucuacccugacacuuuccaaagcugacuacgagaagcacaaagucuacgccugugaaguuacccaucagggccugagcucuccugugaccaagagcuucaacagaggggagugc

SEQ ID NO: 38662 - RNA, 1332 nt, Artificial Sequence
  derived and/or modified sequence opt5 from Igatuzuab_HeavyChain1
caggugcaacugguccagagcggcgccgagguuaagaaacccggguccucugugaaggugagcugcaaggcuuccggauucaccuuuacagacuacaaaauccacugggucagacaggccccuggccaggggcucgaauggggauauuucaaccccaauucuggcuacagcacguaugcgcaaaaauuucaggggcgggugaccauuacagcugauaaguccaccucuacagccuacgagcugagcucccuucgcagcgaagacaccgccguuuauuacugugcuagacugucucccggaggcuauuacguggaugccuggggccaggggacaaccgucacgguguccagcgcuucuaccaagggaccuuccguuuucccccucgccccuagcucuaaauccacaagcggcgggaccgcggcccugggaugccuugugaaggacuacuuucccgagccugucacaguguccuggaacucuggcgcucugaccagcggggugcauacguucccggccguccuccaguccagcggacuguauucucuguccagcguugugacagugcccucuagcucccucggcacccaaacauacaucuguaaugucaaccacaaaccuucuaauaccaagguggauaaaaagguugaacccaagagcugcgacaaaacccauacauguccucccugcccggcuccugagcugcuuggcgggcccuccguguuucuguucccucccaagcccaaagauacgcucauuagccggaccccugaggucacaugugugguuguggacgucucucacgaagauccggaggugaaguuuaacugguaugucgacggaguggaaguucauaaugccaaaaccaagccccgcgaggagcaguacaacuccacauauagaguggucagcgugcugaccguucuucaccaggauuggcugaauggcaaagaauacaagugcaaggugucuaacaaagcgcucccugcccccaucgagaagacgauuuccaaagcuaaggggcagccucgggaaccccaagucuauacacugccgccuagccgcgacgagcugaccaaaaaucaggugucccucaccugucuggugaagggauucuaccccucugauaucgccguugaaugggagagcaacggccagccugagaauaacuacaagacaaccccgccuguccuugacuccgacgggagcuuuuuccuguauucuaaacucacaguggauaaguccagauggcaacagggaaauguguuuagcugcucuguccacgaagcucugcauaaccacuacacgcagaaaucccuuagccugucucccggc

SEQ ID NO: 38663 - RNA, 636 nt, Artificial Sequence
  derived and/or modified sequence opt5 from Igatuzuab_LightChain1
gacauccagacccaaagccccuccucucugagcgccuccgugggcgauagagucacaauuacgugccgggcuucucaggggaucaacaauuaccucaacugguaucagcagaaaccuggaaaagccccgaagcgccugauuuacaauaccaacaaucuucaaacaggcguucccagcagauucuccgggucuggaagcggcaccgaguuuacacugaccaucuccagccuccagccugaagacuucgcgacauauuacugucugcagcacaacucuuuucccaccuucgggcagggaacgaaacuugagauuaagcggaccguggcugccccuuccguguuuaucuuucccccuagcgaugaacaacugaaaucuggcacagccuccgucgugugccuccugaauaacuucuauccgcgcgaggcuaagguucaguggaagguggacaaugcccugcagagcggcaacucucaggaauccgucaccgagcaagauagcaaagacuccacauacucucucagcuccacccugacgcuuagcaaggcugauuaugagaaacauaagguguacgccugugaaguuacacaccaggggcugucuucccccgugaccaagagcuucaauagaggagagugc

SEQ ID NO: 38664 - RNA, 357 nt, Artificial Sequence
  derived and/or modified sequence opt5 from IGF-IR_HUMAB-1A_HeavyChain
gaggugcagcugguccaaagcggcgggggacucguucaccccggcgggucccugagacuuucuugcgccggaagcggcuucaccuuucggaacuacgcuauguauugggugcgccaggccccugggaagggacuggaauggguguccgcgaucggcucuggcgggggaacauacuaugcugacagcgucaaaggcagauucacgauuucccgggauaaugccaagaacucucucuaccugcagaugaauagccuucgcgccgaggacauggcuguguauuacugugccagagcuccgaacuggggguccgaugccuuugacaucuggggacagggcaccaugguuacagugagcucu

SEQ ID NO: 38665 - RNA, 357 nt, Artificial Sequence
  derived and/or modified sequence opt5 from IGF-IR_HUMAB-23_HeavyChain
gaggugcagcugguccaaagcggcgggggacucguucaccccggcgggucccugagacuuucuugcgccggaagcggcuucaccuuuuccaacuacgcuauguauugggugcggcaggccccugggaagggacuggaaugggugucugcgaucggcagcggcgggggaacauacuaugcugacuccgucaaaggccgcuucacgauuucuagagauaaugccaagaacagccucuaccugcagaugaacucccuucgggccgaggacauggcuguguaucauugugcccgcgcuccgaauugggggagcgaagccuuugauaucuggggacagggcaccaugguuacagugucuucc

SEQ ID NO: 38666 - RNA, 321 nt, Artificial Sequence; identical to SEQ ID NO: 38562
  derived and/or modified sequence opt5 from IGF-IR_HUMAB-23_LightChain

SEQ ID NO: 38667 - RNA, 357 nt, Artificial Sequence
  derived and/or modified sequence opt5 from IGF-IR_HUMAB-8_HeavyChain
gaggugcagcugguccaaagcggcgggggacucguucaccccggcgggucccugagacuuucuugcgccggaagcggcuucaccuuucgguccuacgcuauguauugggugcgccaggccccugggaagggacuggaaugggugucugcgaucggcagcggcgggggaacauacuaugcugacuccgucaaaggcagauucacgauuucucgggauaacgccaagaauagccucuaccugcagaugaacucccuucgcgccgaggacauggcuguguauuacugugccagagcuccgaauugggggagcgaugccuuugacaucuggggacagggcaccaugguuacagugucuucc

SEQ ID NO: 38668 - RNA, 321 nt, Artificial Sequence
  derived and/or modified sequence opt5 from IGF-IR_HUMAB-8_LightChain
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccccuaccuuuggccccgggacaaaaguggacauuaag

SEQ ID NO: 38669 - RNA, 708 nt, Artificial Sequence
  derived and/or modified sequence opt5 from ImAb1_LightChain
auggacaugagagcccccgcucaguucuuuggcauccugcuccugugguucccugggauucggugcgauaucaagaugacccaaagcccguccucuauguacgccagccuuggagagcgcgugacaauuacguguaaagcgucccaggacaucaagucuuaucugagcugguaccagcagaaacccuggaaguccccuaaaauucucaucuauuacgcuaccucucuggccgauggcguccccagcagaaucuccgggagcggaucuggccaagacuauucccuuacaauuagcucucuggaauccgaugacaccgccacauacuauugccuccagcacggggagagcccuuacaccuuuggaggcggcacaaagcuggaaaucaagcgggcugaugccgcucccaccguuucuauuuucccuccguccagcgagcagcugacguccgggggagccucugugguguguuuucucaacaauuucuaccccaaagacaucaacgucaaguggaaaauugauggcagcgaacgccagaauggggugcugaacuccuggaccgaccaagauagcaaggacucuacauauuccaugagcucuacccuuacacugaccaaagaugaguacgagagacauaauagcuauacgugcgaagcgacacacaagaccuccacaucuccuaucguuaagagcuuuaaccggaaugagugu

SEQ ID NO: 38670 - RNA, 681 nt, Artificial Sequence
  derived and/or modified sequence opt5 from ImAb1_gamma1-Chain
augaacuucggcuuuagccugaucuuccucgugcugguccuuaaggggguucagugcgaggugaaacugguggaauccggaggcgggcucgucaagcccggaggcucucugaaacuuagcugugccgcuuccggguuuaccuucucuaauuacgccaugagcugggugagacaaacaccugagaagcggcuggaauggguugcguccauuucuagcgacggagauacguauuuuccggacaacgugaaaggccgcuucaccaucuccagagagaaugcuggcaacauucucuuucugcagaugagcucucugcgguccgaagauacagccauguacuauugcgcccgcggguucaugaucaccuuuuggggacagggcacacucgucaccgugagcgcugccaagacaacgcccccuucuguuuacccccuggcuccuggguguggagacaccaccggcuccagcgugacacuugggugccuggucaagggauauuuccccgagucugugaccgugacauggaauagcggcagccucuccucuagcguccacaccuuuccugcccugcuucaguccggccuguacacgauguccucuuccguuacagugccgagcucuaccuggcccagccaaacagugaccuguuccgucgcgcauccugccucuagcaccacaguggau

SEQ ID NO: 38671 - RNA, 1344 nt, Artificial Sequence
  derived and/or modified sequence opt5 from Imalumab_HeavyChain1
gaggugcagcugcucgaaagcggcgggggacugguccaacccggcgggucccuuagacugucuugcgccgcuagcggauucaccuuuuccaucuacucuaugaacuggguucggcaggccccuggcaaggggcucgagugggugagcuccauuggaucuagcggcggcacaacguauuacgcggacuccgugaaagggcgcuucaccaucagcagagauaauucuaagaacacacuguaucuucagaugaauagccugcgggcugaagacaccgccgucuacuauugugccggaucccaguggcucuacggcauggaugugugggggcaaggaacaaccguuacagugucuuccgcuagcaccaaaggcccgucugucuuuccccuggccccuuccagcaaguccacgucugggggaaccgcugcccugggcugccucgugaaagacuauuuccccgagccuguuacagugagcuggaacuccggcgcgcugaccagcgggguccacacauuucccgccgugcuucagucuuccggacuguacagccucucuagcguggucaccguuccuuccucuagccugggcacgcagacauacauuuguaaugugaaccauaagccguccaauaccaagguggauaaacgcgucgaacccaagagcugcgacaaaacacacaccuguccucccugcccugcucccgagcuucuugggggaccgucuguguuccucuuuccucccaagccuaaagauacccugaugaucuccagaacacccgagguuacguguguggucguggacguuagccaugaagaucccgaggugaaguucaacugguaugucgacggcguggaaguccacaaugccaagaccaaaccucgggaggagcaguacaacucuacauaucgcgugguuuccgugcugaccguccuccaucaagauuggcugaaugggaaggaauacaaaugcaaggugagcaacaaagcucugccggcccccauugagaagacaaucuccaaagcgaagggacagccuagagaaccccagguuuauacccugccucccucucgggaggaaaugacgaagaaucaggugagccucacaugucuggucaaaggcuuuuacccguccgacaucgccguggagugggagucuaacggccaaccugaaaauaacuauaagaccacacccccugugcuugauagcgacggguccuucuuucuguacagcaaacucaccguugacaagucucgcuggcagcagggaaacgucuucuccugcagcgugaugcacgaggcucugcacaaucauuacacccaaaaaucucugucccucagccccggcaag

SEQ ID NO: 38672 - RNA, 642 nt, Artificial Sequence
  derived and/or modified sequence opt5 from Imalumab_LightChain1
gacauccagaugacccaaagccccuccucucugagcgccuccgugggcgauagagucacaauuacgugccggucuagccagcgcaucaugaccuaccucaacugguaucagcagaagccugggaaagcuccgaagcugcuuauuuucguugccucccacucucaaagcggagugcccuccagauuucggggcagcgggucugagacagacuucacccugacaaucuccggacuccagccugaagauagcgcgaccuacuauugucagcagucuuuuuggacaccccugaccuucggcgggggaacgaaaguggagauuaagcgcaccgucgcugccccuuccguguuuaucuuucccccuagcgacgaacaacuuaaaucuggcacagccuccguugugugccugcucaauaacuucuacccgagagaggcuaagguccaguggaagguggauaaugcccugcagagcggcaacucccaggaaucuguuaccgagcaagacagcaaagauuccacauauagccugucuuccacccucacgcugagcaaggcugacuacgagaaacauaagguguaugccugugaagucacacaccaggggcuuucuagccccgugaccaaauccuucaaucggggagagugc

SEQ ID NO: 38673 - RNA, 1347 nt, Artificial Sequence
  derived and/or modified sequence opt5 from Imgatuzumab_HeavyChain1
caggugcaacugguccagagcggcgccgagguuaagaaacccggguccucugugaaggugagcugcaaggcuuccggauucaccuuuacagacuacaaaauccacugggucagacaggccccuggccaggggcucgaauggaugggauauuucaaccccaauucuggcuacagcacguaugcgcaaaaauuucaggggcgggugaccauuacagcugauaaguccaccucuacagccuacauggagcugagcucccuucgcagcgaagacaccgccguuuauuacugugcuagacugucucccggaggcuauuacgugauggaugccuggggccaggggacaaccgucacgguguccagcgcuucuaccaagggaccuuccguuuucccccucgccccuagcucuaaauccacaagcggcgggaccgcggcccugggaugccuugugaaggacuacuuucccgagccugucacaguguccuggaacucuggcgcucugaccagcggggugcauacguucccggccguccuccaguccagcggacuguauucucuguccagcguugugacagugcccucuagcucccucggcacccaaacauacaucuguaaugucaaccacaaaccuucuaauaccaagguggauaaaaagguugaacccaagagcugcgacaaaacccauacauguccucccugcccggcuccugagcugcuuggcgggcccuccguguuucuguucccucccaagcccaaagauacgcucaugauuagccggaccccugaggucacaugugugguuguggacgucucucacgaagauccggaggugaaguuuaacugguaugucgacggaguggaaguucauaaugccaaaaccaagccccgcgaggagcaguacaacuccacauauagaguggucagcgugcugaccguucuucaccaggauuggcugaauggcaaagaauacaagugcaaggugucuaacaaagcgcucccugcccccaucgagaagacgauuuccaaagcuaaggggcagccucgggaaccccaagucuauacacugccgccuagccgcgacgagcugaccaaaaaucaggugucccucaccugucuggugaagggauucuaccccucugauaucgccguugaaugggagagcaacggccagccugagaauaacuacaagacaaccccgccuguccuugacuccgacgggagcuuuuuccuguauucuaaacucacaguggauaaguccagauggcaacagggaaauguguuuagcugcucugucaugcacgaagcucugcauaaccacuacacgcagaaaucccuuagccugucucccggc

SEQ ID NO: 38674 - RNA, 639 nt, Artificial Sequence
  derived and/or modified sequence opt5 from Imgatuzumab_LightChain1
gacauccagaugacccaaagccccuccucucugagcgccuccgugggcgauagagucacaauuacgugccgggcuucucaggggaucaacaauuaccucaacugguaucagcagaaaccuggaaaagccccgaagcgccugauuuacaauaccaacaaucuucaaacaggcguucccagcagauucuccgggucuggaagcggcaccgaguuuacacugaccaucuccagccuccagccugaagacuucgcgacauauuacugucugcagcacaacucuuuucccaccuucgggcagggaacgaaacuugagauuaagcggaccguggcugccccuuccguguuuaucuuucccccuagcgaugaacaacugaaaucuggcacagccuccgucgugugccuccugaauaacuucuauccgcgcgaggcuaagguucaguggaagguggacaaugcccugcagagcggcaacucucaggaauccgucaccgagcaagauagcaaagacuccacauacucucucagcuccacccugacgcuuagcaaggcugauuaugagaaacauaagguguacgccugugaaguuacacaccaggggcugucuucccccgugaccaagagcuucaauagaggagagugc

SEQ ID NO: 38675 - RNA, 1353 nt, Artificial Sequence
  derived and/or modified sequence opt5 from Inclacumab_HeavyChain1
gaggugcagcuggucgaaagcggcgggggacucguuagacccggcgggucccugcggcuuucuugcgccgcuagcggauucaccuuuuccaacuacgacaugcacugggugcgccaagccacaggcaaggggcuggagugggugucugcgaucacggcugccggagauauuuauuacccuggcagcgucaaaggcagauucaccaucucccgggaaaaugccaagaacucucucuaucugcagaugaauagccuucgcgcuggggacacagccguguacuauugugcuagaggacgguacuccggcagcgggucuuauuacaacgauugguuugacccguggggacagggcacccugguuacaguguccagcgccucuaccaaagggcccuccgucuucccucucgcgcccugcagccgcucuacauccgagagcaccgccgcucugggaugucuggugaaggauuacuuuccugaacccguuacgguguccuggaacucuggcgcccucaccagcggcguccauacauucccugcugugcugcaguccagcgggcuuuauucucuguccagcguggucaccguuccgucuagcucccucggaacaaaaaccuacacgugcaauguggaccacaagcccucuaauacaaagguggauaaaagagucgagagcaaguauggcccucccuguccucccugcccggccccugaguuugaagggggacccuccguguuccuguuuccucccaaacccaaggacacccuuaugauuagccggacaccugagguuaccuguguggucguggauguuucucaagaagacccggaggugcaguucaacugguacgucgauggcguggagguccauaaugcgaaaaccaagccccgcgaggaacaguuuaacuccacauauagagugguuagcgugcugacgguccuccaccaggacuggcugaaugggaaggaauacaaaugcaaggugucuaacaaaggacugccuuccagcaucgagaagaccauuuccaaagccaagggccaaccccgggaaccucagguuuauacacugcccccgucucaggaggagaugaccaaaaaucaggugagccucacaugucuugucaagggcuucuacccuuccgauaucgcuguggaaugggagucuaacgggcaacccgaaaauaacuacaagaccacgccucccgugcuggacagcgacggauccuuuuuccucuauagccgccugacaguugauaaaucuagauggcaggagggcaacgucuucuccugcagcgugaugcaugaagcccuucacaaucacuacacccagaagucucugucccucagccuggggaaa

SEQ ID NO: 38676 - RNA, 642 nt, Artificial Sequence
  derived and/or modified sequence opt5 from Inclacumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccucucaccuuuggcgggggaacaaaaguggagaucaagagaaccguggcugcccccucugucuucauuuuuccuccguccgaugaacagcugaaaagcggcacggcgucugugguuugccugcucaacaauuucuauccccgggaggccaaggugcaguggaaagucgacaacgcucugcaauccggcaauagccaggaguccgugaccgaacaggauucuaaggacagcacauacucccuuagcucuacccugacacucuccaaggccgauuaugagaaacacaagguuuacgcuugugaagugacccaucaggggcugagcucuccugucacgaaauccuuuaaccgcggagagugc

SEQ ID NO: 38677 - RNA, 1347 nt, Artificial Sequence
  derived and/or modified sequence opt5 from Indatuximab_ravtansine_HeavyChain1
caggugcaacugcagcagagcggcuccgagcucaugaugcccggggccucugucaagaucagcugcaaagcuaccggauacacauucuccaacuauuggauugaauggguuaagcagagaccuggccacgggcuggaguggaucggagaaauucuuccgggcacggggcggaccaucuacaaugagaaauuuaagggaaaagccacauucaccgcggacauuucuagcaacacagugcaaaugcagcuguccucucucaccagcgaagauuccgcuguguauuacugugcccgcagagacuauuacggcaauuuuuauuacgccauggauuacuggggccaggggacaagcgucaccgugucuuccgcuagcacgaagggacccucuguuuucccucuggcccccugcucccggagcaccucugaguccacagcugcccuuggcugucuggugaaggacuauuuuccugagcccgucaccgugagcuggaacuccggggcgcucacaucuggaguucauaccuucccugccgugcugcagagcuccggccuguacagccucucuuccgucgugacggugccgagcucuagccuggggacaaaaaccuauacaugcaaugucgaucacaagcccuccaacaccaaaguugacaagcgcguggaaucuaaauacggaccucccuguccuagcugccccgcuccggaguuucuuggcggcccuuccguguuccuguuucccccuaagcccaaggauacccucaugaucagcagaacacccgaagucacgugugugguuguggacgucucucaagaggauccugaggugcaguucaauugguauguugacgggguggaaguccauaacgccaaaaccaagccgcgggaggaacaguuuaauuccacauaccgcguggucagcgugcugaccguucuucaccaggauuggcugaacggaaaagaguauaagugcaaagugucuaauaagggccuccccuccagcaucgagaaaacaauuuccaaggcuaaggggcaaccuagagaaccccaggucuacacccugccucccucucaggaggaaaugacgaaaaaccaagugagccugacaugucucguuaagggauucuacccguccgacaucgccguggagugggaaucuaauggccagccugagaacaauuauaaaaccacacccccuguccuggauagcgacggguccuuuuuccuuuacagccggcugaccguggacaagucucgcuggcaggaaggaaacguguucuccugcagcguuaugcaugaggcgcuccacaaccacuauacccagaaaucucugucccuuagccugggcaag

SEQ ID NO: 38678 - RNA, 642 nt, Artificial Sequence
  derived and/or modified sequence opt5 from Indatuximab_ravtansine_LightChain1
gacauccagaugacccaaagcacauccucucugagcgccucccucggcgauagagugacgauuucuugcagcgcuucccaggggaucaacaauuaccugaacugguaucagcagaagcccgacggaaccgucgagcuucugauuuacuauacaucuacccuccaaagcggcguuccuucccgguucagcgggucuggauccggcacagauuacagccugaccaucucuaaucuugaaccggaggacauugggacauauuacugucagcaguauuccaaacugccccgcaccuuuggaggcggcacgaagcucgaaaucaaaagaaccguggccgcgccuagcguguucaucuuucccccuucugaugagcagcugaaguccgggacagcuagcgucgugugccugcucaacaauuucuacccccgggaagccaaaguucaauggaagguggacaacgcccugcaguccggaaauucucaggagagcgucaccgagcaggauuccaaggacagcacauacucucuuuccagcacccugacgcucucuaaagcugauuaugaaaagcacaaaguguacgccugugagguuacacaucaaggccugagcuccccugugaccaagucuuuuaaccgcggggaaugc

SEQ ID NO: 38679 - RNA, 1347 nt, Artificial Sequence
  derived and/or modified sequence opt5 from Indusatumab_vedotin_HeavyChain1
caggugcaacugcagcaguggggcgccgggcuccugaagcccagcgagacccuuucccugacaugcgcugucuucggaggcucuuuuagcggguacuauugguccuggaucagacagccuccgggaaaaggccucgaauggauuggggagaucaaccaccggggaaauacgaacgacaaucccucucuuaagagccgcguuaccauuuccguggauacaucuaaaaaccaauucgcccuuaagcugagcuccgugaccgcggcugacacagccgucuacuauugugccagagaacggggcuacaccuauggcaauuuugaucauugggggcagggaacacucgugaccguuagcucugcuuccacgaaaggcccuagcguguucccccuggccccuucuuccaagagcaccucugggggaacagcugcccugggcugccucgucaaggacuacuuucccgagccugugaccguuuccuggaacagcggggcgcugacauccggagugcacaccuucccggccguccuucagucuagcggccuguauucccucagcucuguggugacgguccccuccagcucucugggcacacagaccuacaucuguaauguuaaccauaaaccuagcaauacaaagguggauaaaaagguggaacccaaauccugcgacaagacccacaccuguccucccugcccggcuccugagcuucugggaggacccucugucuuucucuucccucccaagcccaaagauacacugaugauuagccgcacgccugaggugaccuguguuguggucgacgugucccaugaagauccggagguuaaguuuaacugguacguggacggcgucgaagugcacaaugccaaaacaaagcccagagaggagcaauauaacagcaccuaccgggucgugucuguucugacagugcuccaccaggauuggcugaaugggaaagaauauaagugcaaagucuccaacaaggcucugccugcccccaucgagaagaccaucagcaaagcgaagggacagccucgcgaaccccagguguacacgcugccgccuucuagagacgagcucaccaaaaaucaaguuucccugacaugucuugugaagggcuucuaucccagcgauauugccgucgaaugggaguccaacgggcagccugagaacaauuacaaaaccacacccccugugcuggacucugacgggagcuuuuuccucuauuccaagcugaccguggauaagucucgguggcagcaaggcaacguuuuuagcugcuccgucaugcaugaagcucugcacaaucauuacacacagaaaagccucucucugucccccggcaag

SEQ ID NO: 38680 - RNA, 642 nt, Artificial Sequence
  derived and/or modified sequence opt5 from Indusatumab_vedotin_LightChain1
gagaucgugaugacccagagccccgccacacuguccgucucuccuggcgaaagagcuacgcucagcugccgggccucccaaucuguuagccgcaaccuggcgugguaccagcagaagccggggcaggcucccagacuucugauuuauggagccuccacccgggccacaggcaucccugcucgcuucucugggagcggauccggcaccgaguuuacacucaccauugggagccugcaaucugaagacuucgccguguacuauugucagcaguacaaaacauggcccagaaccuuuggacagggcacgaauguggagaucaagcggaccgucgcugccccuuccguguucauuuuucccccuagcgaugaacaacuuaaaucuggcacagcguccguugugugccugcucaacaauuucuauccgcgcgaggccaagguccaguggaaaguggacaacgcucugcagagcgggaauagccaggaguccguuaccgaacaagauagcaaggacuccacauacucucugagcuccacccucacgcugagcaaggccgauuaugagaaacacaagguguacgcuugugaagucacacaucagggacuuucuucccccgugaccaaaucuuuuaacagaggcgagugc

SEQ ID NO: 38681 - RNA, 1353 nt, Artificial Sequence
  derived and/or modified sequence opt5 from Inebilizumab_HeavyChain1
gaggugcagcuggucgaaagcggcgggggacucguucaacccggcgggucccugagacuuucuugcgccgcuagcggauucaccuuuuccucuagcuggaugaacugggugcggcaggccccuggcaaggggcuggagugggugggacgcaucuacccgggcgacggcgauacaaauuauaacgucaaauucaaggggagauuuacgauuucccgggacgauucuaaaaauagccucuaccugcagaugaacucccuuaagaccgaagacacagcgguguauuacugugcucgcagcggauucaucaccacaguuagagauuuugacuauuggggccaggggacccuggugacagucucuuccgccagcaccaaaggacccucuguguucccucucgcccccuccagcaagucuacguccggcgggaccgcugcccugggaugccugguuaaggauuacuuuccugagcccgugacagucagcuggaacuccggcgcucucaccucuggcgugcacacauucccugccgugcugcaaagcuccgggcuuuauagccugucuuccgucguuaccgugccgagcucuagccucggaacgcagacauacauuuguaaugugaaucauaaacccuccaacaccaaggucgacaaacggguggaaccuaagucuugcgauaaaacacacaccugucccccuugccccgcgccggagcugcuuggcgggccuagcguuuuucuguuucccccuaagcccaaggacacccucaugaucucccgcacacccgaggugacgugugucgugguugaugugagccaugaagacccugaggucaaauucaauugguacguggauggagucgaagugcacaacgccaagaccaaaccgagagaggagcaguauaauucuacauaccggguuguguccguccugaccgugcugcaucaggacuggcucaacggcaaggaauauaaaugcaagguuagcaauaaagcucugcccgccccuauugagaagacaaucucuaaggcuaaagggcaaccccgcgaaccucagguguacacccuucccccguccagagaggaaaugacgaagaaccaggucagccugacaugucucgugaaaggauucuauccuuccgacaucgccguggagugggagucuaauggccagcccgaaaacaacuacaagaccaccccucccguucuggauagcgacggcuccuuuuuccuuuauucuaaacugacagucgauaagagccgguggcaacaggggaauguguucuccugcagcgugaugcacgaggcgcuccacaaccauuacacccagaagucucugucccugagcccuggaaaa

SEQ ID NO: 38682 - RNA, 654 nt, Artificial Sequence
  derived and/or modified sequence opt5 from Inebilizumab_LightChain1
gagaucgugcugacccagagccccgacuuccaauccgucacaccuaaggaaaaaguuacgauuaccugcagagccucugagagcguggauacauuuggcaucuccuucaugaacugguuucagcagaagccggaccagucucccaaacuccugauucacgaagcuagcaaucaaggguccggagugccuucucgguucagcggcuccgggagcggaaccgauuuuacacuuaccaucaacucucuggaggccgaagacgcggcuacauacuauugucagcaguccaaggagguccccuucaccuuuggcgggggaacgaaaguggagauuaagcgcaccguugccgccccuagcguguucaucuuucccccuucugaugaacagcucaaguccggcacagcuagcgucgugugccugcuuaauaacuucuacccgagagaggccaaaguucaauggaagguggacaaugcucugcagucuggcaacucccaggaaagcgucaccgagcaggauuccaaagacucuacauauagccucuccagcacccugacgcugucuaaggccgauuacgagaaacauaagguguaugcgugugaagugacacaccaagggcucuccagccccgucaccaagucuuuuaaucggggagagugc

SEQ ID NO: 38683 - RNA, 90 nt, Artificial Sequence
  derived and/or modified sequence opt5 from Insulin_peglispro_Fragment1
uucgugaaccagcaccugugcggcagccaucucgucgaggcccuguaccuuguuuguggggaaagaggauuuuucuauaccaagcccaca

SEQ ID NO: 38684 - RNA, 63 nt, Artificial Sequence; identical to SEQ ID NO: 23400
  derived and/or modified sequence opt5 from Insulin_peglispro_Fragment2

SEQ ID NO: 38685 - RNA, 495 nt, Artificial Sequence
  derived and/or modified sequence opt5 from Interferon_beta-1b_chain1
agcuacaaccugcucggcuuccugcagagauccucuaauuuucaaagccagaaacuucuguggcagcucaacgggcggcuggaguauugccuuaaggaccgcaugaauuucgauauccccgaagagauuaagcagcugcaacaguuucagaaagaagacgccgcucucaccaucuacgagaugcugcagaacauuuucgccaucuuuagacaagauuccucuagcacaggauggaaugaaacgauuguggagaaccugcucgcgaaugucuaucaccagaucaaccaucugaagaccguucuugaggaaaaacuggagaaggaagacuucacacggggcaagcucauguccucucugcaccuuaaacgcuacuaugggagaauccugcauuaccucaaggcuaaagaguauagccacugugccuggaccauugugcggguggagauccugcgcaauuuuuacuucauuaacagacugacaggauaccuccggaau

SEQ ID NO: 38686 - RNA, 1347 nt, Artificial Sequence
  derived and/or modified sequence opt5 from Intetumumab_HeavyChain1
caggugcaacuggucgagagcggcgggggaguugugcagcccggcagaucccggcgccucucuugcgcugcuagcggguucaccuuuuccagauacacaaugcacugggugcggcaggccccuggaaagggccuggaaugggucgcggugaucucuuucgacgggagcaacaaauauuacguugauuccgugaagggacgcuuuacgauuucuagagacaauagcgagaacacccuuuaucugcaggucaauauccuccgggcugaagauacagccguguacuauugugcccgcgaggcuagaggcuccuacgccuucgacauuuggggccaagggaccaugguuacagugagcucugcuuccaccaaaggaccgagcgucuuuccccuggccccuucuuccaagagcacaucuggcgggaccgcggcccuuggaugccuggugaaagauuauuuccccgaaccugugacggucuccuggaacagcggcgcucucaccuccgggguucauacauuucccgccgugcugcagucuagcggacuguacucccucagcucuguggucaccgugccuuccagcucucugggcacacagaccuacaucuguaauguuaaccacaagccgagcaauacgaagguggacaaaaaggucgagcccaaauccugcgauaagacacauaccuguccucccugcccugcucccgagcuucugggcgggccgucuguguuccucuuuccucccaaaccuaaggacacacugaugauuagccggacccccgaaguuaccuguguggucguggaugucucccacgaggaccccgaagugaaguucaacugguauguugauggaguggagguccauaaugccaaaacaaagccucgcgaggaacaguacaacagcacguauagagugguuucugugcuuaccguccugcaccaagacuggcucaauggcaaagaguacaagugcaaaguguccaacaaggcgcugccggcccccaucgagaaaacaaucagcaaggcuaaggggcagccucgggaaccccagguguauacccugccucccucucgcgaugaacucaccaaaaaucagguuucccugacaugucuugucaagggauuuuacccgagcgacauugccguggagugggaguccaacggccaaccugaaaauaacuauaaaacgacacccccugugcuggacucugaugggagcuucuuucucuacuccaagcugaccgucgacaaaucuagauggcagcagggaaacguguucagcugcuccguuaugcacgaggcccuucauaaucacuacacccaaaagagccugucucucucccccggcaag

SEQ ID NO: 38687 - RNA, 645 nt, Artificial Sequence
  derived and/or modified sequence opt5 from Intetumumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccucccuuuaccuucggcccugggacaaaaguggauaucaagagaaccguggcugccccgucugucuuuauuuuucccccuuccgacgagcagcucaaaagcggaacggcgucugugguuugccugcugaacaauuucuauccccgggaagccaaggugcaguggaaagucgauaacgcucuccaauccggcaauagccaggaguccgugaccgagcaggacucuaaggauagcacauacucccugagcucuacccuuacacuguccaaggccgacuaugaaaaacacaagguuuacgcuugugaggugacccaucagggccucagcucuccugucacgaaauccuucaaccgcggggaaugc

SEQ ID NO: 38688 - RNA, 1347 nt, Artificial Sequence; identical to SEQ ID NO: 38546
  derived and/or modified sequence opt5 from Iodine_(124I)_Girentuximab_HeavyChain1

SEQ ID NO: 38689 - RNA, 642 nt, Artificial Sequence; identical to SEQ ID NO: 38547
  derived and/or modified sequence opt5 from Iodine_(124I)_Girentuximab_LightChain1

SEQ ID NO: 38690 - RNA, 1335 nt, Artificial Sequence
  derived and/or modified sequence opt5 from Iodine_(131I)_derlotuxiab_biotin_HeavyChain1
caggugcaacugaaggagagcggccccgggcucgucgccccuucccagucucugagcauuaccugcacaguuuccggauucucucuuacggacuacggcgugagauggauccggcagccgcccgggaaaggacuggaauggcucggcgugaucuggggagggggcagcaccuauuacaacuccgcucugaagucucgccuuagcauuuccaaagauaauagcaagucucaggucuuucugaaaaacucccuccaaacagacgauaccgccuauuacugugcgaaggagaagagacggggcuauuacuaugcugacuacugggggcagggaacaagcgugaccguuucuuccgccagcacaaaaggcccuucuguguucccccuggccccuuccagcaaguccaccucugggggaacggcugcccugggcugccucgucaaagauuacuuucccgaaccugugaccguuagcuggaacuccggggcucugacaagcggagugcacaccuucccggccguccuucagucuuccggccuguauagccucucuagcguggugacaguccccuccucuagccugggcacccagacguacaucuguaauguuaaucauaagccuuccaacacaaaaguggacaagaaggcggagcccaaaagcugcgauaagacccacacauguccucccugcccggccccugaacuucucgggggacccucuguguuucuguucccucccaaacccaaggacacccugauuucccgcaccccugaggucacaugugugguuguggaugucagccaugaggacccggaagugaaauuuaauugguauguugauggcguggagguccacaacgcuaagacgaaacccagagaagaacaauacaauucuaccuaucggguggucuccgugcugacaguucuccaucaggacuggcugaacgggaaggaguacaagugcaaagugagcaauaaggcccuuccugcucccaucgagaaaaccaucuccaaggccaaaggacagccucgcgagccccaggucuauacacugccgccuucuagagaugaacucaccaagaaccaagugagccugacgugucuuguuaagggcuucuaccccuccgacauugcgguggagugggaaucuaaugggcagccugagaacaauuacaaaacaacacccccuguccuggacagcgauggauccuuuuuccucuauagcaagcugaccguggacaaaucucgguggcagcaaggcaacguguuuuccugcagcguucacgaggcccugcacaaccauuacacccagaagucucucucccugagccccggcaaa

SEQ ID NO: 38691 - RNA, 639 nt, Artificial Sequence
  derived and/or modified sequence opt5 from Iodine_(131I)_derlotuxiab_biotin_LightChain1
gagaacgugcugacccagagccccgccaucuccgcuucuccuggcgaaaaggucacaacgugcagagccagcuccucuguuagcuccucuuaccuccacugguaucaacagaaaagcggggcguccccgaagcuguggauuuacagcaccucuaaucuugcuuccggagugcccgcccgguucagcggcucuggguccggaacaagcuauucucugaccaucuccagcguggaggccgaagacgcugccacauacuauugucagcaguacuccggcuauccucucaccuuugggggaggcacaaaacuggagauuaagcgcaccgucgcugcccccucuguguucaucuuuccucccagcgaugaacaacuuaaauccggcacggcgagcguugugugccugcucaacaauuucuacccuagagaggccaagguccaguggaagguggacaacgcucugcagucuggaaauucccaggagagcguuaccgaacaagauucuaaagacagcacauacucccugucuagcacccucacacuguccaaggccgauuaugagaaacauaagguguacgcuugugaagucacccaccaggggcuuagcucuccggugacgaaauccuuuaaccggggcgagugc

SEQ ID NO: 38692 - RNA, 1350 nt, Artificial Sequence
  derived and/or modified sequence opt5 from Iodine_(131I)_Derlotuximab_biotin_HeavyChain1
caggugcaacugaaggagagcggccccgggcucgucgccccuucccagucucugagcauuaccugcacaguuuccggauucucucuuacggacuacggcgugagauggauccggcagccgcccgggaaaggacuggaauggcucggcgugaucuggggagggggcagcaccuauuacaacuccgcucugaagucucgccuuagcauuuccaaagauaauagcaagucucaggucuuucugaaaaugaacucccuccaaacagacgauaccgccauguauuacugugcgaaggagaagagacggggcuauuacuaugcuauggacuacugggggcagggaacaagcgugaccguuucuuccgccagcacaaaaggcccuucuguguucccccuggccccuuccagcaaguccaccucugggggaacggcugcccugggcugccucgucaaagauuacuuucccgaaccugugaccguuagcuggaacuccggggcucugacaagcggagugcacaccuucccggccguccuucagucuuccggccuguauagccucucuagcguggugacaguccccuccucuagccugggcacccagacguacaucuguaauguuaaucauaagccuuccaacacaaaaguggacaagaaggcggagcccaaaagcugcgauaagacccacacauguccucccugcccggccccugaacuucucgggggacccucuguguuucuguucccucccaaacccaaggacacccugaugauuucccgcaccccugaggucacaugugugguuguggaugucagccaugaggacccggaagugaaauuuaauugguauguugauggcguggagguccacaacgcuaagacgaaacccagagaagaacaauacaauucuaccuaucggguggucuccgugcugacaguucuccaucaggacuggcugaacgggaaggaguacaagugcaaagugagcaauaaggcccuuccugcucccaucgagaaaaccaucuccaaggccaaaggacagccucgcgagccccaggucuauacacugccgccuucuagagaugaacucaccaagaaccaagugagccugacgugucuuguuaagggcuucuaccccuccgacauugcgguggagugggaaucuaaugggcagccugagaacaauuacaaaacaacacccccuguccuggacagcgauggauccuuuuuccucuauagcaagcugaccguggacaaaucucgguggcagcaaggcaacguguuuuccugcagcguuaugcacgaggcccugcacaaccauuacacccagaagucucucucccugagccccggcaaa

SEQ ID NO: 38693 - RNA, 645 nt, Artificial Sequence
  derived and/or modified sequence opt5 from Iodine_(131I)_Derlotuximab_biotin_LightChain1
gagaacgugcugacccagagccccgccaucauguccgcuucuccuggcgaaaaggucacaaugacgugcagagccagcuccucuguuagcuccucuuaccuccacugguaucaacagaaaagcggggcguccccgaagcuguggauuuacagcaccucuaaucuugcuuccggagugcccgcccgguucagcggcucuggguccggaacaagcuauucucugaccaucuccagcguggaggccgaagacgcugccacauacuauugucagcaguacuccggcuauccucucaccuuugggggaggcacaaaacuggagauuaagcgcaccgucgcugcccccucuguguucaucuuuccucccagcgaugaacaacuuaaauccggcacggcgagcguugugugccugcucaacaauuucuacccuagagaggccaagguccaguggaagguggacaacgcucugcagucuggaaauucccaggagagcguuaccgaacaagauucuaaagacagcacauacucccugucuagcacccucacacuguccaaggccgauuaugagaaacauaagguguacgcuugugaagucacccaccaggggcuuagcucuccggugacgaaauccuuuaaccggggcgagugc

SEQ ID NO: 38694 - RNA, 1344 nt, Artificial Sequence
  derived and/or modified sequence opt5 from Ipilimumab_HeavyChain
caggugcaacuggucgagagcggcgggggaguugugcagcccggcagaucccuccggcugucuugcgccgcuagcggguucaccuuuuccucuuacacaaugcacugggugcgccaggccccuggaaagggccuugaaugggucacguucaucagcuaugacgggaacaauaaauacuaugcggauuccgugaagggaagauuuaccauuucucgggacaacagcaaaaauacacuguaccuccagaugaacucccugcgcgcugaggauaccgccaucuauuacugugccagaacaggcuggcuuggcccguucgacuauugggggcaaggaacccugguuacagugagcucugcuuccaccaagggccccagcgucuuuccucucgcccccucuuccaaaagcacgucugggggaaccgcugcccugggcugccuggugaaggauuacuucccugaacccguuacaguguccuggaauagcggggcgcucaccuccggaguccauacauuuccugccgugcugcagucuagcggccuuuacucccugagcucuguggucaccguuccguccagcucucucggcacgcagacauauauuuguaacgugaaucacaagcccagcaacaccaaaguggacaagcgggucgagccuaaauccugcgauaagacacauaccugucccccuugccccgcuccggaacugcuugggggaccuucuguguuccuguuucccccuaaacccaaggacacccucaugaucagccgcacacccgagguuacguguguggucguggauguuucccacgaggacccugaagugaaguucaauugguacgucgauggcguggagguccauaacgccaaaaccaagccgagagaagaacaguauaauagcacauaccgggugguuucugugcugaccguccugcaccaagacuggcucaacgggaaagaguauaagugcaaaguguccaauaaggcucugcccgccccuauugagaaaacaaucagcaaggcgaagggacagccccgcgagccucagguuuacacccuucccccgucuagagaugaacugacgaaaaaccaggugucccucacaugucuggucaagggcuuuuauccuagcgacaucgccguggagugggaauccaaugggcaacccgagaacaacuacaaaaccaccccucccgugcuugacucugauggcagcuucuuucuguacuccaagcucacaguugacaaaucucgguggcagcagggaaaugucuucagcugcuccgugaugcacgaggcucugcauaaccacuauacccaaaagagccugucucucuccccuggcaag

SEQ ID NO: 38695 - RNA, 645 nt, Artificial Sequence
  derived and/or modified sequence opt5 from Ipilimumab_LightChain
gagaucgugcugacccagagccccggcacacucagccugucuccuggggaaagagccacgcuuagcugccgggcuucccaaucugucggaagcuccuaccuggccugguaucagcagaagccgggccaggcgccccgccuccugauuuacggggcuuucucuagagccaccggaaucccugaccgguuuagcggcuccgggagcggaacagauuucacccuuacaauuucucgccuggagcccgaagacuuugccguuuauuacugucaacaguauggcuccagcccuuggaccuucggccaggggacaaaaguggagaucaagagaaccguggcugcccccucugucuuuauuuucccuccguccgaugaacagcucaaaagcggaacggcuucugugguuugccugcugaacaauuuuuacccccgggaggccaaggugcaauggaaagucgacaacgcgcuccaguccggcaauagccaggaguccgugaccgaacaggauucuaaggacagcacauauucccugagcucuacccuuacacuguccaaggccgauuacgagaaacacaagguuuacgcuugugaagugacccaucaagggcucagcucuccugucacgaaauccuucaaccgcggagagugc

SEQ ID NO: 38696 - RNA, 186 nt, Artificial Sequence
  derived and/or modified sequence opt5 from Iratumumab_HeavyChain1
caggugcaacugcagcaguggggcgccgggcuccugaagcccagcgagacccuuucccugacaugcgcugucuacggaggcucuuucagcgccuauuacugguccuggaucagacagccuccggggaaaggacucgaauggauuggcgacuauugggggcaaggaucucugguuacggugagcucc

SEQ ID NO: 38697 - RNA, 321 nt, Artificial Sequence
  derived and/or modified sequence opt5 from Iratumumab_LightChain1
gacauccagaugacccaaagccccacaucccugucugccagcgugggcgauagagucacgauuaccugccgggcuucccaggggaucucuagcuggcucacaugguaccagcagaagccugagaaagccccgaagucccugauuuaugcggcuucuagccuucaauccggaguucccagccgcuucucuggcuccgggagcggaaccgacuuuacacugaccaucucuucccuccagccugaagauuucgccacauacuauugucagcaguacgacagcuaucccauuaccuuuggccaagggacgagacuggagaucaaa

SEQ ID NO: 38698 - RNA, 1350 nt, Artificial Sequence
  derived and/or modified sequence opt5 from Isatuximab_HeavyChain1
caggugcaacugguccagagcggcgccgagguugcuaagcccgggaccuccgugaaacucucuugcaaggccagcggauacacauucacggacuauuggaugcagugggugaaacagagaccuggccaagggcuggaauggaucggaaccauuuacccgggcgauggggacacaggauaugcgcagaaguuucagggcaaagcuacccuuacagccgauaaguccucuaagaccgucuacaugcaccugagcucccucgccucugaggacagcgcuguguauuacugugcccggggcgauuauuacggguccaacagccuggacuacuggggacagggcacaucuguuaccguguccagcgcuucuacgaaagggcccuccgucuucccucuugcccccagcucuaaguccaccagcggaggcacagcggcccuggggugccucgugaaagauuauuuuccugaacccguuaccguguccuggaacucuggagcucugacaagcggcguccauaccuucccugccgugcugcaauccagcggccucuacucucuguccagcguggucacgguuccgucuagcucccuugggacacagaccuauaucuguaaugugaaucacaagcccucuaacacaaaaguggacaagaaggucgagccuaaaagcugcgauaagacccauaccugucccccuugccccgcuccggaacugcucggaggcccuuccguguuucuguuucccccuaaacccaaggacacacuuaugauuagccgcacgcccgagguuaccuguguggucguggauguuucucacgaggacccugaagugaaauuuaauugguacgucgaugggguggagguccauaacgccaagacaaaaccgagagaagaacaguauaauuccaccuaccgggugguuagcgugcugacaguccuccaccaggacuggcugaacggaaaggaguauaagugcaaagugucuaauaaggcgcugcccgccccuaucgagaaaaccauuuccaaggcuaaaggccaaccccgcgagccucagguuuacacgcuucccccgagcagagacgaacugacaaagaaccaggugucccuuaccugucuggucaagggguucuacccuucugauaucgccguggagugggaaagcaauggacaacccgagaacaauuauaaaaccacaccucccgugcucgacuccgauggcucuuucuuccuguacagcaagcucaccguugacaaaucccgguggcagcagggcaacgucuuuagcugcucugugaugcacgaggcucugcauaaucacuauacacagaagucccucagccugucuccugggaaa

SEQ ID NO: 38699 - RNA, 642 nt, Artificial Sequence
  derived and/or modified sequence opt5 from Isatuximab_LightChain1
gacaucgugaugacccagagccaccuguccaugucuacaagccucggcgaucccgucuccauuacgugcaaggccucucaagacguuagcaccgugguggcuugguaccagcagaaaccugggcaguccccgagacggcugaucuauucugccagcuaccgcuauauuggaguccccgauagauucacaggcuccggggcgggaaccgacuuuacauucaccaucagcucugugcaagcugaggaucuugccguuuacuauugucagcagcauuacuccccucccuauacauuuggcgggggaaccaagcuggaaauuaaacggacgguggccgcuccuagcgucuucaucuuucccccuucugacgagcagcucaaguccggcaccgccagcgugguuugccugcuuaacaauuucuacccgcgcgaagcuaaagugcaauggaaggucgauaacgcccugcagucuggcaauucccaggagagcgugacagaacaggacuccaaggauucuaccuacagccucuccagcacacugacccugucuaaagcggacuaugagaagcacaaaguguacgccugugaggucacgcaucaagggcucuccagccccguuacaaagucuuuuaacagaggagaaugc

SEQ ID NO: 38700 - RNA, 1347 nt, Artificial Sequence
  derived and/or modified sequence opt5 from Itolizumab_HeavyChain1
gaggugcagcuggucgaaagcggcgggggacucguuaagcccggcgggucccugaaacuuucuugcgccgcuagcggauucaaguuuuccagauacgccaugucuugggugcggcaagcgccuggcaaacgccuggaguggguggcuaccaucagcuccgggggaucuuauauuuacuauccggacagcgucaagggcagauucacaaucucccgggauaacgugaaaaauacgcucuaccugcagaugagcucucuucgcuccgaagacaccgccauguauuacugugccagacgggauuaugaccuggauuacuuugacagcuggggccaggggacacucguuaccgugucuuccgcuagcacaaagggacccucugucuucccucuggcccccuccagcaaguccaccucuggcgggacagcugcccugggaugccucgugaaagauuacuuuccugagcccguuaccgugagcuggaacuccggcgcgcugacgagcgggguccacaccuucccugccgugcuucagucuuccggacuguauagccucucuagcguggucacaguuccguccucuagccugggcacccaaacauacauuuguaaugugaaccauaagcccuccaauaccaaaguggacaagaaagucgaaccuaagagcugcgauaagacgcacacaugucccccuugccccgcuccggagcuucugggcgggccuucuguguuucucuuucccccuaaacccaaggacacccugaugaucucccgcacacccgagguuaccuguguggucguggauguuagccaugaagacccugaggugaaauucaacugguaugucgauggaguggaaguccacaaugccaagaccaaaccgagagaggagcaguacaacucuacauaucgggugguuuccgugcugacgguccuccaucaggacuggcugaauggcaaggaauacaaaugcaaggugagcaacaaggcccuucccgcuccuauugagaaaaccaucuccaaggcgaaagggcagccccgcgaaccucaaguuuauacacugcccccgucuagagacgagcucaccaagaaucaggugagccugacaugucuugucaaaggauucuacccuuccgauaucgccguggaaugggagucuaacggccagcccgagaauaacuacaagaccacgccucccgugcuggacagcgauggguccuuuuuccucuauagcaagcugacaguugacaaaucucgguggcagcaaggaaaugucuuuuccugcagcgugaugcacgaagcucugcacaaccauuacacccagaagucucucucccugagcccuggcaaa

SEQ ID NO: 38701 - RNA, 642 nt, Artificial Sequence
  derived and/or modified sequence opt5 from Itolizumab_LightChain1
gacauccagaugacccaaagccccuccucucugagcgccuccgugggcgauagagucacaauuacgugcaaggcuucucgggacauccgcagcuaccucaccugguaucagcagaaaccugggaaggccccgaaaacacugauuuacuaugcgaccucccuugcugauggaguucccucuagauucagcggcuccgggagcggacaggacuacucucugacaaucuccagccucgagucugaugacaccgccacauauuacugucugcaacacggcgaauccccuuuuacccuugggagcggaacgaagcuggagauuaaacggaccguggccgcucccucuguguucaucuuuccucccuccgaugaacagcucaagagcggcacagccuccgucgugugccugcugaacaauuucuauccucgcgaggcuaagguucaguggaaaguggacaacgcccuccagucuggcaauagccaagaauccgucaccgagcaggauagcaaggacucuacauacucccugagcucuacccuuacgcugagcaaagcggauuacgagaagcauaaaguguaugccugugaaguuacacaccaggggcucuccucuccggugaccaagagcuuuaacagaggagagugc

SEQ ID NO: 38702 - RNA, 1335 nt, Artificial Sequence
  derived and/or modified sequence opt5 from Ixekizumab_HeavyChain1
caggugcaacugguccagagcggcgccgagguuaagaaacccggguccucugugaaggugagcugcaaggcuuccggauacucuuucaccgacuaucacauccauugggucagacaggccccuggccaggggcucgaauggaugggagugauuaacccgauguacggcacaacggauuauaaucaacgguuuaaagggcgcguuaccaucacagcggacgagagcaccuccacagcuuacauggaacugucuagccuuagauccgaggauaccgccguguauuacugugcccgguaugacuacuucacaggaaccggcgucuacuggggccaggggacgcuggugaccguuagcucugcuuccacaaaaggacccagcguguuuccucucgcccccugcucucgcuccaccagcgaaucuacagcugcccugggcugucuugucaaggauuauuucccugagcccgugaccguguccuggaacagcggggcgcugacguccggaguccacacauuuccugccguucuccagucuagcggccuguacucccugagcucuguggugaccgucccguccagcucucucgggacaaagaccuauaccugcaauguggaccauaaacccagcaacacaaagguugauaaaagaguggaguccaaguacggaccucccuguccucccugcccggcuccugaguuccugggcggccccucugucuuucuuuucccucccaaacccaaggacacgcugaugauuagccggaccccugaggugacauguguuguggucgaugugucccaggaagacccggagguccaauuuaauugguauguggaugggguugaggugcacaacgccaagaccaaaccccgcgaagaacaguucaauagcacauacagagucgugucuguucucaccgugcugcaucaggacuggcuuaacggaaaggaauauaaaugcaaggucuccaauaaaggccugccuagcucuaucgagaagacgauuuccaaagcuaaggggcagccccgggaaccucaaguguacacacugcccccgagccaggaggagaugaccaagaaccaggugucccucaccugucugguuaaaggauuuuacccuucugauaucgccgucgaaugggagagcaauggccaacccgaaaacaauuauaagacaaccccucccgugcucgacuccgacgggucuuucuuucuguacagccgccuuacaguggauaaauccagauggcaggagggaaacgucuucagcugcucugugaugcacgaagcgcugcacaaucauuauacgcagaagucccucagccugucucuuggc

SEQ ID NO: 38703 - RNA, 657 nt, Artificial Sequence
  derived and/or modified sequence opt5 from Ixekizumab_LightChain1
gacaucgugaugacccagacaccccugagccucuccgucacgccuggccaaccggccucuauuagcugcagauccucucggagccugguucacucccgcgggaacaccuaccuucauugguaucugcagaagcccggacagucuccucagcuccugaucuacaaagugagcaauagauucauuggcgugcccgaucgguuuuccgggagcggaucuggcacagacuucacccuuaagaucucccgcgucgaggcugaagauguggggguuuauuacuguagccaaucuacacaucugccuuuuaccuucggacagggcacaaaacucgagauuaagagaaccguggccgcgcccuccgucuuuaucuucccuccgagcgacgaacagcugaaaucuggcacggcuuccgugguuugccugcucaacaauuuuuauccccgggaggccaaggugcaguggaaggucgauaacgcccugcaaagcggaaauucccaggaaucugugaccgagcaggacagcaaagauuccacauacagccuuucuuccacccugacacucagcaaggcugacuaugagaaacacaagguguacgccugugaagucacccaccaggggcugucuagcccuguuacgaaauccuucaaccgcggcgagugc

SEQ ID NO: 38704 - RNA, 1347 nt, Artificial Sequence
  derived and/or modified sequence opt5 from Labetuzumab_govitecan_HeavyChain1
gaggugcagcuggucgaaagcggcgggggaguugugcaacccggcagaucccuccggcugucuugcagcgccuccggguucgacuuuaccacauacuggaugucuugggugcgccaggcuccuggaaagggccuugaguggaucggggaaauucacccggauagcuccacgaucaacuaugcccccucucugaaagacagauucaccauuagccgggauaaugcgaagaacacacucuuucugcagauggacucccuucgcccugaggauaccggagucuacuucugugcuagccuguauuuuggcuuccccugguuugccuacuggggccaggggacaccugugaccguuucuuccgccagcacaaaaggacccucuguguucccucucgcuccguccagcaagucuaccuccggcgggacggccgcucugggaugccuggucaaagacuauuuucccgaaccugugaccguuagcuggaacuccggcgcccucacaucuggggugcauaccuuccccgcgguccugcaaagcuccggacuuuacagccugucuuccguggugacagucccuagcucuagccucggcacccagacguauaucuguaauguuaaucacaagcccuccaacacaaagguggauaaaagaguggagccgaagucuugcgacaaaacccauacauguccucccugcccugcccccgagcugcuuggcgggcccagcgucuuucuguucccuccgaagcccaaagauacccucaugauuucccggaccccugaagugacauguguuguggucgacgugagccacgaggaucccgaaguuaaguuuaauugguacguggacggagucgaggugcauaacgcuaagacgaaaccucgcgaggaacaguacaauucuaccuauagagucguguccguucugacagugcugcaccaggauuggcucaacggcaaggaguacaaaugcaaggucagcaauaaagcccugcccgcuccgaucgaaaagaccaucucuaaagccaaggggcaaccucgggagccccagguguauacacuuccucccucccgcgaagagaugaccaagaaccagguuagccugacgugucucgugaaaggauucuacccuuccgacauugcggucgagugggaaucuaauggccagcccgagaacaauuauaagacaaccccgccugugcuggacagcgauggguccuucuuucuuuacucuaaacugaccguggacaagagcagauggcaacagggaaacguuuucuccugcagcgucaugcacgaagcccuccauaaccacuauacacagaaaucucugucccugagccccggcaag

SEQ ID NO: 38705 - RNA, 639 nt, Artificial Sequence
  derived and/or modified sequence opt5 from Labetuzumab_govitecan_LightChain1
gacauccagcugacccaaagccccuccucucucagcgccuccgugggcgauagagucacaauuacgugcaaggcuucucaggacguugggaccagcguggccugguaccagcagaaaccuggaaaggcgccgaaacugcuuaucuauuggacauccacccggcacacaggcgugcccucucgcuucagcggguccggaagcggcaccgauuuuacauucaccauuucuucccugcaaccugaggacaucgcuacguacuauugucagcaguacagccucuauagaucuuuugggcagggaaccaaggucgaaauuaaacggacaguggccgcccccuccguuuucaucuuuccucccagcgaugagcaacugaagucuggcaccgcuuccguggucugccuucugaacaauuucuacccucgcgaagccaaggugcaguggaaaguugacaacgcucuccagagcggcaauucccaggagucugugacagaacaagauagcaaggacuccaccuauagccugucuuccacgcugacacucagcaaagccgauuacgagaagcauaaagucuacgcgugugaggugacccaccaggggcugucuagcccggugacaaaguccuuuaacagaggagaaugc

SEQ ID NO: 38706 - RNA, 1341 nt, Artificial Sequence
  derived and/or modified sequence opt5 from Lambrolizumab_HeavyChain1
caggugcaacugguccagagcggcguugaggugaagaaacccggggccuccgugaaggucucuugcaaagcuagcggauacaccuucacaaacuauuacauguauugggugagacaggccccuggccaggggcucgaauggaugggaggcaucaauccguccaacgggggaacgaauuuuaacgagaaguucaaaaaucggguuacccugacaaccgacucuagcacaaccacagcguacauggaacuuaagucccugcaauuugaugacaccgcuguguauuacugugcccgcagagauuaucgguucgacaugggcuuugauuacuggggccaggggacgaccgucacagugucuagcgccuccaccaagggacccagcguuuucccucucgcucccugcucucgcuccacaagcgagucuaccgccgcucugggcugucuugugaaagacuacuuuccugaacccgucacgguguccuggaacagcggggcccugacaucuggagugcacaccuucccugcgguccuccaguccagcggccuguauucccugucuagcguugugacagugccguccagcucucucgggaccaagaccuacacaugcaaugucgaucauaaacccuccaacacgaagguggacaaaagaguugagagcaaguauggaccucccuguccucccugcccggccccugaguuucugggcggccccucuguguuccuuuuuccucccaagcccaaagauacccugaugauuagccggacaccugaagucaccugugugguuguggacgucucccaggaggauccggaagugcaauucaauugguacgucgacgggguggagguucacaacgcuaagacaaaaccccgcgaggaacaguuuaauucuaccuauagaguggucagcgugcucacgguucugcaucaggauuggcuuaacggaaaggaguacaaaugcaagguguccaauaaaggccugccuagcucuaucgaaaagacaauuuccaaggccaaagggcagccccgggagccucaagucuauacccugcccccgagccaggaagagaugaccaagaaccaggugucucucacaugucuggugaaaggauucuacccuuccgacaucgcuguugagugggaaagcaauggccaacccgagaacaacuacaagaccacaccucccguccucgacuccgaugggucuuucuuucuguauagccgccuuacgguggacaaauccagauggcaggaaggaaauguguucucuugcagcgucaugcacgaggcccugcauaaccacuacacccagaagucccucagccugucucuuggcaag

SEQ ID NO: 38707 - RNA, 654 nt, Artificial Sequence
  derived and/or modified sequence opt5 from Lambrolizumab_LightChain1
gagaucgugcugacccagagccccgccacacucucccugucuccuggcgaacgggcuacgcuuagcugccgggccuccaagggggucucuaccagcggauacuccuaucugcacugguaccaacagaaaccgggccaggcgccccgccuccugauuuaucuugcuucuuaccuggagagcgggguuccugccagauucuccggaagcggcucugggacagacuuuacccucacaaucuccagccuggaacccgaggauuucgccguguauuacugucagcauucucgggaccugccucucaccuuuggaggcggcacaaagguggaaauuaaacgcaccgucgcugcccccuccguguucaucuuuccuccgagcgaugagcaacugaagucugggacggcuuccguugugugccuucugaacaauuucuaucccagagaggccaaaguccaguggaagguggacaacgcgcuccagagcggaaauucccaggaaucuguuaccgagcaagauagcaaggacuccacauacagccugucuuccacccuuacacugagcaaagccgauuacgaaaagcacaaaguguaugcuugugaggucacccaucagggccucucuagcccugugacgaaguccuuuaacagaggggagugc

SEQ ID NO: 38708 - RNA, 669 nt, Artificial Sequence
  derived and/or modified sequence opt5 from Lampalizumab_HeavyChain1
gaggugcagcugguccaaagcggccccgaacucaagaaaccuggggccuccguuaaggugucuugcaaagcuagcggauacaccuucacaaacuauggcaugaauugggugagacaggccccggggcagggacuggaguggaugggcuggaucaacacguacaccggggaaacaaccuaugcggacgauuuuaagggacgguucgucuuuucccuugacacaucugugagcaccgcuuaccugcagauuuccucucucaaagccgaggauacagccguuuauuacugugaacgcgagggcggcgugaauaacugggggcaaggaacccuggucacggugagcuccgcuagcaccaagggccccucuguuuucccucuugcccccuccagcaagucuacauccgggggaaccgcugcccugggcugccucgugaaagacuauuuuccugagcccgucacagugagcuggaauagcggggcgcugaccuccggagugcacacguucccugccguccugcagagcuccggccucuacucucugagcuccguugugacagugccgucuucuucccuuggcacccagacauacaucuguaacgucaaucauaagcccagcaacaccaaaguggauaagaaaguugaaccuaagucuugcgacaagacccacaca

SEQ ID NO: 38709 - RNA, 642 nt, Artificial Sequence
  derived and/or modified sequence opt5 from Lampalizumab_LightChain1
gacauccaggugacccaaagccccuccucucugagcgccuccgucggcgauagaguuacaauuacgugcaucaccucuacagacauugaugacgauaugaacugguaccagcagaaaccugggaaagugccgaagcuccugaucagcggaggcaauacccuucggcccggggugccuucccgcuucucuggaagcggcuccgggacagacuuuacccugacaauuagcucucuccagcccgaggaugucgcuaccuauuacugucugcaauccgacagccuuccuuauacguucggacagggcaccaaaguggaaaucaagagaacaguugccgcgcccucuguguuuaucuucccuccguccgaugagcagcugaaaagcggcaccgcuucugucgugugccuccugaacaauuuuuacccccgggaagccaagguucaguggaagguggacaacgcccugcaauccgggaauagccaggaguccgucacagaacaggauucuaaagacagcaccuauucccucagcucuacgcugacacuuuccaaggcugauuacgagaaacacaagguguaugccugugaggugacccaucagggacugagcucuccugucacaaagagcuucaaccgcggcgaaugc

SEQ ID NO: 38710 - RNA, 1353 nt, Artificial Sequence
  derived and/or modified sequence opt5 from Lanadelumab_HeavyChain1
gaggugcagcugcucgaaagcggcgggggacugguccaacccggcgggucccuuagacugucuugcgccgcuagcggauucaccuuuucccacuacaucaugauguggguucggcaggccccuggcaaggggcucgagugggugucuggaauuuauagcuccggcggcaucacaguguacgcggacucugucaaagggcgcuucacgauuagcagagauaacuccaagaauacccuguaucuucagaugaacagccugcgggcugaagacacagccguguacuauugugccuaccgcagaaucggaguuccgcggcgcgaugaguuugacauuuggggccaggggaccauggugacagucucuuccgcuagcaccaaaggacccucuguguucccucucgcccccuccagcaagucuacauccggcgggaccgcugcccugggaugccugguuaaagauuauuuuccugaacccgugacggucagcuggaacuccggcgcgcucaccucuggcgugcauacauucccugccgugcugcaaagcuccgggcuuuacagccugucuuccgucguuaccgugccgagcucuagccucggaacacagaccuacaucuguaaugugaaucacaagcccuccaacacgaaggucgacaaaagaguggagccuaagucuugcgauaaaacacauaccugucccccuugccccgcuccggagcugcuuggcgggccuagcguuuuucuguuucccccuaagcccaaagacacacucaugaucucccggacccccgaagugaccugugucgugguugaugugagccacgaggacccugaagucaaguucaauugguauguggauggagucgaggugcauaacgccaagacaaaaccgcgcgaggaacaguacaauucuacguauagaguuguguccguccugaccgugcugcaccaggacuggcucaacggcaaggaguacaaaugcaagguuagcaauaaagcucugcccgccccuauugaaaagacaaucucuaaagcgaaggggcaaccccgggagccucagguguauacccuucccccgucccgcgaagagaugacaaagaaccaggucagccugaccugucucgugaaaggauucuacccuuccgauauugccguggagugggaaucuaauggccagcccgagaacaauuauaagacgacaccucccguucuggacagcgacggcuccuuuuuccuuuacucuaaacugaccgucgauaagagcagauggcaacaggggaacguguuuuccugcagcgugaugcacgaagcucuccauaaccacuacacccagaaaucucugucccugagcccugga

SEQ ID NO: 38711 - RNA, 639 nt, Artificial Sequence
  derived and/or modified sequence opt5 from Lanadelumab_LightChain1
gacauccagaugacccaaagccccuccacacugucugccagcgugggcgauagagucacgauuaccugccgggcuucccagucuaucagcuccuggcucgccugguaccagcagaagccugggaaagcgccgaagcugcuuauuuauaaggcuucuacacuggagagcggaguucccucccgcuucagcggcucuggguccggaaccgaauuuacacucaccaucagcucucugcaaccugacgauuucgccacauacuauugucagcaguacaacaccuauuggacguuuggccaggggaccaaaguggagauuaaaagaacaguggccgcucccuccgucuucaucuuuccucccagcgacgaacaacuuaagucuggaaccgccuccgugguuugccugcucaauaacuucuacccucgggaggcuaaggugcaguggaaagucgauaaugcccugcagagcggcaacucccaggaaucugugacagagcaagacagcaaggauuccaccuauagccugucuuccacgcucacacugagcaaagcggacuacgagaagcacaaaguuuacgccugugaagugacccaucagggccuuucuagcccggucacaaaguccuuuaaucgcggggagugc

SEQ ID NO: 38712 - RNA, 1317 nt, Artificial Sequence
  derived and/or modified sequence opt5 from Landogrozumab_HeavyChain1
gaggugcagcuggucgaaagcggcgggggacucguucaacccggcgggucccugagacuuucuugcgccgcuagcggacugaccuucucccgguacccuaugucuugggugcgccaggccccgggcaaggggcucgugugggucagcgcgaucacauccucuggaggcagcacguauuacuccgacaccgugaaaggcagauuuacaauuagccgggauaacgcuaagaauacccuguaucuucagaugaacucucugcgcgccgaggacacagccguuuacuauugugcuagacuccccgauuacugggggcagggaacccuggugacagucuccagcgccucuaccaaaggcccuuccguguucccccuggcuccuugcagccggucuacguccgaaagcaccgccgcgcucgggugucugguuaaggacuauuuucccgagccugugacagucuccuggaacucuggagcccuuaccagcggcgugcacacauucccggcugugcugcaauccagcgggcucuacucucuguccagcgucguuaccgugcccucuagcucccuuggaacgaaaacauauaccugcaauguggaucauaagccuucuaauacaaaggucgacaaacgcguggaaagcaaguacgggcccccuugucccccgugcccugcccccgaguuucugggcggcccuuccguuuuccucuuuccucccaaacccaaggauacccugaugaucagcagaaccccggaggugacaugugucgugguugacgugucucaggaagaucccgagguccaguucaacugguacguggacggagucgaagugcacaaugcuaaaacgaagccucgggaggagcaguuuaacuccaccuaucgcguugugagcguccugacagugcuccaucaagauuggcugaauggcaaggaauacaaaugcaagguuucuaacaaagggcuucccuccagcauugagaagaccaucuccaaagccaagggacagccuagagaaccccagguguauacacugccgccuucucaggaggaaaugaccaaaaaucaagucagccucacgugucuggugaagggcuucuaccccuccgacauugcgguggagugggagucuaacgggcagccugaaaauaacuauaagacaacacccccuguucuugauagcgacggauccuuuuuccuguacagccggcucaccgucgacaaaucucgcuggcaggagggcaauguguuuuccugcagcgugaugcacgaagcccugcauaaccacuacacccaaaagucucugucccucagccugggc

SEQ ID NO: 38713 - RNA, 645 nt, Artificial Sequence
  derived and/or modified sequence opt5 from Landogrozumab_LightChain1
gagaucgugcugacccagagccccggcacacucucccugucuccuggggaacgggccacgcuuagcugccgggcuuccucuagcgucuccucuagcuaccugcacugguaucaacagaagccgggacaggcgccccgccuccugauuuacuccaccagcaaccuuguugccggcaucccugacagauucucuggguccggaagcggcacagauuuuacccugacaauuucucggcucgagcccgaagacuucgcuguguauuacugucagcaucacuccggguaucauuuuaccuucggaggcggcacaaaaguggagaucaagcgcaccgucgccgccccuagcguguuuauuuuucccccuucugaugaacaacugaaauccgggacggcuagcguugugugccugcucaauaacuucuacccgagagaggccaagguccaguggaaaguggacaaugcucugcaguccggaaacucucaggagagcguuaccgaacaagauuccaaggacagcacauauucucuuuccagcacccugacacucucuaaggccgauuacgagaaacacaagguguacgcgugugaagucacccaucagggccugagcucccccgugacgaaaucuuucaauagaggggagugc

SEQ ID NO: 38714 - RNA, 1344 nt, Artificial Sequence
  derived and/or modified sequence opt5 from Laprituximab_emtansine_HeavyChain1
caggugcaacugguccagagcggcgccgagguugcuaagcccggggccuccgugaaacucucuugcaaggcgagcggauacaccuucacauccuauuggaugcagugggugaaacagagaccuggccaagggcuggaauguaucggaacgauuuacccgggcgacggggauaccacauauacccagaaguuucagggaaaagcuacacuuaccgccgacaagucuagcuccacagccuacaugcagcugucuagccuccgguccgaggauagcgcugucuauuacugcgcccgcuaugacgcucccggcuacgccauggauuacuggggccaagggacccuggugacgguuucuuccgcgagcaccaagggaccuucuguguucccccuugccccuuccagcaaaucuacauccggcgggaccgcugcccugggaugucucgucaaggacuauuuucccgaaccugugacaguuagcuggaacuccggcgcucugaccucuggggugcacacguucccggccguccugcagagcuccggacucuacagccugucuuccguggugacaguccccagcucuagccuuggcacccagacauauaucugcaauguuaaccauaaaccuuccaauaccaagguggauaaaaagguggagcccaagucuugugacaaaacccacacaugcccucccuguccggcgccugaacugcucggcgggcccagcgucuuucuguucccucccaagcccaaagauacgcuuaugauuuccagaaccccugaggugacaugcguuguggucgacgugagccaugaggauccggaaguuaaguuuaacugguacguggacggagucgaggugcacaaugccaaaaccaagccccgggaggaacaguauaacucuacauaccgcgucguguccguucugaccgugcuccaucaagauuggcugaauggcaaagaguauaaguguaaggucagcaacaaagcucugccugcccccaucgaaaagacgauuucuaaagcuaaggggcagccuagagagccccagguguacacacucccgccuucccgggacgaacugaccaaaaaucaaguuagccuuaccugccuggugaagggauucuaccccuccgacaucgccgucgagugggaaucuaacggccagccugagaauaacuauaagacaacacccccugugcucgauagcgacggguccuuuuuccuguacucuaaacuuaccguggauaagagccgcuggcagcagggaaaugucuuuuccuguagcguuaugcacgaggcccugcacaaccauuauacgcaaaaaucucucucccugagccccggc

SEQ ID NO: 38715 - RNA, 642 nt, Artificial Sequence
  derived and/or modified sequence opt5 from Laprituximab_emtansine_LightChain1
gacauccagaugacccaaagccccuccucucugagcgccuccgugggcgauagagucacaauuacgugccgggcuucucaggacaucaacaauuaccucgccugguaucagcacaaaccugggaaaggaccgaagcugcuuauucauuacaccagcacacugcaccccggcaucccuucccgcuucucugggagcggauccggcagagauuauagcuuuucuauuuccagccucgagcccgaagacaucgcgaccuacuauugucugcaguacgauaaccuucuguauacauucgggcaaggaaccaaacucgagaucaagcggacaguugcugccccuucuguguuuauuuuucccccuuccgacgaacagcugaaaagcggcaccgccucuguggucugccugcucaauaacuucuacccgcgcgaggcuaaggugcaguggaagguugauaaugcccugcaguccggcaacagccaagaauccgugacggagcaggacucuaaagauagcaccuacucccuuagcucuacacugacccucuccaaggcugacuaugagaaacauaaggucuacgccugugaagugacacaccaggggcugagcucucccguuaccaagagcuucaauagaggagagugc

SEQ ID NO: 38716 - RNA, 1314 nt, Artificial Sequence
  derived and/or modified sequence opt5 from Lealesoab_HeavyChain1
caggugcaacugcaggagagcggccccgaacucaagaaaccuggggagaccgucaagaucuccugcaaagccucuggauacacauucagaaacuauggcaauuggguuaagcaggcuccggggaaaggacugaaguggggcuggauuaacacguacaccggggaacccacauaugccgacgauuuuaagggacgguucgcguuuagccuugagaccuccgcuucuacagccuaccugcagaucaauaacgugaaaaaugaagacaccgccacauauuucugugcucgcaagggcugggauuuuaacggcagcucccucgacuacugggggcaaggaaccacggugaccgucucuagcgccaaaacaaccccucccuccguguauccucuggcucccggcagcgccgcgcagacaaauucuguuacccuugggugccuggugaagggauacuucccugagccggucacggugacauggaacuccggcagccucucuuccgggguucacaccuuucccgccgugcugcagagcgaucuguacacacucucuuccagcgucaccgugccuuccucucccagaccuagcgagaccgugacauguaaugucgcucaucccgccuccagcacgaaaguugacaagaagauugugccgcgggauugcggauguaaaccuugcaucuguaccgugcccgaagucucuuccguguucauuuuuccucccaagcccaaagacguucugacaaucacccuuacaccuaaggugaccugcgucgugguugauaucagcaaagacgauccggaggugcaguucucuugguuugucgacgauguggaaguccacacggcucaaacacagccccgcgaggagcaguucaacagcaccuuuagauccgugucugaacugccuauucaucaggacuggcucaauggcaaggaguucaaaugucggguuaacagcgccgcguuccccgccccuaucgaaaagaccauuuccaagacaaaaggccgccccaaggcuccgcaaguguauaccaucccucccccuaaagagcaggccaaggacaaagucagccugacaugcauuacggacuuuuuccccgaagauaucaccguggaguggcaguggaaugggcaaccugcugagaacuacaagaauacacagcccauuaacaccaacggaucuuauuuuguuuacuccaagcugaaugugcagaaaagcaacugggaagccggcaauacauucaccuguucuguccuucacgaggggcuccauaaccaccacacggaaaagucccugagccauuccccgggaaaa

SEQ ID NO: 38717 - RNA, 654 nt, Artificial Sequence
  derived and/or modified sequence opt5 from Lealesoab_LightChain1
gacauccagcugacccaaacaccccucagccugccugugucccuuggcgaucaggccucuauuagcugcagauccucucagagcaucguccacuccaacgggaauacguaccuggagugguaucuccagaagccgggacaaucucccaaccugcuuauuuacaaaguuagcaaucgguucuccggcgugccugaccgcuuuagcgggucuggauccggcaccgauuucacacugaagaucagcagaguggaagcugaggaccucggggucuauuacuguuuucagggaucucaugugcccccuaccuucggcggcgggacaaaacuggaaauuaagcgggccgaugcggcucccaccguuuccaucuuuccuccgagcucugagcagcugacauccggaggcgccagcguggucugcuuccucaacaauuuuuaucccaaagacaucaacgugaaguggaagauugauggguccgaacgccagaauggaguucugaacucuuggaccgaccaagauagcaaagacuccacguacucuagcuccacccuuacacugaccaaggaugaguaugagagacacaauagcuacacaugugaagccacccauaaaacgucuacaagcccuaucgugaaguccuucaaccggaaugagugc

SEQ ID NO: 38718 - RNA, 1335 nt, Artificial Sequence
  derived and/or modified sequence opt5 from Lebrikizumab_HeavyChain1
caggugacccugagagagagcggccccgcccucgucaagccuacacaaacgcugacccuuacaugcaccguuuccggguucucucugagcgcuuacuccgugaacuggauccggcagccgcccggaaaagcccucgaauggcuggcgaugauuuggggcgacgggaagaucguguauaauucugcucuuaaaagccgccugacaauuuccaaggauaccucuaaaaaccaggucgugcucacaaugaccaauauggacccuguugauacggccaccuacuauugugccggagacggcuacuaucccuacgcuauggauaacugggggcagggaagccuggugacagucuccagcgccucuaccaagggcccuuccguguuuccccuggcuccuugcagcagaucuacauccgagagcaccgccgcgcucggcugucugguuaaggacuauuucccggaacccgugacggucucuuggaacuccggggcccuuacaagcggagugcacaccuuuccugcugugcugcaauccucuggccucuacagccuguccagcgucguuacagugcccucuuccagccuugggaccaaaaccuacacaugcaauguggaucauaagccuucuaauacgaaagucgacaagcggguggagagcaaauauggacccccguguccucccugcccugcccccgaguuccugggcgggcccuccguuuuucucuucccuccgaagcccaaggauacccugaugaucucucgcacaccugaggugaccugugucgugguugacgugagccaggaggaucccgaaguccaguuuaacugguacguggacggagucgaggugcacaaugcuaaaacaaagccuagagaagaacaguucaacuccaccuaucggguugugagcguccugacggugcuccaucaagauuggcugaauggcaaagaguacaagugcaaaguuucuaacaagggccuucccuccagcauugagaaaacaaucucuaaggccaaggggcagccgcgcgaaccucagguguauacccugcccccuucccaggaagagaugaccaaaaaucaagucagccucacaugucuggugaagggauuuuaccccuccgacaucgcgguggaaugggagucuaacggccagccugagaauaacuauaaaaccacacccccgguucuugacagcgauggguccuucuuucuguacucuagacucacggucgacaagagccgguggcaggaaggaaacguguucuccugcagcgugaugcacgaggcccugcauaaucacuacacccaaaaaucucugucccucagccugggcaag

SEQ ID NO: 38719 - RNA, 654 nt, Artificial Sequence
  derived and/or modified sequence opt5 from Lebrikizumab_LightChain1
gacaucgugaugacccagagccccgauucccugucugucagccucggcgagagagccacaauuaacugccgggcuuccaagucuguugacagcuacgggaauagcuucaugcacugguaucaacagaaaccuggacagccgcccaagcugcuuaucuaccuggccucuaaccucgaaagcggcgugccugaucgcuuuuccgggagcggaucuggcacggacuucacccugacaauuuccagccuucaggcggaggauguggcugucuauuacugucaacagaauaacgaagaccccagaaccuuugggggaggcacaaaaguggagaucaagcggaccguugccgccccuucuguguucauuuuucccccuuccgaugaacagcugaaaagcggcacagcuucugucgugugccuccugaauaacuucuauccgcgcgaggccaagguucaguggaagguggacaaugcucugcaauccgggaacagccaggaguccgucaccgaacaggauucuaaagacagcacguacucccucagcucuacccugacacuuuccaaggccgauuaugagaaacauaagguguacgcgugugaagugacccaccagggacugagcucucccgucacaaaauccuuuaauagaggcgagugc

SEQ ID NO: 38720 - RNA, 1227 nt, Artificial Sequence
  derived and/or modified sequence opt5 from Lenercept_chain1
cuggugccccaccucggcgacagagagaagcgggauagcgucugcccucaggggaaauacauccauccgcagaacaauuccauuuguugcaccaagugucacaaaggaacauaucuguacaacgacugccccggcccugggcaggauacggacugucgcgaaugcgagucuggcagcuucaccgccuccgaaaaucaucuuagacacugucugucuugcagcaagugucggaaagagaugggacagguugaaaucuccucuugcacaguggaucgcgacaccgugugugggugcagaaagaaccaguaucggcauuacuggagcgagaaucucuuucaaugcuucaacuguucccugugccuuaauggaacaguccaccugagcugucaggagaagcagaacaccgugugcacaugucacgcuggcuuuuuccuccgcgaaaaugagugcguuucuuguuccaacugcaaaaagagccuggaauguaccaaacugugccucccccagauugagaaugugaagggcacggaggauucugggaccacagacaaaacccauacauguccucccugcccugccccggaacugcuuggaggccccuccgucuuucuguucccucccaagccuaaggauacccucaugaucagcagaacgcccgaggugacaugcguuguggucgacgugucucacgaagauccggaggugaaauuuaacugguaugucgacgggguugaagugcauaaugcgaagaccaaaccucgggaggagcaauacaacuccacauaucgcguggucagcgugcugaccguucuucaccaggauuggcugaauggaaaggaauacaaauguaagguguccaacaaagcucuccccgccccuauugagaagaccaucucuaaggccaaaggccagcccagagaaccccaggucuacacacugccuccgagccgggaggaaaugacgaagaaccaagugucccugaccugccucguuaaaggguucuaucccagcgacaucgcuguggagugggagucuaauggacagccugaaaacaauuacaagacaacacccccuguccuggacuccgauggcagcuuuuuccuuuauucuaaacugaccguggacaagagccgcuggcagcaaggcaacgucuuuuccuguucugugaugcacgaggcccuccauaaucacuacacccaaaagagccugucccuuagccccgggaaa

SEQ ID NO: 38721 - RNA, 1347 nt, Artificial Sequence
  derived and/or modified sequence opt5 from Lenzilumab_HeavyChain1
caggugcaacugguccagagcggcgccgagguuaagaaacccggggcuuccgugaaggugucuugcaaagccagcggauacuccuucaccaacuauuacauccacugggucagacaggcgccuggccagcggcucgaauggaugggguggauuaaugcuggaaacggcaauacaaaguauucucaaaaauuucaggggcgcgugacgaucaccagagacacaagcgccuccaccgccuacauggagcugucuagccuucgguccgaagauacagcuguuuauuacugugugcgcagacagcgguucccguauuacuuugacuacuggggacagggcacccuggucacagugagcucugccuccaccaagggccccagcguuuucccucucgcucccucuuccaagagcacgucugggggaaccgccgcgcugggcugccuugugaaagauuauuuuccugagcccgucacaguguccuggaacagcggggcccugaccuccggagugcauacauucccugcuguccuccaaucuagcggccuguacucccugagcucuguugugaccgugccguccagcucucucgggacgcagacauauauuuguaaugucaaccacaagcccagcaauaccaaaguggacaagcgcguugaaccuaaauccugcgauaagacacauaccugucccccuugccccgccccggagcugcuuggaggcccuucuguguuucuguuucccccuaagcccaaagacacccucaugaucagcagaacacccgaggucacgugugugguuguggaugucucccacgaagacccugaggugaaguucaacugguacgucgauggcguggaaguucauaaugcuaaaaccaagccgcgggaggagcaguauaacagcacauaccgcguggucucugugcugaccguucuucaccaggacuggcugaaugggaaagaauauaagugcaaaguguccaacaaggcccuccccgcgccuauugagaagacaaucagcaaagccaagggacaacccagagaaccucaggucuacacccugcccccgucucgggaggaaaugacgaaaaaucaggugucccugacaugucucgugaagggcuucuacccuagcgauaucgcuguugagugggaguccaacgggcaacccgaaaauaacuauaaaaccaccccucccguccuggacucugauggcagcuuuuuccuuuacuccaagcugacaguggacaagucucgcuggcagcagggaaacguguuuagcugcuccgucaugcacgaggcccuccauaaucacuauacccagaaaagccugucucuuuccccugggaag

SEQ ID NO: 38722 - RNA, 642 nt, Artificial Sequence
  derived and/or modified sequence opt5 from Lenzilumab_LightChain1
gagaucgugcugacccagagccccgccacacucuccgucucuccuggcgaaagagcuacgcugagcugccgggccucccaaucuguugggaccaacguggcgugguaccagcagaagccgggacaggcuccccgcgugcuuauuuauagcacauccucuagagccaccggcaucacagaccgguucagcggguccggaagcggcaccgauuuuacacugaccauuucucgccucgagccugaagacuucgccgucuacuauugucaacaguuuaauaaaagcccccugacguucgggggaggcaccaagguggagaucaaaagaacaguugcugccccuuccguguuuauuuuucccccuucugaugaacagcuuaaguccggcaccgcuagcgucgugugccugcucaacaauuucuacccgcgggaggccaaaguucaguggaagguggacaacgcgcugcaaucuggaaauucccaggagagcgucacagaacaggauuccaaggacucuaccuauagccuguccagcacgcucacacugucuaaagccgauuacgagaagcacaaaguguaugcuugugaagugacccaucaggggcuuuccagccccgucacaaagucuuucaaccgcggcgagugc

SEQ ID NO: 38723 - RNA, 1326 nt, Artificial Sequence
  derived and/or modified sequence opt5 from Lerdelimumab_HeavyChain1
gaggugcagcuggucgaaagcggcgggggaguugugcaacccggcagaucccuccggcugucuugcgccgcuagcggguucaccuuuuccucuuacggaaugcacugggugcgccaggccccuggcaaggggcuugagugggucgcggugaucugguaugacggaagcaacaaauacuaugcugauuccguuaagggcagauucacaauuucucgggacaauagcaaaaacacgcuguaccuccagauggauucccugcgcgccgaagacaccgccguguauuacuguggcagaacacuugagagcucucugugggggcagggaacccucgucacaguguccagcgcuucuaccaagggcccguccguuuuuccccuggccccuugcagccggucuacauccgaaagcaccgcugcccuggggugucucgugaaagauuauuuccccgagccugucacgguguccuggaacucuggagcgcugaccagcggcgugcauacauuucccgccguccuucaauccagcgggcuguacucucucuccagcguugugaccgugccuucuagcucccugggaacaaagaccuacacgugcaaugucgaccacaagccgucuaauacaaaaguggauaagcgcguugagagcaaauauggacccccuugucccuccugcccugcucccgaguuccuuggcgggccgagcguguuucuguucccucccaagccuaaagacacccucaugaucucuagaacacccgaggucaccugugugguuguggaugucucccaggaagaccccgaggugcaguuuaacugguacgucgauggaguggagguucauaaugccaagaccaagccucgggaagaacaguucaacagcacauaucgcguggucucugugcugacgguucugcaccaagacuggcucaauggcaaagaauacaagugcaaaguguccaacaaggggcugccgagcuccauugagaaaaccaucucuaaggcuaaaggacagcccagagaaccucaggucuauacacuucccccuagccaggaggagaugaccaagaaucaagugucccugacaugucucgugaagggcuuuuaccccucugauauugccguugaaugggagagcaacgggcagccggaaaauaacuauaaaaccacgccucccguccuggacuccgacggcagcuucuuucuuuacucucggcugacaguggauaagucccgcuggcaggagggcaauguguucagcugcucugucaugcaugaagcgcuccacaaccacuacacccaaaaaucccugagccugucucucggcaag

SEQ ID NO: 38724 - RNA, 645 nt, Artificial Sequence
  derived and/or modified sequence opt5 from Lerdelimumab_LightChain1
agcuccgagcugacccaggaccccgccgugucugucgcucucggccaaacaguuagaaucacgugccagggggauagccugcgguccuacuaugccucuugguaccagcagaagccuggacaagcgccggugcuugugauuuauggcaaaaacaaucgccccagcgggaucccugacagauucuccggaucuagcuccggcaacaccgcuagccugacaauuaccggggcccaggccgaagaugaggcugacuacuauuguaauucucgggauuccagcucuacacaccgcggagucuuuggcggcgggaccaagcucacagugcugggacagcccaaagccgcuccuuccguuacccuuuuucccccuagcucugaagaacugcaggccaacaaggcgacgcucgugugccugaucuccgacuucuacccgggcgccgucaccguggcuuggaaagccgauagcucccccguuaaggcugggguggaaacaaccacaccuucuaagcaaagcaauaacaaauaugccgcguccagcuaccugucucucacccccgagcaguggaagucccauagaagcuacucuugucaggucacgcacgagggaagcacaguggagaaaaccguggccccuacagagugcucc

SEQ ID NO: 38725 - RNA, 1353 nt, Artificial Sequence
  derived and/or modified sequence opt5 from Lexatumumab_HeavyChain1
gaggugcagcugguccagagcggcgggggaguugaaagacccggcgggucccuccggcugucuugcgccgcuagcggauucaccuuugacgauuacggcauguccugggugcgccaggccccugggaagggacuugagugggugucuggcaucaacuggaauggcgggagcacaggauaugcggacuccgucaaaggcagagugacgauuucucgggauaacgcuaagaauagccuguaccuccagaugaacucccugcgcgccgaagacaccgccguuuauuacugugcuaaaauccuuggggccggaagaggcugguauuucgaucugugggggaagggaacaaccgugacagucagcucugcuuccaccaaaggcccgagcguguuuccccucgccccuucuuccaagagcacaucuggcgggaccgcggcccugggaugccugguuaaggacuacuuccccgagccugugacggucuccuggaauagcggcgcucucaccuccggggugcacacauuucccgccgugcugcagucuagcggacuuuauucccugagcucugucguuaccgugccuuccagcucucucggcacacaaaccuacauuuguaacgugaaucauaaaccgagcaacacgaaggucgauaaacggguggaacccaaguccugcgacaaaacacacaccuguccucccugcccugcucccgagcugcuugggggaccgucuguuuuccuguuuccucccaagccuaaggauacacucaugaucagccgcacccccgaggugaccugugucgugguugacgugucccaugaagaucccgaggucaaauucaauugguacguggacggcgucgaagugcacaacgccaagacaaaaccuagagaggagcaguauaauagcacguaccggguugugucuguccugaccgugcugcaucaggauuggcucaacggcaaggaauauaaaugcaagguuuccaauaaagcgcugccggcccccauugagaagacaaucagcaaggcuaaagggcagccucgcgaaccccaaguguacacccuuccucccucuagagaggaaaugacaaagaaccaggucucccugaccugucucgugaaaggauuuuauccgagcgacaucgccguggagugggaguccaauggccagccugaaaacaacuacaagacgacacccccuguucuggacucugaugggagcuucuuucuuuauuccaaacugaccgucgacaagucucgguggcagcaaggaaauguguucagcugcuccgugaugcacgaggcucuccacaaccauuacacccaaaagagccugucucugucccccggcaaa

SEQ ID NO: 38726 - RNA, 1353 nt, Artificial Sequence; identical to SEQ ID NO: 38725
  derived and/or modified sequence opt5 from Lexatumumab_HeavyChain

SEQ ID NO: 38727 - RNA, 642 nt, Artificial Sequence
  derived and/or modified sequence opt5 from Lexatumumab_LightChain1
agcuccgagcugacccaggaccccgccgugucugucgcucucggccaaacaguuagaaucacgugccagggggauagccugcgguccuacuaugccucuugguaccagcagaagccuggacaagcgccggugcuugugauuuauggcaaaaacaaucgccccagcgggaucccugacagauucuccggaucuagcuccggcaacaccgcuagccugacaauuaccggggcccaggccgaagaugaggcugacuacuauuguaauucucgggauuccagcggaaaccacgucguguuuggcggcgggacaaagcucaccguucugggacagcccaaagccgcuccuucugugacacuuuuucccccuuccagcgaagaacugcaggccaauaaggcgacccucgucugccugaucucugacuucuacccgggcgccgugacgguugcuuggaaagccgauuccagccccgugaaggcuggggucgaaaccacaaccccuuccaagcaaucuaacaauaaauaugccgcgagcuccuaccugagccucacacccgagcaguggaagucucaucgcuccuacagcugucaggugacccacgagggaucuacgguggagaaaacagucgccccuaccgagugcagc

SEQ ID NO: 38728 - RNA, 642 nt, Artificial Sequence; identical to SEQ ID NO: 38727
  derived and/or modified sequence opt5 from Lexatumumab_LightChain

SEQ ID NO: 38729 - RNA, 1377 nt, Artificial Sequence
  derived and/or modified sequence opt5 from Libivirumab_HeavyChain1
caggugcaacuggucgagagcggcgggggaguugugagacccggccggucccuccgccugucuugcgccgcuagcggguucgccuuuuccgacuacucuaucaacugggugagacaggcgccuggaaagggccuugaaugggucgcuauuaucagcuaugaugggcggauuaccuacuaucgcgacuccgugaaaggaagauucacaaucucucgggaugacagcaagaauacgcuguaccuccagaugaacucccugcgcaccgaggauacagccguuuauuacugugccagacaguauuacgacuuuuggagcgggucuuccgugggccggaauuacgauggcauggacgucuggggacuuggcaccacagugaccguuagcucugcuuccacaaaagggccgagcguguucccccuggccccuucuuccaagagcaccuccggaggcacggcugcccucgggugccuggucaaagauuauuuucccgaaccugugaccgugucuuggaacagcggagcgcugacauccggcguccacaccuuccccgccguucuccaaagcucuggccuguacucccuuagcucuguggugacagucccuagcuccucucuggggacccagacguauauuuguaaugugaaccauaagccgagcaauacaaagguugacaaacgcguggagcccaaguccugcgauaaaacccacacauguccucccugcccugcucccgaacuccugggaggcccgagcgucuuucuuuucccucccaagccuaaagacacccugaugaucucuagaacccccgaggugacauguguuguggucgaugugucccaugaggaccccgaagucaaguuuaacugguacguggacgggguugaggugcacaaugccaagacgaaaccucgggaggaacaguauaacagcaccuaccgcgucgugucuguucucacagugcugcaucaggauuggcugaauggaaaggaguauaaaugcaaggucuccaacaaagcucucccggcccccaucgaaaagaccauuagcaaagcgaagggccaaccuagagagccccagguguacacacugccucccucccgggaagagaugaccaagaaucaggugucucuuacgugucugguuaaaggguucuacccgagcgacaucgccgucgaaugggaguccaacggacagccugagaauaacuauaagacaacacccccugugcucgauucugacggcagcuuuuuccuguacuccaaacuuaccguggauaagagccgcuggcaacagggcaacgucuuuucuugcuccgugaugcacgaagcucugcacaaucauuauacccagaaaagccucucucugucccccgggaag

SEQ ID NO: 38730 - RNA, 657 nt, Artificial Sequence
  derived and/or modified sequence opt5 from Libivirumab_LightChain1
gacaucgugaugacccagagcccccugucccucucugucacaccuggcgagccggccagcauuuccugcagaucuagccaaucccugcuucaccggucugggaacaauuaccuggauugguaucuccagaagcccggacauagcccucagcugcuuaucuacguuggcuccaaccgcgcuagcggggugcccgacagauucucuggauccggcagcgggacggaauauacccugaaaauuucucggguggaggccgaagaugucggaguguacuauuguaugcaggcgcuccaaacaccucgcaccuuuggccagggcacaaagcuggagaucaaaagaaccguugcugcccccuccguguucauuuuuccuccgagcgacgaacagcugaagucugggacagccuccgucgugugccuccugaauaacuucuacccccgggaggcuaaaguucaguggaagguggauaaugcccuucaaagcggaaacucccaggagucugucaccgaacaggacagcaaggauuccacguauagccugucuuccacccucacacugagcaaagcugacuacgagaagcacaaaguguacgccugugaagugacccaucagggccuuucuagcccugucacaaaguccuuuaaucgcggggagugc

SEQ ID NO: 38731 - RNA, 1350 nt, Artificial Sequence
  derived and/or modified sequence opt5 from Lifastuzumab_HeavyChain
gaggugcagcuggucgaaagcggcgggggacucguucaacccggcgggucccugagacuuucuugcgccgcuagcggauucuccuuuucugacuucgccaugagcugggugcggcaggcgccuggcaaggggcuggaguggguggcuaccaucggacgcgucgccuuucacacauacuauccggauuccaugaaaggcagauucacgauuucucgggacaacagcaagaauacccucuaccugcagaugaacucccuucgcgccgaagauacagcuguguauuacugugccagacaucggggcuuugacguugggcacuucgauuuuuggggacagggcacccuggugacagucagcucugcuuccaccaaagggcccagcguguucccucucgcccccucuuccaagagcacaucuggaggcaccgcggcccuggggugccugguuaaagacuauuuuccugagcccgugacggucuccuggaauagcggagcucucaccuccggcgugcauacauucccugccgugcugcaaucuagcggccuuuacucccugagcucugucguuaccgugccguccagcucucucgggacacagaccuauaucuguaacgugaaucacaagcccagcaacacgaaggucgauaaaaagguggaaccuaaauccugcgacaagacacauaccugucccccuugccccgcuccggagcugcuuggaggcccuucuguuuuucuguuucccccuaaacccaaggauacacucaugauuagccgcacccccgaggugaccugugucgugguugacgugucccacgaagauccugaggucaaguucaauugguacguggacggggucgaagugcacaacgccaaaacaaagccgagagaggagcaguacaauagcacguaucggguugugucuguccugaccgugcugcaucaggauuggcucaacggaaaagaauacaagugcaaaguuuccaauaaggcgcugcccgccccuaucgagaaaacaauuagcaaggcuaagggccaaccccgcgaaccucagguguauacccuucccccgucuagagaggaaaugacaaagaaccaggucucccugaccugucucgugaagggguucuacccuagcgacaucgccguggagugggaguccaauggacagcccgaaaacaauuauaaaacgacaccucccguucuggacucugauggcagcuucuuucuuuacuccaagcugaccgucgacaaaucucgguggcaacagggcaacguguucagcugcuccgugaugcacgaggcucuccauaaccacuauacccagaaaagccugucucuguccccugggaag

SEQ ID NO: 38732 - RNA, 657 nt, Artificial Sequence
  derived and/or modified sequence opt5 from Lifastuzumab_LightChain
gacauccagaugacccaaagccccuccucucugagcgccuccgugggcgauagagucacaauuacgugccggucuagcgagacccucguucacuccucugggaacacauaccuggaaugguaucagcagaagccuggaaaagcuccgaaacuucugaucuaccgcgugagcaauagauucuccggcgugcccagccgguuuucuggguccggaagcggcaccgacuucacacucaccauuucuucccugcagccugaggauuuugccacauauuacuguuuccaagggagcuuuaacccccuuaccuucggacagggcacgaaagucgaaaucaagcgcaccguggcggcuccuucuguuuuuauuuuucccccuuccgacgagcagcugaaaagcggcacagccuccguggucugccuccugaauaacuucuauccgagagaagccaaggugcaguggaagguugauaaugcucugcaaucugggaacagccaggaguccgugaccgagcaggacagcaaagauucuacauacucccucagcucuacccugacgcuuagcaaggccgacuaugaaaaacauaaggucuacgcuugugaggugacacaccagggacuguccucucccgugaccaagagcuucaaucggggcgaaugc

SEQ ID NO: 38733 - RNA, 1347 nt, Artificial Sequence
  derived and/or modified sequence opt5 from Lifastuzumab_vedotin_HeavyChain1
gugcagcuggucgagagcggcgggggacucguucaacccggcgggucccugagacuuucuugcgccgcuagcggauucuccuuuucugacuucgccaugagcugggugcggcaggcgccuggcaaggggcuggaauggguggcuaccaucggacgcgucgccuuucacacauacuauccggauuccaugaaaggcagauucacgauuucucgggacaacagcaagaauacccucuaccugcagaugaacucccuucgcgccgaggauacagcuguguauuacugugccagacaucggggcuuugacguugggcacuucgauuuuuggggacagggcacccuggugacagucagcucugcuuccaccaaagggcccagcguguucccucucgcccccucuuccaagagcacaucuggaggcaccgcggcccuggggugccugguuaaagacuauuuuccugaacccgugacggucuccuggaauagcggagcucucaccuccggcgugcauacauucccugccgugcugcaaucuagcggccuuuacucccugagcucugucguuaccgugccguccagcucucucgggacacagaccuauaucuguaacgugaaucacaagcccagcaacacgaaggucgauaaaaagguggagccuaaauccugcgacaagacacauaccugucccccuugccccgcuccggaacugcuuggaggcccuucuguuuuucuguuucccccuaaacccaaggauacacucaugauuagccgcacccccgaggugaccugugucgugguugacgugucccacgaggauccugaagucaaguucaauugguacguggacggggucgaggugcacaacgccaaaacaaagccgagagaagaacaguacaauagcacguaucggguugugucuguccugaccgugcugcaucaggauuggcucaacggaaaagaguacaagugcaaaguuuccaauaaggcgcugcccgccccuaucgagaaaacaauuagcaaggcuaagggccaaccccgcgagccucagguguauacccuucccccgucuagagaagagaugacaaagaaccaggucucccugaccugucucgugaagggguucuacccuagcgacaucgccguggaaugggaguccaauggacagcccgagaacaauuauaaaacgacaccucccguucuggacucugauggcagcuucuuucuuuacuccaagcugaccgucgacaaaucucgguggcaacagggcaacguguucagcugcuccgugaugcacgaagcucuccauaaccacuauacccagaaaagccugucucuguccccugggaag

SEQ ID NO: 38734 - RNA, 657 nt, Artificial Sequence; identical to SEQ ID NO: 38732
  derived and/or modified sequence opt5 from Lifastuzumab_vedotin_LightChain1

SEQ ID NO: 38735 - RNA, 1359 nt, Artificial Sequence
  derived and/or modified sequence opt5 from Ligelizumab_HeavyChain1
caggugcaacugguccagagcggcgccgagguuaugaagcccggguccucugugaaagugagcugcaaggcuuccggauacaccuucucuugguauuggcucgaaugggucagacaggccccuggccacgggcuggaguggaugggagaaaucgacccgggcacauuuacgaccaacuacaaugagaaauucaaggcgcgggugacauuuaccgcugauacaagcaccuccacagccuauauggaacuuucuagccugcgcuccgaggacaccgccguuuacuauugugcuagauucagccauuuuucuggguccaacuacgauuauuucgacuacuggggacagggcacgcucgugaccgucagcucugccuccacaaaaggccccagcguguuuccucuggcucccucuuccaagagcaccuccgggggaacagccgcgcuuggcugccugguuaaggauuacuucccugagcccgugaccgucucuuggaauagcggggcccucacguccggagugcacacauuuccugcugugcugcaaagcucuggccuguauucccucagcucugucguuaccgugccgagcuccucucuggggacacagaccuacauuuguaacgugaaucauaaacccagcaacaccaaggucgacaaaaagguggaaccuaaauccugcgauaagacacacacgugucccccuugccccgccccggagcuucugggaggcccuagcguuuuccucuuucccccuaagcccaaagacacccugaugaucucucggacacccgaagugaccugugucgugguugaugugucccaugaggacccugaggucaaguucaauugguauguggauggcgucgaagugcacaacgcuaaaacaaagccgcgcgaggaacaguacaauagcaccuauagaguugugucuguccuuacggugcugcaccaggacuggcucaacgggaaagaguacaagugcaaaguuuccaauaaggcccugcccgcgccuauugaaaagacaaucagcaaagccaagggacaaccccgggagccucagguguauacccugcccccgucccgcgaugagcucaccaaaaaccaggucucucugacaugucuugugaagggcuuuuacccuagcgacauugcuguggaaugggaguccaaugggcagcccgaaaacaauuacaaaaccacaccucccguucuggacucugauggcagcuucuuccucuauuccaagcugacggucgacaagagcagauggcaacagggaaacguguuuucuugcuccgugaugcaugaggcccuucacaaccauuacacccagaaaagccugucucucuccccugggaag

SEQ ID NO: 38736 - RNA, 642 nt, Artificial Sequence
  derived and/or modified sequence opt5 from Ligelizumab_LightChain1
gagaucgugaugacccagagccccgccacacuguccgucucuccuggcgaaagagcuacgcucagcugccgggccucccaaucuauugggaccaacauccacugguaccagcagaagccgggacaggcgccccgccugcuuauuuauuacgcuagcgaguccaucucuggcauuccugccagauucagcggguccggaagcggcacagaauuuacccugacaaucucuucccuccaaagcgaggacuucgccguuuauuacugucagcagucuugguccuggcccaccacauuugggggaggcaccaaaguggaaaucaagcggacgguggcugccccuagcgucuucauuuuucccccuucugaugagcagcugaaauccggcaccgcuagcgugguuugccuucugaauaacuucuauccgcgcgaggccaaggugcaauggaaagucgacaaugcgcuccaguccgggaacucucaggaaagcgugacagagcaggauuccaaggacagcaccuacucucuguccagcacacugacccucucuaaggccgauuaugaaaaacauaagguuuacgcuugugaggugacgcaccaaggacugagcucccccgucacaaaaucuuuuaauagaggcgagugc

SEQ ID NO: 38737 - RNA, 1329 nt, Artificial Sequence; identical to SEQ ID NO: 38285
  derived and/or modified sequence opt5 from Lilotomab_HeavyChain1

SEQ ID NO: 38738 - RNA, 642 nt, Artificial Sequence; identical to SEQ ID NO: 38286
  derived and/or modified sequence opt5 from Lilotomab_LightChain1

SEQ ID NO: 38739 - RNA, 1338 nt, Artificial Sequence
  derived and/or modified sequence opt5 from Lintuzumab_HeavyChain1
caggugcaacugguccagagcggcgccgagguuaagaaacccggguccucugugaaggugagcugcaaggcuuccggauacaccuucacagacuauaacaugcacugggucagacaggccccuggccaggggcucgaauggaucggauacauuuauccguacaauggcgggacgggauauaaccaaaaauuuaaaucuaaggcgaccaucacagcugaugagagcaccaauacagccuacauggaacuguccucucuucggagcgaggacaccgccguguauuacugugcucgcggcagacccgccauggauuacuggggccaggggacacugguuaccguguccagcgcuucuacgaagggaccuuccgucuucccccucgccccuagcucuaaauccaccagcggcgggacagcggcccugggaugccuugugaaggacuauuuucccgaaccuguuaccgugucuuggaacuccggcgcucugacaagcgggguccauaccuucccggccgugcuccaguccucuggacuguacagccuguccagcguggucacgguucccucuuccagccucggcacacagaccuauauuuguaaugugaaccacaaaccuucuaauacaaagguggauaaaaaggucgagcccaagagcugcgacaaaacccauaccuguccucccugcccggcuccugagcugcuuggcgggcccuccguguuucuguucccucccaagcccaaagauacacucaugaucucucggacgccugaaguuaccuguguggucguggacguuagccacgaggauccggaagugaaguuuaacugguacgucgacggaguggagguccauaaugccaaaacaaagccccgcgaggaacaauauaacuccaccuacagagugguuagcgugcugacaguccuucaccaggauuggcugaauggcaaagaguauaagugcaaggugucuaacaaagcgcucccugcccccauugaaaagaccaucuccaaagcuaaggggcagccucgggagccccagguuuacacgcugccgccuagccgcgacgaacugaccaaaaaucaagugucucucacaugucuggucaagggauucuaccccuccgauaucgccguggagugggagagcaacggccagccugaaaauaacuauaagaccacacccccugugcuugacuccgacgggagcuuuuuccuguacucuaaacucaccguugauaaguccagauggcagcaaggaaacgucuuuucuugcagcgugaugcacgaggcucugcauaaucacuauacacagaaaucccuuagccugucucccggcaag

SEQ ID NO: 38740 - RNA, 654 nt, Artificial Sequence
  derived and/or modified sequence opt5 from Lintuzumab_LightChain1
gacauccagaugacccaaagccccuccucucugagcgccuccgugggcgauagagucacaauuacgugccgggcuucugagagcguugacaacuacgggaucuccuucaugaauugguuucagcagaagccuggaaaagccccgaagcuccugauuuaugcggcuucuaaccagggcagcggggugcccucccgcuucagcggaucuggcuccgggaccgauuuuacacuuaccaucagcucucugcaaccugacgauuucgccacauacuauugucagcaguccaaagaagugcccuggaccuuuggacagggcacaaaggucgagauuaaaagaaccguggccgcuccuagcguuuucaucuuucccccuucugacgaacaacucaaguccggcacggccagcguggucugccugcuuaauaacuucuacccgcgggaggcuaaggugcaguggaaaguugauaaugcccugcaguccgggaacucucaggaaagcgugaccgagcaagacuccaaggauagcacauauucucucuccagcacccugacacugucuaaagcggacuacgagaagcacaaagucuaugccugugaagugacccaucagggacucagcucccccgugacgaagucuuuuaaucgcggcgagugc

SEQ ID NO: 38741 - RNA, 1350 nt, Artificial Sequence
  derived and/or modified sequence opt5 from Lirilumab_HeavyChain1
caggugcaacugguccagagcggcgcugagguuaagaaacccggguccucugugaaggugagcugcaaggcuuccggaggcaccuucucuuuuuacgccaucagcugggucagacaggcgccugggcagggacucgaauggaugggcggguucauuccgaucuuuggagcugccaacuaugcccaaaaauuccagggccgggugacaauuacggcugacgaguccaccucuacagccuacauggaacugagcucccuucgcagcgaugacaccgcuguuuauuacugugccagaauccccucuggcuccuauuacuaugauuacgacauggaugugugggggcagggaacaaccgucacagugagcucugcguccaccaaaggcccuagcguuuuuccccuggccccuugcucucgguccacgagcgaguccaccgcugcccucgggugucuggugaaggacuacuuccccgaaccugucacagugucuuggaauagcggagcucuuaccuccggcgugcacacauuuccggccguccugcagagcucugggcucuauucccugagcucuguugugaccgugcccagcuccucucugggaacgaagacauauaccugcaacgucgaucauaaaccuagcaauacaaagguggacaaacgcguugaguccaaguacggacccccuugucccccgugcccugcgcccgaguuccucggcgggccuagcguguuucuguucccucccaaacccaaggauacccuuaugauuucuagaaccccggaagucacaugugugguuguggacgucucccaagaggaucccgaagugcaguuuaacugguacgucgacggaguggagguucacaaugccaagacgaaaccucgggaggaacaguucaacagcaccuaucgcguggucucugugcugacaguucuccaucaggauuggcugaauggcaaggaguacaaaugcaagguguccaacaaagggcuucccagcuccaucgaaaagaccaucucuaaagcuaagggacaaccuagagagccccaggucuauacacugccgccuagccaggaagagaugaccaagaaucaagugucccucacgugucuggugaaaggcuuuuaccccucugacauugccguugagugggaaagcaacgggcagccugagaauaacuacaagacaacacccccuguccuggacuccgauggcagcuucuuccucuauucucggcugaccguggacaaaucccgcuggcaggaaggcaauguguuuagcugcucugucaugcacgaggcccuucauaaccacuacacccagaagucccugagccucucucugggcaaa

SEQ ID NO: 38742 - RNA, 642 nt, Artificial Sequence
  derived and/or modified sequence opt5 from Lirilumab_LightChain1
gagaucgugcugacccagagccccgucacacucagccugucuccuggcgaaagagccacgcuuagcugccgggcuucccaaucuguuagcuccuaccuggccugguaucagcagaagccggggcaggcgccccgccuccugauuuacgacgcuucuaacagagccaccggaaucccugcccgguucagcggcuccgggagcggaacagauuuuacccuuacaauuucuucccuggagcccgaagacuucgcuguguauuacugucaacagcgcagcaauuggauguauaccuuuggccaggggacaaaacucgagaucaagagaaccguggccgcuccuucugucuucauuuuucccccuuccgaugaacagcugaaaagcggaacggccucugugguuugccugcucaacaauuucuacccgcgggaggcgaaggugcaauggaaagucgacaacgcccugcaguccggcaauagccaggaguccgugaccgaacaggauucuaaggacagcacauauucccuuagcucuacccugacacucuccaaggcugauuacgagaaacacaagguuuacgccugugaagugacccaucaaggccugagcucucccgucacgaaauccuuuaaccgcggggagugc

SEQ ID NO: 38743 - RNA, 1344 nt, Artificial Sequence
  derived and/or modified sequence opt5 from Lodelcizumab_HeavyChain1
caggugcagcugguccagagcggcgccgagguuaagaaacccggggcuuccgugaaggugucuugcaaagccagcggauacaccuucuccacaauguauaugucuugggucagacaggcgccuggccaggggcucgaauggaugggacggaucgacccggcuaacgagcacacgaauuacgcccaaaaguuucagggccgcgugaccaugacaagagauaccagcauuuccacagccuauauggaacugucucggcuuaccagcgacgauacagcuguuuacuauugugcccgcuccuacuauuacuacaacauggacuauugggggcagggaacccuggugacggucagcucugcuuccaccaaaggccccagcguguucccucucgcccccucuuccaagagcacaucuggcgggaccgcggcccugggaugccuuguuaaggauuacuuuccugagcccgugacagucuccuggaauagcggcgcucugaccuccggggugcauacguucccugccgugcuccagucuagcggacuguauucccugagcucugucguuacagugccguccagcucucucggcacccaaacauacaucuguaacgugaaucacaaacccagcaacaccaaggucgacaaaagaguggaaccuaaguccugcgauaaaacccauacaugucccccuugccccgcuccggaggccgcugggggaccuucuguuuuucuguuucccccuaagcccaaggacacgcuuaugauuagccggacccccgaggugacaugugucgugguugaugugucccacgaagacccugaggucaaauucaauugguauguggauggcgucgaagugcauaacgccaagaccaaaccgcgcgaggagcaguacaauagcacauauagaguugugucuguccugaccgugcuccaccaggacuggcugaacggcaaggaauacaaaugcaagguuuccaauaaagcgcuucccgccccuaucgagaagacgauuagcaaggcuaaagggcagccccgggaaccucaaguguacacacugcccccgucucgcgaggaaaugaccaagaaccaggucucccucaccugucuggugaaaggauucuauccuagcgauaucgccguggagugggaguccaauggccagcccgaaaacaauuacaagacaaccccucccguucuggacucugacgggagcuuuuuccucuauuccaaacugacagucgauaagucuagauggcaacagggaaacguguuuagcugcuccgugaugcacgaggcccuucauaaccacuacacgcaaaagagccugucucucuccccuggcaaa

SEQ ID NO: 38744 - RNA, 639 nt, Artificial Sequence
  derived and/or modified sequence opt5 from Lodelcizumab_LightChain1
cagaucgugcugacccaaagccccgccacacucuccgucucuccuggcgagagagcuacgcugagcugccgggccucccagucuguuagcuacaugcacugguaucagcagaagccggggcaagcgccccgccuucugauuuacggaguguucagacgggcuaccggcaucccugaccgcuuuuccgggucuggaagcggcacagauuucacccucacaauugggagacuggaacccgaggacuuugccguguauuacugucuucagugguccagcgauccucccaccuucggacagggcacaaaacuggaaaucaagcggaccgucgccgcuccuucuguguuuauuuucccgcccuccgacgagcagcucaaaagcggcacggccucuguugugugccugcugaacaauuuuuauccucgcgaagcuaagguccaauggaaaguggauaacgcccuccaguccgggaauagccaggagucuguuaccgagcaggacuccaaggauagcacauacucccugucuagcacccuuacacuguccaaggcggacuaugaaaaacauaagguguacgccugugaggucacccaccaaggacucagcucucccgugacgaaauccuucaacagaggcgaaugc

SEQ ID NO: 38745 - RNA, 1356 nt, Artificial Sequence
  derived and/or modified sequence opt5 from Lokivetmab_HeavyChain1
gaggugcagcuggucgaaagcggcggggaccucguuaagcccggaggcucccugagacuuucuugcguggccagcggguucaccuuuuccaacuacggaaugucuugggugcggcaagcuccuggcaaagggcugcagugggucgccacaaucagcuauggaggcuccuacacguauuacccggauaauauuaagggccgcuucaccaucucuagagacaacgcgaaaaauacacucuaucugcagaugaacagccuucgggcugaggauaccgccauguacuauugugugcgcggguacggauacgacacaauggauuauuggggccaggggacccugguuacaguguccagcgccucuaccacggcucccuccgucuuuccucucgcccccagcugcggaucuaccuccggcagcacaguggcucuggccugucugguuucuggguacuucccugaacccgugaccgucuccuggaauagcggaucccucacaucuggcgugcacaccuuuccuagcgugcugcaauccagcggccuuuauucucuguccagcauggucacgguuccgucuagcagauggcccuccgagacauuuaccugcaacguggcgcauccugccucuaagacaaaaguggacaagcccgucccuaagcgggaaaaugggcgcgugcccagaccgccugauugucccaaaugcccugcucccgagaugcucggaggccccagcguuuucauuuucccuccgaagcccaaagacacccugcuuaucgcccggaccccugaggugacaugugucgugguugaucuggaccccgaagauccugaggugcagauuuccugguuugucgacgggaagcagaugcagacggcuaaaacccaaccccgcgaagaacaguucaacggaacauacagaguggucagcgugcucccgaucggccaccaggauuggcugaaggggaagcaguuuaccugcaaaguuaauaacaaggcccugccuucucccaucgagcggacaauuuccaaagcgcgcggacaagcccaucagccuagcguguauguccugcccccuucuagagaggagcucuccaagaauaccgugagccuuacgugucugaucaaagacuucuuucccccggacauugauguugaauggcaguccaacggccaacaggagccugaaucuaaguaccggacaaccccuccccagcucgacgaggauggcagcuauuuccuguacuccaaacuuucuguggacaagagccgcuggcagagaggggauaccuucaucugcgcugucaugcacgaggcccugcauaaucacuacacacaagaaucccucagccacucucccgga

SEQ ID NO: 38746 - RNA, 651 nt, Artificial Sequence
  derived and/or modified sequence opt5 from Lokivetmab_LightChain1
gagaucgugaugacccagagccccgccucccugucucucagccaagaagagaaggucacaauuacgugcaaggcuucccagucuguuagcuucgccggcaccgggcugaugcacugguaccagcagaagccuggacaagcgccgaaacuucugaucuauagagcuuccaaccucgaagccggcgugcccucucgguuuagcggguccggaagcggcacagacuucucuuuuaccauuuccagccuggagccugaagauguggccgucuacuauugucagcagucucgcgaguaccccuggacauucgggcagggaaccaaacuugagaucaaaagaaaugacgcucaaccugccguguaucuguuucagcccuccccugaucagcuccauacaggcagcgcuucuguugugugccugcugaacuccuucuacccgaaggacauuaaugucaaguggaaaguggauggcguuauccaggacaccgggauccaagaaagcgugacggagcaggauaaggacuccaccuauucucucagcuccacacugaccaugagcucuacagaauaccuuucccacgagcuguacagcugugagauuacccauaaaucucuccccagcacgcugaucaaguccuuucagcggucugaaugc

SEQ ID NO: 38747 - RNA, 1344 nt, Artificial Sequence
  derived and/or modified sequence opt5 from Lorvotuzumab_mertansine_HeavyChain1
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcguacaucagcuccggaucuuuuacaauuuauuacgcugacagcgugaaaggcagauucacgaucucccgggauaacagcaagaauacccuguaucuccagaugaacucucugcgcgccgaggacacagccguuuacuauugugcuagaaugcggaaaggcuacgccauggauuauugggggcaaggaacccuugugacagucuccagcgcuucuaccaagggcccguccguguuuccccuggccccuagcucuaaauccacaagcgggggaaccgcggcccucggcugccugguuaaggacuacuuccccgaaccugugacggucuccuggaacucuggggcucugaccagcggagugcauacauuucccgccgugcuccaguccagcggccuguacucucuuuccagcgucguuaccgugccuucuagcucccugggcacacagaccuauauuuguaaugugaaucacaagccgucuaacacgaaagucgauaagaaaguggagcccaagagcugcgacaaaacacauaccuguccucccugcccugcucccgaacuccuugggggaccguccguuuuccuguuuccucccaagccuaaggauacacugaugaucagccgcacccccgaggugaccugugucgugguugacgugucucacgaggaucccgaagucaaauucaauugguacguggacggcgucgaggugcauaacgccaagacaaaaccuagagaggaacaguauaauuccacguaccggguugugagcguccucaccgugcugcaccaagauuggcugaacgggaaggaguauaaaugcaagguuucuaauaaagcgcucccggcccccauugaaaagacaaucuccaaggcuaaaggacagccucgcgagccccagguguacacccugccucccagcagagacgaacuuacaaagaaccaggucucccugaccugucucgugaaaggcuuuuauccgucugauaucgccguggagugggaaagcaaugggcaaccugagaacaauuacaagacgacacccccuguucuggacuccgacggaucuuucuuucuuuacagcaaacugaccgucgauaagucccgguggcagcagggcaacguguucagcugcucugugaugcacgaggcucuccauaaccacuauacccaaaagucccugagccugucucccggcaaa

SEQ ID NO: 38748 - RNA, 657 nt, Artificial Sequence
  derived and/or modified sequence opt5 from Lorvotuzumab_mertansine_LightChain1
gacguggucaugacccagagcccccugucccucccuguuacacugggccaaccggccucuaucagcugcagauccucucagauuaucauucacagcgaugggaacacguaccuugagugguuccagcagcggcccggacaauccccucgcagacugaucuauaaggugucuaaucgguuuagcggcgugcccgaccgcuucuccgggagcggaucuggcaccgauuuuacacucaaaauuuccagagucgaagcugaggacguggggguuuacuauuguuuccagggaagccaugugccucacaccuuuggccagggcacaaaggucgaaaucaaacggaccguggccgcgcccucuguuuucaucuuuccuccguccgaugagcagcuuaagagcgggacagcuucuguggucugccugcugaacaauuucuacccccgcgaagccaaagugcaauggaagguggacaacgcccuccaguccggaaauagccaggaguccgucaccgagcaggauucuaaggacagcacguauucccugagcucuacccugacacucuccaaagcugauuacgaaaagcauaaaguuuaugccugugaggugacccaccaaggccugagcucuccugugacaaagagcuuuaacagaggggaaugc

SEQ ID NO: 38749 - RNA, 336 nt, Artificial Sequence
  derived and/or modified sequence opt5 from Lpathomab_VL
gacguggucaugacccagacaccccugagccucccuguuucccugggcgaucaagccucuaucagcugcacguccgggcagucucuugugcacauuaacggaaauaccuaccugcauugguaucuccagaagccgggccagagccccaaacugcuuaucuacaagguguccaaccuguucucuggggucccugacagauuuagcggauccggcagcgggacagauuucacccucaaaauuucucggguggaggcugaagaccugggaguuuauuuuuguucccaaagcacacacuuccccuuuaccuucggcacaggcaccaagcuggagaucaaa

SEQ ID NO: 38750 - RNA, 366 nt, Artificial Sequence
  derived and/or modified sequence opt5 from Lpathomab_gamma1-Chain_VDJ-Region
caggugcaacugcagcagagcggcgccgagcucgucagacccgggaccuccguuaaggugucuugcaaagcuagcggauacggcuucaucaacuaucugauugaauggaucaagcagcggccugggcaaggacuugaguggauuggccugaucaauccgggguccgacuacacaaacuauaaugaaaacuuuaaaggaaaggccacgcucaccgcggauaaaucuagcuccacagcuuacaugcaccugucuagccuuaccuccgaggacagcgccguguauuucugugcccgcagauuuggcuacuauggcucugggaauuacuucgauuacuggggacagggcacaacccugacagucuccagc

SEQ ID NO: 38751 - RNA, 1350 nt, Artificial Sequence
  derived and/or modified sequence opt5 from Lucatumumab_HeavyChain1
caagugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugaggaauccaacagauaccaugcugacucuguuaaaggacgguucacaauuagccgcgauaauuccaagaucacgcuguaucuccagaugaacagccugagaaccgaggacacagccguguacuauugugcccgggauggcggcauugcugccccggggcccgacuacuggggacaaggcacccuugucacagugucuuccgcuagcaccaaagggccuucuguuuuuccccuggccccugcguccaagagcacaucuggaggcaccgccgcucucgggugccuggugaaagauuauuuccccgaaccugucacgguguccuggaauagcggagcccugaccuccggcgugcacacauuuccggcuguccuccagucuagcggccuguacucccuuagcucuguugugaccgugcccuccagcucucuggggacacagaccuacaucuguaacgucaaucauaagccuagcaacacgaagguggacaaacgcguugagcccaaguccugcgauaaaacacacaccuguccucccugcccggccccugagcuccugggaggccccucuguguuccuuuuuccucccaagcccaaagacacacugaugauuagcagaaccccugaagucaccugugugguuguggaugucucccaugaggacccggaagugaaguucaauugguaugucgaugggguggagguucacaacgcgaagacaaaaccccgggaggaacaguacaauagcacguaucgcguggucucugugcucaccguucugcaccaagacuggcugaacggaaaggaguacaaaugcaagguguccaauaaagcccucccugcucccaucgaaaagacaaucagcaaagccaagggccagccuagagagccccaggucuauacccugccgccuucucgggaagagaugacaaagaaccaggugucccuuaccugucuggugaaaggguuuuaccccagcgauauugcuguugagugggaauccaauggacaaccugagaacaauuauaagacgacacccccuguccucgacucugacggcagcuucuuucuguacuccaaacuuaccguggauaagucucgcuggcagcagggcaacguguucagcugcuccgucaugcaugaagcccugcacaaccauuacacccagaaaagccucucucugucccccgggaag

SEQ ID NO: 38752 - RNA, 657 nt, Artificial Sequence
  derived and/or modified sequence opt5 from Lucatumumab_LightChain1
gacaucgugaugacccagagcccccugucccucacagucacgccuggcgagccggccucuauuagcugcagauccucucaaagccugcuuuacuccaacggguauaauuaccuggauugguaucuccagaagcccggacagucuccucagguucugaucagccuuggcuccaaccgggcuagcggggugcccgaccgcuucucuggauccggcagcgggaccgauuuuacacugaaaauuucuagaguggaagccgaggacgucggaguguacuauuguaugcaagcgcggcagaccccuuucacauuuggccccggcaccaagguugauauccgcagaacaguggcugccccuuccgucuucauuuuuccgcccagcgacgaacagcucaaaucugggaccgccuccgugguuugccugcugaauaacuucuacccucgggaggcuaaggugcaguggaaagucgauaaugcccuccaaagcggaaacucccaggaaucugugacggagcaggacagcaaggauuccaccuauagccugucuuccacacuuacccugagcaaggcugacuacgagaaacacaagguguacgccugugaagucacacaucagggccucucuagccccguuaccaaauccuuuaaucgcggggagugc

SEQ ID NO: 38753 - RNA, 324 nt, Artificial Sequence
  derived and/or modified sequence opt5 from Lulizumab_pegol_LightChain1
gacauccagaugacccaaagccccuccucucugagcgccuccgugggcgauagagucacaauuacgugccgggcuucucgcccuaucuggccguuccucgagugguaccagcagaagcccgggaaagccccuaagcugcuuauuuauuuuaccagcagacugcggcacggaguucccucccgcuucucuggcagcggguccggaacauguuuuacccucacaaucagcucucugcagccugaagacuucgcgaccuacuauugccuucaaaacguggcuaaucccgccacauuuucccagggcaccaaaguggagauuaagaga

SEQ ID NO: 38754 - RNA, 324 nt, Artificial Sequence; identical to SEQ ID NO: 38753
  derived and/or modified sequence opt5 from Lulizumab_pegol_LightChain

SEQ ID NO: 38755 - RNA, 1194 nt, Artificial Sequence
  derived and/or modified sequence opt5 from Lumiliximab_HeavyChain1
gaggugcagcuggucgaaagcggcgggggacucgccaagcccggcgggucccugagacuuucuugcgcugccagcggauuccgguuuaccuucaacaauuacuauauggacuggguucgccaggcgccuggccaggggcuggagugggugcucacaacgggauccgauucuuggggccagggcgugcuggucaccgugagcuccgcuucuacaaaagggccgagcguuuuuccccuugccccuuccagcaagucuaccuccggaggcacagccgcucuggggugucucgugaaagacuacuuccccgaaccugucaccgugagcuggaacucuggagcccugacauccggcguucacaccuuucccgcugugcugcagagcucugggcucuauucccugagcuccgucgugacggugccuucuagcucccuuggaacccaaacauacaucugcaaugucaaccauaagccgagcaauaccaaaguugauaagaagguggagcccaaaucuugugacaagacacauaccugcccucccuguccugcccccgaacugcucggcggcccguccguguuccuguuuccucccaaaccuaaggauacgcuuaugauuagcagaacacccgaggugaccugcgucguuguggacgucucucacgaggaucccgaagugaaauucaacugguauguugacgggguggagguccacaaugcgaagacaaagccucgggaggaacaguacaacagcaccuaucgcguggucuccgugcugaccguucuccaucaggauuggcugaauggaaaagaguacaaguguaaagugucuaacaaggcccugccggcucccaucgaaaagacaauuagcaaggccaaaggccagccuagagagccccaagucuacacgcucccucccucccgggacgaacugaccaagaaucaggugagccuuacaugccugguuaagggguuuuauccgucugauaucgcuguggagugggaauccaacggacagccugagaauaacuacaaaaccacacccccuguccucgacagcgauggcucuuucuuucuguauuccaaacuuaccguggacaaaagccgcuggcagcaagggaauguguucuccuguucuguuaugcacgaggcccugcacaaccauuacacgcaaaagagccucucccugucucccggaaaa

SEQ ID NO: 38756 - RNA, 642 nt, Artificial Sequence
  derived and/or modified sequence opt5 from Lumiliximab_LightChain1
gacauccagaugacccaaagccccuccucucugagcgccuccgugggcgaucgggucacaauuacgugccgggcuucucaggacauccgcuacuaucucaacugguaccagcagaagccugggaaagccccgaagcugcuuauuuauguugcgagcucccugcaaucuggagugcccagcagauucuccggcagcgggucuggaaccgaguuuacacucaccguguccagccugcagccugaagauuucgcuacauacuauugucuucaggucuacucuacaccccggaccuuuggccaggggaccaaaguggagaucaagcgcacgguugccgccccuuccguguucauuuuucccccuagcgacgaacaacugaaaucuggaaccgcuuccgucgugugccuccugaauaacuucuauccgagagaggccaagguucaguggaagguggauaaugcucugcagagcggcaacucccaggaaucugucacagagcaagacagcaaagauuccaccuacagccucucuuccacacugacccuuagcaaggccgacuacgagaaacacaagguguaugcgugugaagugacgcaucagggccugucuagccccgucacaaaauccuuuaauagaggggagugc

SEQ ID NO: 38757 - RNA, 1347 nt, Artificial Sequence
  derived and/or modified sequence opt5 from Lumretuzumab_HeavyChain1
caggugcaacugguccagagcggcgccgagguuaagaaacccggggcuuccgugaaggugucuugcaaagccagcggauacaccuucagauccucuuauaucagcuggguccggcaggcgccuggccaggggcucgaauggaugggauggauuuacgcuggcacaggguccccgucuuauaaccaaaagcugcagggacgcgugacgaugaccacagacaccagcacauccaccgccuacauggagcuuagaagccugcggucugaugacacagccguuuauuacugugcucgccacagagauuauuacuccaauagccucaccuacuggggccagggcacgcuggugaccgucucuuccgccagcacaaaagggcccucuguguuuccucuugcucccuccagcaaguccaccucuggaggcacagccgcgcuggggugccucguuaaggacuauuucccugaacccgugaccgucagcuggaacuccggagcccugacgagcggcgugcauacauuuccugcugugcugcagucuuccgggcucuacagccugucuagcgucguuaccgugccguccucuagccuuggaacacaaaccuauaucuguaaugugaaccacaaacccuccaauaccaaggucgauaaaaagguggagccuaaaagcugcgacaagacacauacgugucccccuugccccgccccggaacugcucggcggcccuucuguuuuccuguuucccccuaagcccaaagauacccuuaugauuucccggacacccgaggugaccugugucgugguugacgugagccacgaggauccugaagucaaguucaacugguacguggacggggucgaggugcauaaugcuaaaacaaagccgcgcgaggaacaguauaacucuaccuacagaguuguguccguccugacggugcuccaccaggauuggcugaauggaaaagaguauaagugcaaaguuagcaacaaggcccugcccgcgccuaucgaaaagacaauuuccaaagccaagggccagccccgggagccucaaguguacacccuucccccgucucgcgacgaacugaccaaaaaucaggucagccuuacaugucuggugaagggguuuuacccuuccgauaucgcuguggagugggaaucuaacggacagcccgagaauaacuauaaaaccacaccucccguucucgacagcgacggcuccuucuuucuguacagcaagcucacggucgauaagucuagauggcaacaggggaauguguucuccugcagcgugaugcacgaggcccugcauaaccacuauacccagaaaucucucucccugagcccugga

SEQ ID NO: 38758 - RNA, 660 nt, Artificial Sequence
  derived and/or modified sequence opt5 from Lumretuzumab_LightChain1
gacaucgugaugacccagagccccgauucccuggccgucucucucggcgagagagcuacaauuaacugcaagagcucccaaucuguucugaauagcgggaaccagaaaaauuaccuuacgugguaucagcagaagccuggacaaccgcccaaacugcucaucuacugggccuccacccgggaaucuggcgugccugaccgcuucagcggguccggaagcggcacagauuuuacccugacaauuucuucccuucaggcggaggacguggcugucuauuacugucagagcgauuauucuuaccccuauaccuucgggcagggaacaaagcuggaaaucaaaagaaccguggccgccccuuccguuuuuauuuuucccccuagcgacgagcaacucaagucuggcacggcuuccguggucugccugcugaacaauuucuacccgcgggaagccaaggugcaguggaaaguugauaacgcucuccagagcggcaauucccaggagucugugaccgagcaagacagcaaggauuccacauacagccugucuuccacccuuacacugagcaaagccgacuaugaaaagcacaaagucuacgcgugugaggugacccaucaggggcucucuagccccgugacgaaguccuucaaccgcggagaaugc

SEQ ID NO: 38759 - RNA, 1329 nt, Artificial Sequence; identical to SEQ ID NO: 38285
  derived and/or modified sequence opt5 from Lutetium_(177Lu)_lilotomab_satetraxetan_HeavyChain1

SEQ ID NO: 38760 - RNA, 642 nt, Artificial Sequence; identical to SEQ ID NO: 38286
  derived and/or modified sequence opt5 from Lutetium_(177Lu)_lilotomab_satetraxetan_LightChain1

SEQ ID NO: 38761 - RNA, 1350 nt, Artificial Sequence
  derived and/or modified sequence opt5 from Margetuximab_HeavyChain1
caggugcaacugcagcagagcggccccgagcucgucaagccuggggccucccugaaacuuucuugcaccgcuagcggauucaacaucaaggacacauacauucacuggguuaaacagagaccggaacaaggccuggaguggaucgggcggauuuaucccacgaauggauacacccgcuaugauccuaaguuucaggacaaagccacaaucaccgcggauacauccucuaacaccgcuuaccuccaggugagcagacugacauccgaagacaccgccguguauuacuguucucgguggggcggggauggauucuaugccauggacuacuggggccagggcgcuagcgucacgguguccagcgccucuaccaaggggcccuccguuuuuccucuugcucccagcucuaaguccacaagcggaggcaccgccgcgcuggggugccucgugaaagauuacuucccugagccggucacagugucuuggaacuccggagcccugaccagcggcguucauacguuucccgcugugcugcaauccucugggcucuauagccuguccagcgucgugacagugccuucuuccagccuuggaacccagacauacauuuguaaugucaaucacaagcccucuaacaccaaaguugacaagcgcguggaaccuaaaagcugcgauaagacccauacaugucccccgugcccugcccccgagcuggugggcggcccuuccgucuuccuccugccucccaagcccaaagacacgcuuaugaucucuagaaccccggaggugacauguguuguggucgaugugagccacgaagaccccgagguuaaguuuaauugguauguggauggggucgaagugcauaacgcuaaaaccaagccucccgaggagcaguacaauuccacacugcgggucgugagcguucucaccgugcugcaccaggacuggcugaacggaaaagaauauaagugcaaagucucuaauaaggcccucccugcgcccaucgagaagacgauuuccaaagccaagggccaaccgcgcgaaccucagguguacacacugcccccuagcagagacgagcuuaccaaaaaccagguuucucugaccugucucgugaagggguucuaucccuccgauaucgcugucgaaugggagagcaauggacaaccugagaacaauuacaaaacaacaccccuggugcuugacuccgauggcagcuuuuuccuguacucuaagcucaccguggacaagucccgguggcagcaggggaacgucuuuucuugcagcguuaugcacgaagcccugcauaaccacuauacgcagaaaucccugagccucucuccgggaaag

SEQ ID NO: 38762 - RNA, 642 nt, Artificial Sequence
  derived and/or modified sequence opt5 from Margetuximab_LightChain1
gacaucgugaugacccagagccacaaguucauguccacaucugucggcgauagaguuagcauuacgugcaaagccucccaagacgugaacaccgcuguggccugguaccagcagaagcccgggcauucuccuaaacugcucaucuauagcgcguccuuucgguacacaggagucccggaucgcuucaccggcucuagaagcgggacagacuuuaccuucacaauuuccagcgugcaggcugaggaucuggccguuuauuacugucaacagcacuauaccacgcccccuaccuuuggaggcgggacaaagguggaaaucaaacggaccgucgccgcucccucuguguucauuuuuccucccuccgacgagcagcuuaagagcggaacagccucuguugugugccugcucaauaacuucuacccucgcgaagcuaagguccaguggaaaguggauaaugcccugcaauccggcaacagccaggagucugugaccgaacaggacuccaaggauagcacguauucccuuucuagcacacugacccucuccaaagcggacuacgagaagcauaaagucuacgccugugagguuacacaccagggccugagcucuccggugaccaaguccuuuaauagaggggaaugc

SEQ ID NO: 38763 - RNA, 762 nt, Artificial Sequence
  derived and/or modified sequence opt5 from Marzeptacog_alfa_HeavyChain1
aucgugggcgggaaggucugccccaagggagaguguccuuggcagguucugcuccuggugaacggcgcccaacuuugcgggggaacccugauuaauacaaucuggguggucagcgcugcccacuguuucgacaagauuaaaaacuggagaaaucucaucgcggugcugggcgaacaugaucuuuccgagcacgacggggaugaacagucucggcgcguugcucaggugauuaucccgagcacguacguccccggaaccacaaaccaugacaucgcccugcucagacugcaccagccugugguucugaccgaucauguggucccccucugccugccugagcggacauuuuccgaacgcacccuugccuucgugagauuuucucuggugagcggcuggggccggcuccuggaccgcggggcuacagcccuugagcugcaaguccucaauguucccagacugaugacccaggauugucugcagcagucccggaaggugggagacucuccuaacauuacggaguauauguucugcgcuggcuacagcgauggguccaaagacagcuguaagggagauucuggcgggccgcacgccacccacuaucgcggaacaugguaccucaccggcaucguguccuggggccaagggugcgcgacagucggacauuuuggcguguauaccagaguuagccaguacauugaauggcugcagaaacuuaugcggucugagccccgcccuggggugcugcucagagcccccuucccu

SEQ ID NO: 38764 - RNA, 456 nt, Artificial Sequence
  derived and/or modified sequence opt5 from Marzeptacog_alfa_LightChain1
gccaacgcuuuccuggaggaacucagacccggcagccuggagcgggaaugcaaggaggaacaguguuccuuugaggaggcccgcgaaaucuucaaagacgcggagagaaccaagcuguuuuggauuucuuacagcgauggggaccaaugcgcuuccucuccuugucagaauggaggcagcugcaaagaucagcuucaguccuauaucuguuucugccucccggccuuugaagggcggaacugugagacacacaaggacgaucaacugauuugcgugaaugagaacggaggcugugaacaguacugcucugaccauacggggaccaaacgcagcuguagaugccacgagggauauucccuucuggccgauggcgucagcugcaaugcuacaguugaauaccccuguggcaagaucccuauucucgagaagcggaacgccucuaaaccccaggggcgc

SEQ ID NO: 38765 - RNA, 669 nt, Artificial Sequence
  derived and/or modified sequence opt5 from Matuzumab_HeavyChain1_variant_3c08_H
caggugcaacugguccagagcggcgccgagguuaagaaacccggggcuuccgugaaggugucuugcaaagccagcggauacaccuucacaucccacuggaugcauugggucagacaggcgccuggccaggggcucgaauggaucggagaguuuaacccgucuaauggccggacgaacuauaaugaaaaguucaaaagcaaggcuaccaugacaguggacaccuccacaaacaccgccuacauggagcugucuagccuucgcuccgaagauacagccguuuauuacugugcuagcagagacuaugauuacgacgggcgguauuuugauuacuggggacaaggcacccuggugacggucucuuccgccagcaccaagggccccucuguguucccucucgcucccuccagcaaaucuacauccgggggaaccgccgcgcugggcugccuuguuaaggacuacuuuccugagcccgugacagucagcuggaacuccggggcccugaccucuggagugcacacguucccugcugugcuccagagcuccggccuguauagccugucuuccgucguuacagugccgagcucuagccucgggacccagacauacauuuguaaugugaaucauaaacccuccaacaccaaggucgauaaaaagguggagccuaagucu

SEQ ID NO: 38766 - RNA, 669 nt, Artificial Sequence
  derived and/or modified sequence opt5 from Matuzumab_HeavyChain1_variant_3c09_C
caggugcaacugguccagagcggcgccgagguuaagaaacccggggcuuccgugaaggugucuugcaaagccagcggauacaccuucacaucccacuggaugcauugggucagacaggcgccuggccaggggcucgaauggaucggagaguuuaacccgucuaauggccggacgaacuauaaugaaaaguucaaaagcaaggcuaccaugacaguggacaccuccacaaacaccgccuacauggagcugucuagccuucgcuccgaagauacagccguuuauuacugugcuagcagagacuaugauuacgccgggcgguauuuugacuacuggggacaaggcacccuggugacggucucuuccgcuagcaccaagggccccucuguguucccucucgcccccuccagcaaaucuacauccgggggaaccgcggcccugggcugccuuguuaaggauuacuuuccugagcccgugacagucagcuggaacuccggggcucugaccucuggagugcacacguucccugccgugcuccagagcuccggccuguauagccugucuuccgucguuacagugccgagcucuagccucgggacccagacauacauuuguaaugugaaucauaaacccuccaacaccaaggucgacaaaaagguggagccuaagucu

SEQ ID NO: 38767 - RNA, 636 nt, Artificial Sequence
  derived and/or modified sequence opt5 from Matuzumab_LightChain1_variant_3c08_L
gacauccagaugacccaaagccccuccucucugagcgccuccgugggcgaucgggucacaauuacgugcucugcuagcuccucuguuaccuacauguauugguaccagcagaagccugggaaagccccgaagcuccugaucuaugacacaagcaaccuugcguccggagugcccagccgguucucuggcuccgggagcggaaccgauuacacauuuaccauuucuucccugcagccugaggacaucgcuacauauuacugucaacaguggagcucucacauuuucaccuuuggccaggggacgaaaguggaaaucaagcgcaccgucgccgcccccuccguguucaucuuuccucccagcgaugagcagcucaaauccggaacagcuucuguugugugccugcuuaauaacuucuauccuagagaagccaagguccaauggaagguggacaaugcucugcagagcggcaacucccaggagagcguuaccgaacaggauucuaaagacuccacauacagccucucuagcacccugacgcuguccaaggccgauuacgagaaacauaagguguaugcgugugaggucacacaccaaggccucucuagcccggugaccaaauccuuuaauagaggggaa

SEQ ID NO: 38768 - RNA, 636 nt, Artificial Sequence; identical to SEQ ID NO: 38767
  derived and/or modified sequence opt5 from Matuzumab_LightChain1_variant_3c09_B

SEQ ID NO: 38769 - RNA, 1341 nt, Artificial Sequence
  derived and/or modified sequence opt5 from Mavrilimumab_HeavyChain1
caggugcagcugguccagagcggcgccgagguuaagaaacccggggcuuccgugaaggugucuugcaaagucagcggauacacccucacagaacuguccauccacugggugagacaggccccuggcaaggggcuugaguggaugggaggcuucgacccggaagagaacgaaauuguuuaugcgcagcgguuucaagggcgcgugacgaugaccgaggauacaucuaccgacacagcuuacauggagcugagcucccucagaucugaagauaccgccgucuauuacugugccaucgugggauccuucagcccccugacacuuggccuguggggccaggggaccaugguuacggugagcucugcuuccaccaaaggaccuagcgucuuuccccucgccccuugcucucgguccacaagcgagucuaccgcugcccugggcugucuggugaaggacuauuuccccgaaccugugacagucuccuggaauagcggggcgcucaccuccggaguucauacguuuccggccgugcugcagucuagcggccuuuacucccugagcucuguggucacagugcccuccagcucucucgggaccaagacauauaccugcaacguugaucacaaaccuagcaauaccaagguggacaaacgcgucgaguccaaguacggacccccuugucccucuugcccggcuccugaguuccugggcggccccagcguguuucuuuucccucccaaacccaaggauacacugaugauuuccagaacgccugaaguuaccuguguggucguggacgucagccaggaggauccggaagugcaauuuaacugguacguugacgggguggagguccauaaugccaagacaaaaccccgggaggaacaguucaacucuaccuaucgcgugguuuccgugcucacaguccugcaccaggauuggcugaauggaaaggaguacaaaugcaaggugagcaacaaaggccucccuucuuccaucgaaaagaccauuagcaaagcuaaggggcagcccagagagccucaaguguauacgcugcccccgucccaggaagagaugacaaagaaucagguuucucuuaccugucuggucaaaggauuuuacccuagcgacaucgccguggaaugggaguccaacggccaacccgagaauaacuauaagaccacaccucccgugcucgauucugacgggagcuucuuucuguacucccggcuuaccgucgacaaaagccgcuggcaggaaggaaauguguucucuugcuccguuaugcaugaggcgcugcacaaccacuauacacaaaagagccucucucugucccugggcaaa

SEQ ID NO: 38770 - RNA, 651 nt, Artificial Sequence
  derived and/or modified sequence opt5 from Mavrilimumab_LightChain1
cagagcgugcugacccaacccccuuccgucucuggcgccccggggcagagaguuacaaucagcugcacgggauccggcucuaacauuggggcucccuacgacgugagcugguaucagcagcucccuggaaccgcccccaagcugcuuaucuaccacaauaacaaacggccuuccggcgugcccgaucgcuucucugggagcaaguccggaacaagcgcgucucuggcuauuaccggccuccaagccgaggacgaagccgauuauuacugugcuacagucgaggccggccuguccgggagcguguuuggaggcgggaccaaacuuacaguucugggacagccuaaggcugccccgucugugacccucuuucccccuuccagcgaggaacugcaggcgaauaaagccacgcuggucugccucaucucugacuucuaucccggcgcugugaccguugccuggaaggcugauuccagcccugugaaggccggggucgaaacaaccacacccuccaaacagucuaacaauaaguacgcggccagcuccuaucugagccuuaccccggagcaauggaaaucucauagauccuacagcugucaggugacgcacgagggaucuacaguggaaaagaccgucgcuccuacagagugcagc

SEQ ID NO: 38771 - RNA, 1359 nt, Artificial Sequence
  derived and/or modified sequence opt5 from MDX-1303_HeavyChain1
caggugcaacuggucgagagcggcgggggaguugugcagcccggcagaucccuccggcugucuugcgccgcuagcggguucaccuuuuccuacuauggaaugcacugggugcgccaggccccuggcaaggggcuugaaugggucgcggugaucuggcaugacgagucuauuguuuacuaugcugauagcgugaaaggaagauucacaaucucccgggacaacucuaagaauacgcuguaccuccagaugaacagccugcgcgccgaagauaccgccgucuauuacuguacaagagacccgggcgaucccuauuacuacuauuacggccuugacgugugggggcaaggaaccacaguuaccguguccagcgcuucuacaaaaggcccuuccgucuuuccccuggccccuagcucuaaguccaccagcgggggaacggcugcccucggcugccuggugaaagauuauuuccccgagccugugaccgucucuuggaacuccggggcgcugacaagcggaguucacaccuuuccggccgugcuccaguccucuggccuguacagccuuuccagcguggucacagugcccucuuccagccugggcacccagacguauauuuguaauguuaaucauaagccuucuaacacaaagguggacaaacgggucgaacccaagagcugcgauaaaacccacacauguccucccugcccggcuccugagcuccuugggggacccuccguguuccuguuuccucccaagcccaaagacacccugaugaucucucgcaccccugagguuacauguguggucguggaugucagccaugaagacccggaggugaaguucaauugguacguugauggcguggaaguccacaacgccaagacgaaacccagagaggagcaguauaauuccaccuaccgggugguuagcgugcucacaguccugcaccaagacuggcugaacgggaaggaauacaaaugcaaggugucuaauaaagcucucccugcccccauugagaagaccaucuccaaagcgaagggacagccucgcgaaccccagguguauacacugccgccuagcagagaggaaaugaccaagaaccagguuucucuuacgugucuggucaaaggcuuuuaccccuccgacaucgccguggagugggagagcaaugggcaaccugaaaacaauuauaagacaacacccccugugcucgauuccgacggaucuuucuuucuguacagcaaacuuaccgucgauaagucccgguggcagcagggcaacguguucucuugcagcguuaugcaugaggcucugcacaaccauuauacccaaaaaucccucagccugucucccggcaag

SEQ ID NO: 38772 - RNA, 645 nt, Artificial Sequence
  derived and/or modified sequence opt5 from MDX-1303_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccauguacaccuuuggccagggcacaaaacucgagaucaagagaaccguggcugccccuagcguguucauuuuucccccuucugaugaacagcugaaauccgggacggcuagcgucgugugccugcucaacaauuucuauccgcgggaggccaagguucaauggaaaguggacaacgcgcugcaguccggaaauucucaggagagcgucaccgaacaggauuccaaggacagcacauacucucuuuccagcacccugacacucucuaaggccgauuacgagaaacacaagguguaugcuugugaaguuacccaucaaggccugagcucccccgugacgaaaucuuuuaaccgcggggagugc

SEQ ID NO: 38773 - RNA, 1347 nt, Artificial Sequence
  derived and/or modified sequence opt5 from Mepolizumab_HeavyChain1
caggugacccugagagagagcggccccgcccucgucaagccuacacaaacgcugacccuuacaugcaccguuuccggguucucucugacaagcuacuccgugcacugggugcggcagccgcccggaaaaggccucgaauggcugggggucaucugggcuucuggaggcaccgacuauaacagcgcccuuaugucccgccugucuauuagcaaggauacauccagaaaucaggugguucucaccaugacgaacauggacccuguggauaccgcgacauacuauugugcucgggaucccccuagcucucugcugcgccucgacuacugggggagaggaacccccgucacaguguccagcgccucuaccaaaggcccuuccguuuuuccgcuggcccccagcucuaaguccacgagcggcgggacagcugcccuuggaugccuggugaaagacuauuucccugagcccgucaccguguccuggaacucuggcgcucucacaagcggggugcauaccuuuccugccguccugcaguccagcggacuuuacucucuguccagcguugugaccgugcccucuagcucccucggcacacaaacguauaucuguaaugucaaucacaagccgucuaacaccaagguggauaaacggguugaaccuaagagcugcgacaaaacacauaccugucccccuugccccgcgcccgagcugcucgggggaccuuccguguuccuguuuccgcccaagccuaaagauacacugaugauuagccgcacccccgaagucacgugugugguuguggacgucucucacgaggauccugaggugaaguucaauugguacgucgacggcguggaaguucauaacgccaagacaaaacccagagaggaacaguacaauuccaccuaucggguggucagcgugcuuaccguucugcaccaggauuggcucaacggcaaggaguacaaaugcaaggugucuaauaaagcucugccggccccuaucgagaagacaauuuccaaagcuaaggggcagccccgcgaaccucaagucuauacccuucccccuagcagagaggaaaugacaaagaaccaggugucccugacgugucucgugaaaggauuuuaccccucugacaucgccguugagugggaaagcaauggccagccggagaacaauuauaagaccacaccucccguccuggacuccgaugggucuuucuuucuguacagcaaacucaccguggacaagucccgguggcagcaaggaaacguguucagcugcucugucaugcacgaggcgcugcauaaccacuauacacagaaaucccuuagccugucucccggcaag

SEQ ID NO: 38774 - RNA, 660 nt, Artificial Sequence
  derived and/or modified sequence opt5 from Mepolizumab_LightChain1
gacaucgugaugacccagagccccgauucccuggccgucucucucggcgagagagcuacaauuaacugcaagagcucccaaucucugcuuaauagcgggaaccagaaaaauuaccuggccugguaucagcagaagccuggacaaccgcccaaacuccugaucuacggcgcguccacgcgggaaucugggguuccugaccgcuucagcggauccggcagcgggaccgauuuuacacuuaccauuucuucccugcaggcugaggacguggccguguauuacugucagaacguccacagcuuccccuuuacauucggaggcggcaccaagcucgaaaucaaaagaacaguggccgcuccuucuguuuuuauuuuucccccuuccgaugagcagcucaagagcgggaccgccucuguggucugccugcugaauaacuucuauccgcgggaagcuaaggugcaauggaaaguugacaaugcccugcaguccggaaacagccaggaguccgugacggagcaggauucuaaggacagcaccuacucccuuagcucuacacugacccucuccaaagcggauuaugaaaagcauaaagucuacgccugugaggugacacaccaaggccugagcucucccgugaccaagagcuucaaucgcggggaaugc

SEQ ID NO: 38775 - RNA, 1350 nt, Artificial Sequence
  derived and/or modified sequence opt5 from Metelimumab_HeavyChain1
gaggugcagcuggucgaaagcggcgggggaguugugcaacccggcagaucccuccggcugucuugcgccgcuagcggguucaccuuuuccucuuacggaaugcacugggugcgccaggccccuggcaaggagcuugaaugggucgcggugaucagcuaugacggguccauuaaauacuaugcugauucuguuaagggaagauucacaaucagccgggacaacuccaaaaauacgcuguaccuccagaugaacagccugcgcgccgaggauaccgccguguauuacugugcuagaacaggcgaauauucuggcuacgacaccgauccgcaguacuccugggggcaaggaacaaccgucacagugagcucugccuccaccaagggccccagcguuuuuccucuugcucccugcucucgguccacgagcgaguccaccgccgcgcuggggugucucgugaaagacuauuucccugagcccgucacagugucuuggaauagcggagcccugaccuccggcgugcauacauuuccugcuguccugcagagcucugggcucuacucccugagcucuguugugaccgugccgagcuccucucuuggaacgaagacauauaccugcaacgucgaucacaagcccagcaauacaaaaguggacaagcgcguugaauccaaauacggcccucccuguccuagcugccccgccccggaguuccugggcgggccuucuguguuucucuuucccccuaagcccaaacccacccugaugauuuccagaaccccugaagucacaugugugguuguggaugucagccaggaggacccggaggugcaguucaacugguaugucgauggaguggaaguucauaaugcuaagacgaagccccgggaggaacaauucaacucuaccuaccgcguggucuccgugcuuacaguucugcaccaggacuggcucaauggcaaagaguauaagugcaaagugagcaacaaggggcugccuuccucuaucgagaaaaccauuagcaaggccaaaggacagcccagagaaccucaggucuacacacugcccccgucccaagaggaaaugaccaagaaucaggugucucucacgugucuggugaagggcuuuuacccuagcgauaucgcgguugagugggaauccaacgggcagcccgagaauaacuauaaaacaaccccucccguccuugacagcgacggaucuuucuuucuguacucccggcucaccguggauaagagccgcuggcaagaaggcaauguguucucuugcuccgucaugcaugaggcccugcacaaccacuauacacagaaaagccuuucucugagccucggcaag

SEQ ID NO: 38776 - RNA, 639 nt, Artificial Sequence
  derived and/or modified sequence opt5 from Metelimumab_LightChain1
gagaucgugcugacccagagccccuccucucucagcgccuccgucggcgacagaguuacaauuacgugccgggcuucucaagggaucggagaugaccugggcugguaccagcagaagccugggaaagccccgauucuucugaucuauggaaccagcacacuccaguccggcgugcccucucgcuucagcggguccggaagcggcaccgauuuuacacugaccauuaacucucuucaaccugaagacuucgcgacauacuauugucugcaggauuccaauuacccccucaccuuuggcgggggaacgagacuggagaucaagcggaccguggcugccccuagcgucuucaucuuucccccuucugacgaacagcugaaauccggcacagccagcgugguuugccuccugaacaauuucuauccgcgcgaggcuaaggugcaguggaaagucgauaacgcccuucaaucugggaauagccaggaaagcgugaccgagcaggacuccaaggauucuacauacagccuguccagcacccucacgcugucuaaggcugacuaugagaaacacaagguuuacgccugugaagugacacaucagggacuuucccccgucaccaaauccuuuaacagaggcgagugc

SEQ ID NO: 38777 - RNA, 1350 nt, Artificial Sequence
  derived and/or modified sequence opt5 from Milatuzumab_HeavyChain1
caggugcaacugcagcagagcggcuccgagcucaagaaacccggggcuucugucaagguuagcugcaaggcuuccggauacaccuucacaaacuauggcgugaauuggaucaaacaggccccugggcaaggacugcaguggaugggcuggauuaacccgaauacgggggaacccaccuuugacgaugacuucaaaggaagauuugcguucucucuugauacaagcguguccaccgcuuaccugcagaucucuagccucaaggccgacgauacagccgucuauuuuuguucccggagccgcggcaagaacgaggcuugguucgccuacuggggccaggggacccuggugacaguuucuuccgcuagcaccaaaggaccuucuguguuuccccuugccccuuccagcaagucuacguccggcgggaccgcggcccugggaugccucgucaaagacuauuuccccgaaccugugacaguuagcuggaacuccggcgcucugaccucuggggugcacacauuuccggccguccugcaaagcuccggacucuacagccugucuuccguggugaccguccccagcucuagccuuggcacgcagacauauauuuguaauguuaaucauaagccuuccaacaccaaaguggauaagagaguggagcccaagucuugcgacaaaacacacaccuguccucccugcccggcuccugaacugcucggcgggcccagcgucuuccuguuuccucccaagcccaaagauacccuuaugaucucccggacaccugaggugacguguguuguggucgacgugagccaugaggauccggaaguuaaguucaauugguacguggacggagucgaggugcacaacgccaaaaccaagccccgcgaggaacaguacaauucuacauauagagucguguccguucugaccgugcuccaucaggauuggcugaacggcaaagaguacaagugcaaggucagcaauaaagcgcugccugcccccauugaaaagacaaucucuaaagcuaaggggcaaccucgggagccccagguguauacccucccgccuucccgcgaagagaugacgaaaaaccagguuagccugacaugucuugugaagggauuuuaccccuccgacaucgccgucgaaugggagucuaauggccaaccugagaacaacuauaagaccacacccccugugcuggacagcgauggguccuucuuccucuacucuaaacugaccguggacaagagcagauggcagcagggaaaugucuuuuccugcagcguuaugcacgaagcccuucacaaccauuauacccagaaaucucugucccucagccccggcaag

SEQ ID NO: 38778 - RNA, 657 nt, Artificial Sequence
  derived and/or modified sequence opt5 from Milatuzumab_LightChain1
gacauccagcugacccaaagcccccucucccugccugugacacuuggccagccggccucuauuagcugcagauccucucagagccugguccaccggaacgggaauacguaccuccauugguuccagcaacgccccggacaguccccuagacugcuuaucuauaccguuucuaaccgguuuagcggcgugcccgaucgcuucuccgggagcggaucuggcacagacuuuacccugaagauuuccagaguggaggcugaagaugucgggguguacuucuguagccagucuucccacguuccucccacauuuggagccggcacccggcucgagaucaaacgcacaguggcggcuccuagcgucuucauuuuuccgcccucugacgaacagcugaaguccggcaccgccagcgugguuugccugcucaauaacuucuauccuagagaggccaaagugcaauggaaggucgauaaugcucugcaguccgggaacucucaggaaagcgugacggagcaggacuccaaagauagcaccuacucucuuuccagcacacugacccucucuaaggccgacuaugagaagcauaaaguguacgcuugugaagucacacaccaaggacugagcucccccguuaccaagucuuuuaaucggggcgagugc

SEQ ID NO: 38779 - RNA, 1341 nt, Artificial Sequence
  derived and/or modified sequence opt5 from Mirvetuximab_HeavyChain1
caggugcaacugguccagagcggcgcugagguugugaagcccggggcuuccgugaaaaucucuugcaaggccagcggauacaccuucacaggcuauuuuaugaacugggucaaacaguccccugggcagucucucgaauggauuggaagaauccacccguacgacggcgauacguucuauaaucaaaaguuucaggggaaagcgacccugacaguggacaagagcuccaacaccgcucauauggagcuucugucucucacaagcgaagauuucgccguuuacuauuguacccgguacgacggaucccgcgccauggauuauuggggccagggcacaaccgugacggucagcucugcuuccaccaaggggcccagcguguuuccucuggcccccucuuccaaaagcacaucuggaggcaccgcugcccuugggugccugguuaaggacuacuucccugagcccgugacagucuccuggaauagcggagcgcucaccuccggcgugcacacguuuccugccgugcugcagucuagcgggcuguacucccucagcucugucguuacagugccguccagcucucugggaacccaaacauauauuuguaacgugaaucauaaacccagcaacaccaaggucgauaaaaagguggaaccuaaguccugcgacaaaacccacacaugucccccuugccccgcuccggagcuucugggcggcccuucuguuuuccucuuucccccuaagcccaaagauacgcugaugaucagcagaacccccgaggugacaugugucgugguugacgugucccaugaagauccugaggucaaguucaauugguacguggacggggucgaagugcacaacgccaaaaccaagccgcgggaggagcaguauaauagcacauaccgcguugugucuguccuuaccgugcugcaccaggauuggcucaacggaaaagaauauaagugcaagguuuccaauaaagcucugcccgccccuauugagaagacgaucagcaaagcgaagggccagcccagagaaccucaaguguacacacugcccccgucucgggacgagcucaccaaaaaccaggucucccugaccugucuugugaagggguuuuauccuagcgacaucgccguggaaugggaguccaauggacagcccgagaacaauuacaagacaaccccucccguucuggauucugacggcagcuucuuucucuacuccaaacugacagucgauaagucucgcuggcaacaggggaacguguucagcugcuccgugaugcaugaagcccuucacaaccauuauacgcagaaaagccugucucucuccccugga

SEQ ID NO: 38780 - RNA, 654 nt, Artificial Sequence
  derived and/or modified sequence opt5 from Mirvetuximab_LightChain1
gacaucgugcugacccagagcccccucucccuggccgucucucuuggccaaccugcuauuaucagcugcaaggccucccagucuguuagcuucgcggggacaucccugaugcacugguaccaucagaaaccgggacagcaacccagacuccugauuuaucgggcuucuaaccuugaggccggcgugccugaucgcuuuagcggguccggaagcaagacggacuucacccugacaaucucucccguggaagccgaggaugcugccaccuacuauugucagcaguccagagaauacccuuauacauuuggcgggggaaccaaacucgagauuaagcggacagucgcugcccccagcguguucaucuuuccuccgucugacgaacagcugaaauccggcaccgcgagcguugugugccugcucaauaacuucuacccccgcgaggccaagguccaauggaagguggauaaugcucugcagucuggcaacucccaggagagcguuacggaacaggacuccaaagauucuaccuauagccuuuccagcacacugacccucucuaaggccgacuacgagaaacacaagguguacgcuugugaagucacacaucaagggcuguccagcccugugaccaaaucuuuuaauagaggagagugc

SEQ ID NO: 38781 - RNA, 1344 nt, Artificial Sequence
  derived and/or modified sequence opt5 from Modotuximab_HeavyChain1
caggugcaacugcagcagcccggcgccgagcucgucgaaccugggggaagcguuaagcuguccugcaaggcuucuggcuacaccuucacaagccacuggaugcauugggugaaacagagaccggggcaaggacuugaguggaucggcgaaauuaaccccuccucugggcggaauaacuauaaugagaaauuuaagagcaaagccacgcugaccguggacaaguccucuagcacagcguacaugcaguucuccagccucaccucugaagauuccgcugucuauuacugugugcgcuauuacggauaugacgaggccauggauuacuggggccagggcacaagcguuaccgugucuuccgccagcacaaaggggccuucugucuuuccccuggcuccuuccagcaaauccaccucuggaggcacggccgcucuugggugccuggugaaggacuacuuccccgagccuguuaccgugagcuggaacuccggagcccucacaagcggcguccacaccuuuccggcggugcugcagucuuccgggcuguauagccucucuagcguggucacaguucccuccucuagccugggaacccaaacguacaucuguaaugugaaccauaaaccuuccaauacaaagguggauaaaagagucgaacccaagagcugcgacaagacccacacauguccucccugcccggccccugagcuucugggcggccccucuguguuccucuuuccucccaaacccaaggauacccugaugauuucccggaccccugaaguuacauguguggucguggacguuagccaugaggauccggaggugaaauucaacugguaugucgacgggguggaaguccacaaugcuaagacgaaaccccgcgaggaacaguacaacucuaccuauagagugguuuccgugcuuacaguccugcaccaggauuggcucaauggaaaggaguacaaaugcaaggugagcaacaaggcccugccugcucccaucgagaaaaccauuuccaaggccaaaggccagccucgggaaccccaaguuuauacacugccgccuucucgcgaggaaaugaccaagaaucaggugagccucacgugucuggucaaaggguuuuaccccuccgacaucgcgguggagugggaaucuaacggacagccugagaauaacuacaagacaacacccccugugcuugauagcgacggcuccuucuuucuguauagcaagcucaccguugacaaaucuagauggcaacaggggaacgucuucuccugcagcgugaugcaugaagcccugcacaaucauuacacccagaagucucuuucccugagccccgga

SEQ ID NO: 38782 - RNA, 657 nt, Artificial Sequence
  derived and/or modified sequence opt5 from Modotuximab_LightChain1
gacaucgugaugacccaggccgcuuucagcaaccccgucacacugggcacguccgccucuauuagcugcagauccucuaagagccuccugcacuccaaugggaucaccuaccuuuauugguaccugcaaaaaccuggacagucuccgcagcuccugauuuaucagaugagcaaccuugcguccggcguucccgaucgguuuuccucuuccgggagcggaacagacuucacccugcgcaucucuagaguggaggcugaagaugugggcgucuacuauugugcccaaaaucucgagcugccuuacacauuugggggaggcaccaagcuggaaauuaaacggacaguggccgcucccuccguuuucaucuuuccucccagcgacgagcagcucaagucuggcaccgccuccguggucugccugcuuaacaauuucuauccucgcgaagcuaaagugcaguggaagguugauaacgcccugcagagcgggaauagccaagagucugugacggagcaggacagcaaggauuccaccuacagccucucuuccacacugacccuuagcaaagcggacuacgaaaagcauaaagucuaugccugugaggugacacaccagggacugucuagcccggugaccaaguccuuuaacagaggcgaaugc

SEQ ID NO: 38783 - RNA, 1347 nt, Artificial Sequence
  derived and/or modified sequence opt5 from Mogamulizumab_HeavyChain1
gaggugcagcuggucgaaagcggcggggaccucguucaacccggaagaucccugcggcuuucuugcgccgcuagcggcuucaucuuuuccaacuacgggaugucuugggugcgccaggccccuggaaagggccuggaguggguggcgaccauuagcuccgcuucuacauauagcuacuauccggauuccgucaaagggagauucacgaucagccgggacaaugccaagaacucucucuaccugcagaugaacucccuucgcguggaagauaccgcccuguauuacuguggaagacacagcgacggcaauuuugcuuucggcuauugggggcagggaacacucguuaccgugucuuccgccagcacaaaaggccccucugucuuuccucuggcucccuccagcaaguccaccucugggggaacagccgcgcugggcugccucgugaaagauuacuucccugagcccguuaccgugagcuggaacuccggggcccugacgagcggaguccauaccuuuccugcugugcuucaaucuuccggccuguacagccucucuagcguggucacaguuccguccucuagccugggcacccagacauauauuuguaaugugaaucacaagcccuccaacaccaagguggacaaaaaggucgaaccuaaaagcugcgauaagacgcauacaugucccccuugccccgccccggagcuucucgggggaccuucuguguuccuguuucccccuaaacccaaggacacccugaugaucucccggacacccgagguuaccuguguggucguggauguuagccacgaagacccugaggugaaguucaauugguacgucgauggcguggaaguccauaacgcuaaaaccaagccgcgcgaggagcaguauaauucuacauacagagugguuuccgugcugacgguccuccaccaggacuggcugaacgggaaagaauauaagugcaaagugagcaauaaggcccuucccgcgccuauugagaaaaccaucuccaaggccaagggacaaccccgggaaccucagguuuacacacugcccccgucucgcgaugagcucaccaaaaaccaggugagccugacaugucuugucaagggcuuuuauccuuccgacaucgcuguggaaugggagucuaaugggcagcccgagaacaacuacaaaaccacgccucccgugcuggacagcgauggauccuucuuucucuacagcaagcugacaguugacaaaucuagauggcaacagggcaaugucuucuccugcagcgugaugcacgaagcccugcauaaccacuauacccagaagucucucucccugagcccuggcaag

SEQ ID NO: 38784 - RNA, 657 nt, Artificial Sequence
  derived and/or modified sequence opt5 from Mogamulizumab_LightChain1
gacgugcugaugacccagagcccccucucccugccugucacaccgggcgagcccgccucuaucagcugccgguccucucggaacauuguucacaucaauggggauacguaccuugaaugguaucugcaaaagccuggacagagcccccagcuccugauuuacaaaguguccaaccgcuucucuggcgugccugacagauuuagcggguccggaagcggcaccgauuucacacuuaagaucucucgggucgaggcugaagacguggggguuuauuacuguuuucagggaucccugcuccccuggaccuucggccaaggcacaaaaguggagauuaagcgcaccgucgccgcgccuagcguguuuaucuucccgcccucugaugaacagcugaaauccgggacagcuagcguugugugccugcucaauaacuuuuauccuagagaggccaagguccaguggaagguggacaaugcccugcagucuggaaacucccaagagagcgugaccgaacaggauuccaaagacucuacguacagccuuuccagcacccugacacucucuaaggcugauuaugagaaacauaaggucuacgccugugaaguuacccaccagggccuguccagccccgugacaaaaucuuucaauagaggggagugc

SEQ ID NO: 38785 - RNA, 1356 nt, Artificial Sequence
  derived and/or modified sequence opt5 from Monalizumab_HeavyChain1
caggugcaacugguccagagcggcgccgagguuaagaaacccggggcuuccgugaaggugucuugcaaagccagcggauacaccuucacauccuauuggaugaacugggucagacaggcgccuggccaggggcucgaauggaugggacggaucgacccguacgauucugagacgcacuaugcucaaaagcugcagggccgcgugaccaugacaaccgacacaagcaccuccacagccuacauggaacuuagaucucugcggagcgaugacaccgccguuuauuacugugcucgcgggggauaugauuuugacgugggcacgcucuacugguucuuugaugucuggggccaggggaccacagugaccguuuccagcgccucuacaaaaggacccuccguguucccucuggcucccugcagcagaucuaccuccgagagcacggccgcgcuuggcugucuggucaaggacuacuuuccugaacccgugacagugucuuggaacuccggggcccucaccagcggaguccauacauucccugcuguucugcaguccucuggccuguauagccucuccagcguggugaccgucccgucuuccagccuggggaccaagacauacacgugcaauguggaucacaaacccucuaauaccaagguugacaaacggguggagagcaaguauggaccucccuguccucccugcccggccccugaguuucuuggcggccccuccgucuuccuguuuccucccaaacccaaggauacacucaugauuucucgcaccccugaagugacauguguuguggucgacgugagccaagaggauccggaaguccaguucaacugguacguggacgggguugaggugcauaaugcuaagaccaaacccagagaggaacaguuuaacuccacguaucgggucgugagcguucugacagugcuucaccaggacuggcugaauggaaaggaguacaaaugcaaggucucuaacaaaggccucccuuccagcaucgaaaagaccauuucuaaagccaaggggcaaccccgcgagccucagguguauacccugcccccgucccaggaagagaugacaaagaaucaagugagccugaccugucucguuaaaggauucuacccuuccgauaucgcggucgagugggaaucuaacggccagcccgagaauaacuacaagacaacgccucccgugcuggacagcgauggguccuuuuuccuuuauucuagacugaccguggacaaaagccgguggcaggaaggaaaugucuucuccugcagcgugaugcaugaggcccuccacaaccacuacacacagaagucucugucccuuagccugggcaaa

SEQ ID NO: 38786 - RNA, 642 nt, Artificial Sequence
  derived and/or modified sequence opt5 from Monalizumab_LightChain1
gacauccagaugacccaaagccccuccucucugagcgccuccgugggcgauagagucacaauuacgugccgggcuucugagaacaucuacagcuaucucgccugguaccagcagaagccugggaaagcgccgaagcugcuuauuuauaaugcuaaaacccuggccgaaggaguucccucccgcuucucuggcagcggguccggaacagacuuuacccucacaaucagcucucugcagccugaggauuucgccaccuacuauugucaacaccauuacggcacacccagaaccuuugggggaggcacgaagguggaaauuaaacggaccguggcugccccuuccgucuucaucuuucccccuagcgacgagcagcuuaagucuggcacagcuuccgugguuugccugcucaacaauuucuauccgcgcgaagccaaggugcaguggaaagucgauaacgcgcugcagagcggaaauucucaagaguccgugaccgagcaggacagcaaggauuccacauacucucugagcuccacccucacgcugagcaaagccgacuacgaaaagcacaaaguuuaugcuugugaggugacacaucaggggcuuucuucccccgucaccaagagcuuuaacagaggcgaaugc

SEQ ID NO: 38787 - RNA, 1350 nt, Artificial Sequence
  derived and/or modified sequence opt5 from Motavizumab_HeavyChain
caggugacccugagagagagcggccccgcccucgucaagccuacacaaacgcugacccuuacaugcaccuucuccggguuuucucugagcacagcuggaauguccguuggcuggauccggcagccgcccgggaaagcccucgaauggcuggcggacauuuggugggaugacaagaaacacuacaacccuucucuuaaggaucgccugaccaucagcaaagacacauccaagaaucagguggugcucaaggucaccaacauggaucccgcugacacggccaccuauuacugugccagagauaugauuuucaauuuuuauuucgacguguggggacagggcacaaccguuacagugucuagcgcuuccaccaaagggccuagcgucuuuccccuggccccuucuuccaagagcacgucuggaggcacagcugcccugggcugccucgugaaagauuacuucccggagcccguuaccguguccuggaacagcggggcgcugacaucuggaguccauaccuuuccugccgugcuucaauccagcggccuguauucccucucuagcguggucaccguucccuccagcucucuggggacacagacguacaucuguaaugugaaccacaagccuuccaauaccaaaguggacaagcgggucgaacccaagagcugcgauaaaacacauaccuguccgccuugccccgcuccugagcuucugggaggccccucuguguuccucuuucccccuaagccgaaagacacacugaugauuagccgcacccccgaaguuacguguguggucguggauguuucccacgaggacccugaggugaaguucaacugguaugucgacgggguggaaguccauaaugccaaaacaaagcccagagaggaacaguacaacucuaccuaccgggugguuagcgugcugaccguccuccaccaggauuggcugaauggaaaagaguauaagugcaagguguccaacaaagcccuuccugcucccaucgagaagacaaucagcaaagcgaagggccaaccgcgcgaaccucagguuuacacccugcccccuucuagagaggaaaugacgaaaaaucaggugucccucacaugucuggucaagggcuuuuaucccagcgacauugccguggagugggaaucuaacgggcagccugagaauaacuacaagaccacacccccggugcuugauuccgacggcagcuucuuucuguauuccaaacucaccguugauaagucucgguggcaacagggaaacgucuucagcugcuccgugaugcacgaggcucugcauaaucacuacacacagaaaucucugagccucuccccugggaag

SEQ ID NO: 38788 - RNA, 1350 nt, Artificial Sequence; identical to SEQ ID NO: 38787
  derived and/or modified sequence opt5 from Motavizumab_HeavyChain_variant

SEQ ID NO: 38789 - RNA, 639 nt, Artificial Sequence
  derived and/or modified sequence opt5 from Motavizumab_LightChain
gacauccagaugacccaaagccccuccacacugucugccagcgugggcgauagagucacgauuaccugcuccgcuucuagccggguuggguacaugcacugguaucagcagaagccuggaaaagccccgaagcuccugaucuacgacacauccaaacuugcgucuggcgugcccagccgcuucuccgggagcggaucuggcaccgaguuuacacugaccauuuccagccuccagccugaugacuucgcuacauauuacuguuuucaagggucuggauaucccuucaccuuuggcggcgggacgaagguggaaaucaaaagaaccgucgccgccccuuccguguucauuuuucccccuagcgaugagcagcugaagucuggaacagcuuccguugugugccuucugaacaauuucuacccgcgggaagccaagguccaguggaaaguggacaacgcucuccagagcggcaauucccaagagucuguuaccgaacaggauagcaaggacuccacauauagccugucuuccacccugacgcucagcaaagccgauuacgagaagcauaaaguguacgcgugugaggucacacaccaggggcugucuagccccgugaccaaguccuuuaaccgcggagaaugc

SEQ ID NO: 38790 - RNA, 639 nt, Artificial Sequence; identical to SEQ ID NO: 38789
  derived and/or modified sequence opt5 from Motavizumab_LightChain_variant

SEQ ID NO: 38791 - RNA, 1428 nt, Artificial Sequence
  derived and/or modified sequence opt5 from Moxetumomab_pasudotox_HeavyChain1
auggaggugcagcuggucgaaagcggcgggggacucguuaagcccggcgggucccugaaacuuucuugcgccgcuagcggauucgccuuuuccaucuacgacaugucuugggugagacaaaccccugagaagugucuggaauggguggcguauauuagcuccggcgggggaacaacguacuauccggauaccgucaaaggccgguucacaaucucucgcgacaacgcuaagaauacccucuaccugcagaugagcucccuuaaaagcgaggauacagccauguauuacugcgccagacacucuggcuaugggacccauuggggagugcuguuugcuuacuggggccaggggacacucguuaccguguccgccaaggcuagcggaggccccgaagggggaucucuggccgcgcugacggcccaccaggcuugucaucucccucuggagaccuucacacggcaccgccaacccagaggcugggagcagcuugaacagugcggcuacccuguccagcggcugguggcccucuaucuggcugcccgccuuuccuggaaccaaguugaccaggugauuagaaaugcgcuggccagccccgggucuggaggcgaucucggggaggcuauccgggaacagccugagcaggcccgccuggcucugacccucgccgccgcugaguccgaaagauuuguccggcaaggaacaggcaacgacgaggcgggggccgcuaauggaccggccgauagcggcgacgcccugcuugaacgcaacuaccccaccggcgcugaguuccugggggauggaggcgacguguccuuuucuacgagagggacacagaauuggaccguggaacggcuccugcaggcccaucgccaacuugaggagagaggauaugucuucguuggcuaccacgggacauuucuggaagcggcucagagcauuguguucggcggagugcgggccagaucccaggaucucgacgccaucuggcgcggcuuuuauaucgcuggggauccugcccuggcuuacggauaugcccaggaccaagagcccgacgcgcggggccgcauuagaaacggggcccugcuccgggucuacgugccuagaagcucucugcccggauucuaccgcaccucccuuacccuggcugccccggaagcugccggcgagguugaacggcucaucgggcacccucugccccuuagacuggaugcgauuacaggcccugaggaggaaggaggccgccucgagacgauccugggguggccccuggccgaacggaccguggucauucccagcgcuaucccuacagacccgagaaaugugggaggcgaucucgaccccucuagcauuccugauaaggagcaggccaucuccgcucugcccgacuaugccucucagccugggaaacccccgcgcgaagaucuuaag

SEQ ID NO: 38792 - RNA, 324 nt, Artificial Sequence
  derived and/or modified sequence opt5 from Moxetumomab_pasudotox_LightChain1
auggacauccagaugacccaaacaacgagcucccugucugccagccucggcgauagagugaccauuuccugccgggcuucucaggacaucagcaacuaccugaauugguaucagcagaagcccgaugggacagucaaacuucugauuuacuauaccuccauccuccacucuggaguuccuagccgcuucuccggcagcgggucuggaacagacuacucccugaccauuagcaaccuugagcaagaagauuuugccacauauuucugucagcagggcaauacccugccguggacguuugggugcggaaccaagcucgagaucaaa

SEQ ID NO: 38793 - RNA, 1350 nt, Artificial Sequence
  derived and/or modified sequence opt5 from Muromonab-CD3_HeavyChain
caggugcaacugcagcagagcggcgccgagcucgcuagacccggggccuccgucaagaugucuugcaaagcgagcggauacaccuucacacgguauacgaugcacuggguuaagcagcgcccuggccaagggcuggaauggaucggauacauuaacccguccagaggcuauaccaauuacaaccagaaauuuaaggacaaagcuacacuuaccacagauaagucuagcuccaccgccuauaugcagcugucuagccucacauccgaggacagcgccguguacuauugugcucgguacuacgaugaccauuauugccuggauuacugggggcagggaaccacgcuuaccgugucuuccgccaagacaaccgcucccagcgucuauccucuggcccccguguguggcggcacaaccgggucuuccguuacgcucggaugccuggugaaaggcuacuucccugaacccgucacacugaccuggaauagcgggucucucuccagcggagugcacacauuuccugcgguucugcaauccgaccuuuauacccugucuagcuccgugaccgucacaagcucuacguggccgucccagagcaucaccuguaacguggcccaucccgcuucuagcacaaagguggauaaaaagauugagccucgccccaaauccugcgacaagacccacacauguccucccugcccggccccugaacuccugggcgggcccucugucuuccuuuuuccucccaagcccaaagauacccugaugaucagcagaacgccugagguuacaugugugguggucgacgugucccaugaggauccggaaguuaaguucaauugguacguggacggagucgaggugcacaacgcuaaaaccaagccccgggaggaacaguauaauagcaccuaccgcguugugucuguccucacagugcugcaccaggauuggcugaacggcaaagaguacaagugcaaagucuccaauaaggcccucccugcgcccauugaaaagaccaucagcaaagccaagggccaaccuagagagccccagguguauacacugccgccuucucgggacgaacuuacgaaaaaccagguuucccugaccugucucgugaagggguuuuaccccagcgacaucgcugucgagugggaauccaauggacaaccugagaacaauuauaaaacaacacccccugugcuggauucugacggcagcuucuuucuuuacuccaagcugaccguugauaagucucgcuggcagcaggggaacguguucagcugcuccgucaugcaugaggcccuccacaaucauuauacccagaaaagccugucucugucccccggaaag

SEQ ID NO: 38794 - RNA, 639 nt, Artificial Sequence
  derived and/or modified sequence opt5 from Muromonab-CD3_LightChain
cagaucgugcugacccaaagccccgccauuauguccgcuucuccuggcgagaaggucacaaugacgugcagcgccuccucuagcguuuccuacaugaacugguaucagcagaaaucugggaccagcccgaagagauggaucuacgacacauccaaacucgcgagcggagugcccgcucacuuccggggcucuggguccggaaccagcuauucucugacaauuuccggcauggaagccgaggaugccgcuaccuacuauugucagcaauggagcucuaauccuuuuacauucggguccggaaccaagcuggaaaucaaccgcgccgacacggcucccaccgugagcauuuuuccucccuccucugagcagcugacaagcggcggcgccuccgucgugugcuuccucaauaacuuuuacccuaaagauaucaauguuaaguggaagaucgacgggagcgaaagacagaacggagugcuuaauucuuggaccgaucaggacuccaaagauagcacauauucuaugagcuccacccuuacgcugacaaaggacgaguacgagcggcauaacucuuacaccugugaagcgacacacaaaaccagcaccuccccgauugucaagagcuucaaucgcaacgagugc

SEQ ID NO: 38795 - RNA, 1347 nt, Artificial Sequence
  derived and/or modified sequence opt5 from Namilumab_HeavyChain1
caggugcaacugguccagagcggcgccgagguuaagaaacccggggcuuccgugaaggugucuugcaaagccuucggauacccuuuuaccgacuaucuccugcacugggucagacaggcgccgggccaggggcuugaaugggugggauggcugaaccccuacagcggcgauacaaauuaugcucaaaaguuccaggggcggguuacgaugacccgcgacacauccaucucuaccgccuacauggagcucagcagacugcgguccgaugacacagccguguauuacuguacccgcacaacccuuauuucugucuauuuugauuacuggggacagggcacgauggugaccguuagcuccgcuagcacaaaaggcccuucuguguucccccuggccccuuccagcaagucuaccuccgggggaacagcugcccucggcugccuggucaaggacuacuuucccgaaccugugaccgugagcuggaacucuggggcgcugacguccggaguccauacauucccggccguucuccagagcuccggccuguauucucuuagcuccguggugaccguccccucuagcucccuggggacacaaaccuacaucuguaaugugaaccacaaaccuagcaauaccaagguugauaaaaagguggagcccaaaucuugcgacaagacacauacguguccucccugcccggcuccugaacuccugggaggccccagcgucuuucuuuucccucccaagcccaaagauacccugaugauuuccagaacaccugaggugaccuguguuguggucgacgugucucacgaggauccggaagucaaguuuaacugguauguggacggcguugaggugcauaaugccaaaacaaagccccgggaggaacaguacaacagcaccuaucgcgucguguccguucucacggugcugcaccaggauuggcugaaugggaaagaguacaagugcaaagucagcaacaaggcucucccugcccccaucgaaaagacaauuucuaaagcgaagggacagccuagagagccccaaguguauacccugccgccuucccgggacgaacuuaccaaaaaucaggugagccugacaugucucguuaagggcuucuaccccucugacaucgccgucgagugggaauccaacgggcagccugagaauaacuacaaaaccacacccccugugcuggauagcgacggauccuuuuuccuuuauucuaagcugacgguggauaagagccgcuggcaacagggcaaugucuuuuccugcucugugaugcacgaggcucuccauaaccacuacacccagaaaagccugucccugagccccgggaag

SEQ ID NO: 38796 - RNA, 642 nt, Artificial Sequence
  derived and/or modified sequence opt5 from Namilumab_LightChain1
gacauccagaugacccaaagccccuccucugugagcgccuccgucggcgauagaguuacaauugcuugccgggccucucagaacauccgcaauauucugaacugguaccagcagagaccugggaaagcgccgcaacuccugaucuaugcugccagcaaucuucaguccggagugcccucucgguucagcggcuccgggagcggaacggacuuuacccugacaauuaacucucuccagccugaggauuucgccaccuacuauugucagcaauccuacagcaugccccgcacauuuggcgggggaaccaaacuggaaaucaagagaacaguggcugccccuucugucuucaucuuucccccuuccgacgagcagcuuaaaagcggcaccgcuucugugguuugccugcucaauaacuucuauccgcgggaagccaaggugcaguggaaagucgauaaugcgcugcaguccggcaacagccaagaguccgugacggaacaggacucuaaggauagcaccuacucccugagcucuacacucacccuguccaaggccgacuaugagaaacacaagguuuacgcuugugaggugacacaucaggggcuuagcucucccgucaccaagagcuuuaaucgcggagaaugc

SEQ ID NO: 38797 - RNA, 1374 nt, Artificial Sequence
  derived and/or modified sequence opt5 from Naptumomab_estafenatox_HeavyChain
gaggugcagcugcaacagagcggccccgaccucgucaagccuggggccuccguuaaaaucucuugcaaggcuagcggauacuccuucaccggcuauuacaugcacugggugaaacagucuccggggaagggacuggaauggauuggcagaaucaaccccaauaacggggugacacuuuauaaucagaaauuuaaggauaaggccacgcugaccgucgacaaaagcuccacaaccgcguacauggagcuccggucucugacaagcgaagauuccgcuguguauuacugugcccgcagcaccaugauuacaaacuauguuauggacuacuggggacaaggcaccucugugacggucuccagcgccaagaccacaccucccucuguguacccucuugcucccggcuccgccgcucagaccaauagcaugguuacacuggggugccucgugaaaggauauuucccugagccggucaccgugacguggaacucuggcucccugagcuccggggugcauacauuucccgccguccugcagucugaucucuacacccugagcuccagcguuacagugccuucuuccaccuggcccagcgaaaccgugacauguaaugucgcgcacccugccucuagcacgaagguggacaaaaagaucguucccagagauuccggaggcccgucugaaaagagcgaggagauuaacgagaaagaccuucggaagaaauccgaacugcaggggaccgcucucggaaaucugaagcaaaucuauuacuauaacagcaaagccaucacaucuuccgaaaagagcgcugaucaguuccuuaccaauacacugcucuuuaaaggcuucuuuaccggccauccuugguacaacgaccugcugguggaucucgggucuacggccgcgacauccgaguaugagggaagcuccgucgaccuguacggcgccuacuauggguaccagugcgcuggaggcacccccaauaagaccgccuguauguaugggggagugacacuucacgauaacaaucgccugaccgaggaaaagaaaguuccuauuaaccucuggaucgacggcaagcagacaacggugcccauugacaaagucaagaccucuaaaaaggaggugacaguccaagaacuggaucuucaggcuagacauuaccugcacggcaaguucgggcucuauaacagcgacuccuuuggaggcaaagugcagcgggggcugaucguuuuccacucuagcgagggauccaccgugagcuacgaucuguuugacgcccaaggccaguaucccgauacacuccugcgcauuuacagagacaauaccacgaucucuuccaccagccuuucuauuucccuguaccucuauacaacc

SEQ ID NO: 38798 - RNA, 642 nt, Artificial Sequence
  derived and/or modified sequence opt5 from Naptumomab_estafenatox_LightChain
agcaucgugaugacccagacacccacgucccugcucgucucugccggcgacagaguuaccauuacaugcaaggcuagccaauccgugucuaacgauguggccugguaccagcagaaaccugggcagagcccgaagcugcuuaucuccuauaccucuagccgguacgcgggaguccccgaccgcuucuccggcagcggguauggaacagauuuuacccugacaauuucuuccgugcaagcugaggacgccgccguuuacuucugucagcaggauuauaauagcccucccaccuuuggcgggggaacgaaacucgaaaucaagagagcugacgccgcuccuaccgugucuauuuuucccccuuccagcgagcagcugacaucuggcggcgccuccgucgugugcuuccuuaacaauuucuacccgaaagauaucaacguuaaguggaagaucgacgggagcgaacggcaaaauggagugcugaacuccuggaccgaucaggacucuaaagauagcacauauuccaugagcucuacccucacgcugacaaaggacgaguacgaacgccacaauuccuacaccugugaggcgacacauaaaaccagcaccucucccauugucaagagcuuuaacagaaaugagucc

SEQ ID NO: 38799 - RNA, 1356 nt, Artificial Sequence
  derived and/or modified sequence opt5 from Narnatumab_HeavyChain1
gaggugcagcuggucgaaagcggcgggggacucguucaacccggcgggucccugagacuuucuugcgccgcuagcggauucaccuuuuccucuuaccugaugacaugggugcggcaggccccuggcaaggggcucgaguggguggcgaacaucaaacaggacggaagcgaaaaguauuacgucgauuccgugaaaggccgcuucacgauuucuagagacaaugcuaagaacagccugaaucuucagaugaacucccugcgggccgaggauaccgccguuuauuacuguacacgcgacggcuauagcucugggagacacuacggaauggauguguggggccaagggaccacagucaucguguccagcgcuucuaccaaaggaccguccguuuuuccccucgccccuagcucuaaguccacaagcggcgggaccgcugcccugggaugccuggugaaggacuauuuccccgaaccugucacgguguccuggaacucuggcgcgcucaccagcggcgugcauacauuucccgccguccugcaguccagcgggcuuuacucucuguccagcguugugaccgugccuucuagcucccucggaacacagaccuacauuuguaaugucaaucacaaaccgucuaacacgaagguggauaaacggguugagcccaagagcugcgacaaaacacauaccuguccucccugcccugcucccgagcugcuuggcgggccguccguguuccuguuuccucccaagccuaaggauacacucaugaucagccgcacccccgaagucaccugugugguuguggacgucucucacgaggaucccgaagugaaauucaauugguaugucgacggaguggagguucauaacgccaagacaaaaccuagagaggaacaguacaauuccacguaucggguggucagcgugcugaccguucugcaccaagauuggcucaacggcaaggaguacaaaugcaaggugucuaauaaagcucugccggcccccauugaaaagacaaucuccaaggcgaaagggcagccucgcgagccccaggucuauacccuuccucccagcagagaagagaugacaaagaaccaggugucccugaccugucucgugaaaggauuuuacccgucugacaucgccguugagugggaaagcaauggccaaccugagaacaacuauaagacgacacccccuguccuggacuccgauggcucuuucuuucuuuacagcaaacugaccguggacaagucccgguggcagcaggggaauguguucagcugcucugucaugcacgaagcucuccauaaccacuacacccaaaagucccugagccugucucccggaaaa

SEQ ID NO: 38800 - RNA, 642 nt, Artificial Sequence
  derived and/or modified sequence opt5 from Narnatumab_LightChain1
gagaucgugcugacccagagccccgccacacucucccugucuccuggcgaacgggcuacgcuuagcugccgggccucccaaucugucagccgcuaccuggcgugguaucagcagaagccggggcaggcucccagacuccugauuuacgacgccuccaaccgggccaccggaaucccugcucgcuucucuggcagcggguccggaacagauuuuacccuuacaauuagcucucuggagcccgaagacuucgccguuuauuacugucaacagagauccaauuggccucggaccuuuggccaggggacaaaaguggagaucaagcgcaccguggcugcccccagcgucuucauuuuuccuccgucugaugaacagcucaaauccggaacggcgagcgugguuugccugcugaacaauuucuaucccagagaggccaaggugcaauggaaagucgacaacgcucuccagucuggcaauucccaggagagcgugaccgaacaggauuccaaggacucuacauacagccuguccagcacccuuacacugucuaaggccgauuaugagaaacacaagguuuacgcuugugaagugacccaucaaggccucuccagcccugucacgaaaucuuuuaacagaggggagugc

SEQ ID NO: 38801 - RNA, 1350 nt, Artificial Sequence
  derived and/or modified sequence opt5 from Natalizumab_HeavyChain1
caggugcaacugguccagagcggcgccgagguuaagaaacccggggcuuccgugaaggugucuugcaaagccagcggauucaacaucaaggacaccuacauucacugggucagacaggcgccuggccagcggcucgaauggauggggcgcaucgauccggcuaauggauauacaaaauacgaccccaaguuucaaggcagagugacgauuaccgccgauacauccgccucuaccgcuuauauggagcugagcucccuucggucugaagacacagccguuuacuauugugcucgcgagggguacuauggaaacuacggcguguacgccauggauuauuggggccaggggacccuggucacagugagcuccgcgagcaccaagggaccuucuguuuucccccucgccccuugcuccagaagcacgucugaauccaccgcugcccugggcugucuugugaaagacuacuuucccgagccugucacagugagcuggaauagcggggcucugaccuccggagugcauacauucccggccguccuccagagcuccggccuguauucucugagcuccguugugaccgugcccucuucuucccucgggacgaagacauauaccugcaacgucgaucacaaaccuagcaauacaaagguggacaaacggguugagucuaaguacggacccccuugucccagcugcccggcgccugaauuucugggcggccccuccguguuccuuuuuccucccaagcccaaagauacccugaugaucucucgcaccccugaggucacaugugugguuguggacgucagccaggaagauccggaggugcaauucaacugguacgucgacgggguggagguucauaaugccaagacgaaacccagagaggaacaguuuaacuccaccuaucggguggucagcgugcucacaguucugcaccaggauuggcuuaauggaaaggaauacaaaugcaaggugucuaacaaaggccugccuuccagcauugagaagaccaucucuaaggcuaaagggcagccccgcgaaccucaagucuacacacugcccccgucccaggaggagaugaccaagaaucaggugagccucacgugucuggugaaaggauucuauccuuccgacaucgccguugaaugggagucuaacggccaacccgaaaauaacuacaagacaaccccucccguccucgacagcgauggguccuuuuuccuguauucuagacuuaccguggacaaaagccgguggcaggagggaaauguguuuuccugcagcgucaugcaugaagcucugcacaaccacuacacacagaagucucucucccugagccuuggcaag

SEQ ID NO: 38802 - RNA, 639 nt, Artificial Sequence
  derived and/or modified sequence opt5 from Natalizumab_LightChain1
gacauccagaugacccaaagccccuccucucugagcgccuccgugggcgauagagucacaauuacgugcaaaaccucucaggacaucaacaaauacauggcuugguaucagcagacaccugggaaggccccgcggcuccugauucacuacaccagcgcgcuucaacccggaaucccuucccgcuucucuggcagcggguccggaagagauuauacauuuaccauuagcucucugcagcccgaggacaucgcuacauacuauugucuccaguacgauaaucuguggaccuucggccaggggacgaaaguugaaaucaagcggaccguggccgccccuuccguguuuauuuuucccccuagcgacgagcaacuuaaaucuggaacagcuuccgucgugugccugcucaacaauuucuauccgcgcgaagccaagguucaguggaagguggauaacgcucugcagagcggcaauucucaggaguccgucaccgaacaagacagcaaagauuccacauacucucugagcuccacccucacgcugagcaaggccgacuacgagaaacauaagguguaugcgugugagguuacacaccagggccuuucuucccccgugaccaagagcuucaacagaggggaaugc

SEQ ID NO: 38803 - RNA, 1335 nt, Artificial Sequence
  derived and/or modified sequence opt5 from Navicixizumab_HeavyChain1
caggugcaacugguccagagcggcgccgagguuaagaaacccggggcuuccgugaagaucucuugcaaagccagcggauacuccuucaccgcguauuacauucacugggugaagcaggcuccuggccaggggcucgaauggaucggauauauuucuaacuacaauagagccacaaacuauaaucaaaaauuuaagggccgggucacguucaccacagacaccagcacauccaccgccuacauggagcugcgcucucuuagaagcgaugacacagcuguguauuacugugcccgggauuacgacuaugauguugggauggacuacuggggacagggcacccuggugacggucuccagcgcuucuaccaagggcccguccguguuuccccucgccccuugcagccgcucuacauccgaaagcaccgcggcccuggggugucuuguuaaagauuauuuccccgagccugugacagucucuuggaacuccggagcucugaccagcggcgugcauacguuucccgccgugcuccaguccucugggcuguacagccuguccagcgucguuacagugccuucuuccaauuucggaacccagacauauaccugcaacguggaccacaagccgagcaauaccaaagucgauaagacaguggaaagaaaauguugcguugagugucccccuugccccgcuccucccguggccggcccgucugucuuucucuucccucccaagccuaaggacacgcugaugaucagccggacccccgaggugacauguguuguggucgaugugucccaugaagaccccgagguccaauuuaacugguacguggaugggguugaagugcacaaugcgaaaaccaagccucgcgaggagcaguucaacucuacauuuagagucgugagcguucuuaccgugguccaucaggacuggcugaauggaaaagaauauaagugcaaaguguccaacaagggccucccggcccccauugagaaaacgaucagcaagacaaagggccagccucgggaaccccaaguguacacccugccucccucucgcgaggaaaugaccaaaaaucagguuucccuuacaugucuggucgagggguucuacccgagcgacaucgcuguggagugggaaucuaacggacagccugagaauaacuauaagaccacacccccuaugcucgauuccgacggcagcuuuuuccuguacuccgaacugacgguggauaaaucuagauggcaacaggggaacgucuucagcugcuccgugaugcacgaggcccuccacaaucauuauacccagaagucucugagccuuucccccggaaaa

SEQ ID NO: 38804 - RNA, 1341 nt, Artificial Sequence
  derived and/or modified sequence opt5 from Navicixizumab_HeavyChain2
caggugcaacugguccagagcggcgccgagguuaagaaacccggggcuuccgugaaggugucuugcaaagccagcggauacaccuucacaaacuauuggaugcacugggucagacaggcgccuggccaggggcucgaauggaugggagacaucaauccguccaacggccggacgucuuacaaggagaaauuuaagcgcagagugacccugagcguugauaaguccucuagcacagcuuauauggaacuuuccagccugcggucugaggacaccgccguguacuucuguacaauucauuaugaugacaaauacuauccccucauggauuacugggggcaaggaacccuggucacaguguccagcgccucuaccaagggcccuuccguuuuuccccuugcuccuugcagccgcucuacguccgaaagcaccgccgcucugggcugucucgugaaagacuacuuccccgagccugucacaguguccuggaacucuggggcccugaccagcggagugcacacauuuccggcgguccugcaguccagcggccucuauucucuguccagcguugugaccgugcccucuagcaauuucgggacgcagacauauaccugcaaugucgaucauaagccuuccaacacaaaaguggacaagaccguugagagaaaguguugcguggaaugucccccuugccccgccccgccugucgcuggacccucuguguuucuuuucccucccaaacccaaggauacccugaugaucagccggacaccugagguuacguguguggucguggacgucucccacgaagauccggaggugcaguuuaauugguacguugacggcguggagguccauaacgccaaaaccaagccccgcgaggaacaauucaauagcacauuuagagugguuucugugcucaccgucgugcaccaggauuggcugaacgggaaagaauacaagugcaaaguguccaauaagggacuuccugcucccauugagaagacaaucagcaaaaccaagggccagccucgggaaccccagguuuauacgcugccgccuucucgcgagaaaaugacaaagaaccaagucucccucaccugucuggugaaaggcuucuaccccagcgacauugccguggagugggaauccaaugggcagccugagaacaauuauaagaccacacccccuaugcugaagucugacggcagcuuuuuccucuacuccaaacugaccgucgauaagucuagauggcagcaaggaaacguguucagcugcuccguuaugcacgaagcgcuucauaaccacuacacacagaaaagccugucucucucccccgggaag

SEQ ID NO: 38805 - RNA, 654 nt, Artificial Sequence; identical to SEQ ID NO: 38409
  derived and/or modified sequence opt5 from Navicixizumab_LightChain1

SEQ ID NO: 38806 - RNA, 1368 nt, Artificial Sequence
  derived and/or modified sequence opt5 from Navivumab_HeavyChain1
caggugcaacugguccagagcggcgccgagguuaagaaacccggggcuuccgugaaggugucuugcaaaaccagcggauacuccuucucuacauauggcgucagcugggugagacaggccccugggcagggaccggaauggguuggcuggaucuccgcguacacggggauuaccgacuaugcucaaaaguuucagggacgggugacacucaccacagaugccaccacagccaccgcuuuccuggaccuucgcucucugagacccgaugacacggccaccuacuuuugugcucgggauaaaguccagggccgcguggagguuggcagcgggggaagacacgacuauuggggccaggggacacucgugaucgucuccagcgccucuaccaagggaccuuccguguucccccuggcgccuagcucuaaguccacaagcggcgggaccgccgcucuuggaugccuggugaaagauuacuuucccgaaccugucacgguuucuuggaacuccggcgcccucacaagcggcgugcauaccuucccggcugugcugcaauccucugggcuguauagccucuccagcgucgugacaguucccucuuccagccugggaacccagaccuacauuuguaaugugaaccacaagccuucuaauacaaaagucgacaagaaaguggagcccaagagcugcgauaagacgcauaccuguccucccugcccggccccugaacuucugggcgggcccuccguuuuucucuucccucccaaacccaaggacacacugaugaucucucggaccccugaggugacaugugucguggucgaugugagccacgaggacccggaaguuaaauuuaacugguacguggauggagucgaggugcauaaugcgaagaccaaaccccgcgaagaacaguauaacuccacguacagaguugugagcguccuuacagugcugcaccaggacuggcucaauggcaaggaguauaaaugcaaggugucuaacaaggcccugccugcucccauugagaaaaccaucuccaaggccaaagggcaaccucgggagccccagguuuacacccugccgccuagccgcgacgaacucacaaagaaucaggucucucugaccugucuugugaaaggauucuaucccuccgauaucgcuguggagugggaaagcaacggccaaccugagaauaacuacaagacaacgcccccuguccuggacuccgauggcagcuuuuuccucuauucuaagcugaccguggacaaauccagauggcagcaggggaauguguuuucuugcagcguuaugcacgagggacuucauaaccacuacacacagaagucccugagccucucucccggcaaa

SEQ ID NO: 38807 - RNA, 645 nt, Artificial Sequence
  derived and/or modified sequence opt5 from Navivumab_LightChain1
gaggugguccugacccagagccccggcacacucgcccugccuccgggggaaagagcuacgcuuuccugccgggccucucaccgcguuggaagcaccuacaucgcgugguaucaacagaaguccggccaggcucccagacggcugauuuacggggccucuaaccgcgccacagacaucccugauagauucagcggauccggcucugggaccgacuuuacacucaccauucggcgccuggagcccgaagauagcgcuguguauuacugucagcaauucuccgugagcccuuggacauuuggacagggcaccagagucgagaucaaacggacgguggccgcucccucuguuuucauuuuuccuccguccgacgaacagcuuaagagcggcaccgccucuguggucugccugcucaauaacuucuauccccgcgaggcgaaagugcaguggaagguugauaaugcccugcaauccgggaacagccaggagucugugacagaacaggacuccaaagauagcaccuacucccugucuagcacacucacccuguccaaggcugacuaugagaagcauaaagucuacgccugugaagugacgcaccagggacuuagcucuccugugacaaaguccuuuaauagaggcgagugc

SEQ ID NO: 38808 - RNA, 2172 nt, Artificial Sequence
  derived and/or modified sequence opt5 from Ndimab-varB_HeavyChain
caggugcaacuggucgagagcggcgggggaguugugcagcccggcagaucccuccggcugucuugcgccgcuagcggguucaucuuuuccucuuacgccaugcacugggugcgccaggcgccuggaaacggccuugaaugggucgcuuucaugagcuaugacggguccaauaagaaauacgccgauucugugaagggaagauuuaccauuagccgggacaacuccaaaaauacacuguaucuccagaugaacagccugcgcgccgaggauacggcuguuuacuauugugccagagaccggggcaucucugcuggcgggaauuacuauuacuacggaauggauguguggggccaagggaccacagucaccguguccagcgccucuacaaagggaccguccguuuucccccuugcgccuagcucuaaauccaccagcggcgggacagccgcucugggaugccucgugaaggacuauuuucccgaaccugucaccguguccuggaacucuggcgcccugacgagcggcgugcauaccuuccccgcuguccugcaguccagcgggcucuacucucuguccagcguugugacagugccuucuagcucccuuggaacccagacauauauuuguaaugucaaccacaagccgucuaauaccaaaguggauaagcgcguugagcccaaaagcugcgacaagacgcauacauguccucccugcccugcccccgaacugcucggcgggccguccguguuucuguucccucccaaaccuaaggauacccuuaugaucagcagaacacccgaggucaccugugugguuguggacgucucucacgaggaucccgaagugaaguuuaacugguacgucgacggaguggagguucauaaugcgaaaaccaagccucgggaggaacaguauaacuccacauaccgcguggucagcgugcugacgguucuccaccaagauuggcugaauggcaaagaguauaagugcaaagugucuaacaaggcccugccggcucccauugaaaagaccaucuccaaggccaaggggcagccuagagagccccaggucuacacacucccucccagccgggaagagaugaccaaaaaucaggugucccugacaugucuugugaagggauucuacccgucugacaucgcuguugaaugggagagcaacggccaaccugagaacaauuauaaaaccacgcccccuguccuggacuccgauggcagcuuuuuccucuacucuaagcugacaguggacaaaucccgcuggcagcaggggaacguguuuagcugcucugucaugcacgaagcccuucauaaucacuauacccaaaagucccugagccucucucccggaaagggcgggggaggcuccgggggcggaggcagccaggugcagcugguucagucuggggccgaggugaaaaagccuggaagcuccgucaaagugagcuguaaggcuucuggcgggaccuucuccacauacggaauuagcuggguuagacaagcgcccggccagugccuggaauggaugggcgggaucauuccgaucuucgauaccggaaacuccgcccagucuuuucagggccgggugacaauuacggcugacgagagcaccuccacagccuauauggaacucucuagccugcgcuccgaggauaccgccgucuacuauugcgcuagaucuagccggaucuacgaccuuaauccuucccugacagccuacuaugauauggacgugugggggcaaggaaccaugguuacggugagcucuggcgggggaggcuccgggggcggaggcagcgggggaggcgggucuggaggcgggggcucccagagcguccucacccagccucccucuguguccgcggcucccggacagaaagugacaauuagcuguuccggcagcucuagcaacaucgggaauaacuacgucuccugguaucaacagcugccgggaaccgcccccaaacuucugaucuacgauaauaacaagagaccuucuggcauucccgaccgcuucagcggguccaaaucuggaacaagcgccacccucggcaucacgggccugcagacaggggaugaggcugacuauuacugcggaaccugggacuccucucugagcgccuggguuuuuggcugugggacaaagcucaccgugcug

SEQ ID NO: 38809 - RNA, 645 nt, Artificial Sequence
  derived and/or modified sequence opt5 from Ndimab-varB_LightChain
gagaucgugcugacccagagccccgccacacucucccugucuccuggcgaaagagcuacgcuuagcugccgggccucccaaucugucuacagcuaucuggcgugguaccagcagaagccggggcaggcuccccgccuccugauuuaugacgccuccaacagagccaucggcauuccugcucgguucucuggaagcggguccggaaccgauuuuacacuuaccaucagcucucuggagcccgaagacuucgccguuuacuauugucaacagcgcuccaauuggccucccuuuacauucggcccugggaccaaaguggauauuaagagaacaguggcugccccgagcgucuuuaucuuucccccuucugacgagcagcucaaauccggaaccgcgagcgugguuugccugcugaacaauuucuacccccgggaagccaaggugcaguggaaagucgauaacgcucuccaaucuggcaauucccaggagagcgugacggagcaggacuccaaggauucuaccuauagccuguccagcacacuuacccugucuaaggccgacuacgaaaaacacaagguuuacgcuugugaggugacacaucagggccucuccagcccugucaccaaaucuuucaaccgcggggaaugc

SEQ ID NO: 38810 - RNA, 1353 nt, Artificial Sequence
  derived and/or modified sequence opt5 from Necitumumab_HeavyChain1
caggugcaacugcaggagagcggccccgggcucgucaagccuucccagacccugucucuuacaugcacgguuagcggaggcuccaucucuagcggggacuacuauugguccuggauuagacagccgcccggaaaaggccuggaauggaucggguacauuuauuacucuggaagcaccgauuauaacccuucccucaagagccgggugacaaugucuguggacaccuccaaaaaucaauucagccugaaggucaacucugugacagccgcugauaccgccguuuacuauugugcgcgcguguccaucuuuggcgucggcacauucgacuacugggggcagggaacccuugugacgguuagcucugcuuccaccaaaggccccagcgugcugccucucgcccccuccucuaagagcacauccgggggaaccgccgcucugggcugccuggucaaggauuacuuuccugagccggugacagugagcuggaauagcggggcccucaccuccggaguccacacguuccccgcuguucugcagagcucuggccuuuauagccuguccucuguggugacagucccuagcuccagccucggcacccagacauacauuuguaacgugaaucauaaacccucuaacaccaagguugacaaaagaguggaaccuaaguccugcgauaaaacccacacaugucccccgugcccugcccccgagcugcuugggggaccuagcgucuuucuguucccgcccaagccuaaggacacgcucaugaucucucggaccccggaagugacauguguuguggucgaugugucccaugaggaccccgaggucaaauuuaauugguauguggauggcguugaagugcacaacgcgaagaccaaaccucgcgaggaacaauacaauagcacauauagagucguguccguucugaccgugcugcaucaggacuggcucaacgggaaggaguacaaaugcaaggucucuaauaaagcccugcccgcuccuaucgagaagacgauuagcaaggccaaaggacagccccgggaaccccagguguauacacuuccucccucccgcgaggaaaugaccaagaaccaagugucucugaccugucucguuaaaggcuucuacccuagcgauaucgcugucgagugggaauccaaugggcagcccgagaacaauuacaagacaaccccucccgugcuggacagcgacggauccuuuuuccuuuauucuaaacugacaguggauaagagcagauggcagcaaggcaacgucuuuucuugcuccgugaugcacgaggcccuccacaaccauuacacgcagaagucucugucucugagcccgggcaaa

SEQ ID NO: 38811 - RNA, 642 nt, Artificial Sequence
  derived and/or modified sequence opt5 from Necitumumab_LightChain1
gagaucgugaugacccagagccccgccacacugucccucucuccuggcgaaagagcuacgcugagcugccgggccucccaaucugucagcuccuaccuugcgugguaucagcagaaaccggggcaggcuccccgccugcucauuuacgacgccucuaacagagccaccggaaucccugcucgguucagcggcuccgggagcggaacagauuuuacccugacaauuucuucccuugagcccgaagacuucgccguuuauuacugucaccaauauggcagcaccccucugacauuugggggaggcaccaaagcugagaucaagcgcacgguggccgcgcccucuguguucauuuuuccuccguccgaugaacagcucaaaagcggcaccgccucugucgugugccugcugaauaacuucuaccccagagaggcuaagguucaguggaaaguggacaaugcccuccaguccgggaacagccaagaguccgucacagaacaggauucuaaggacagcaccuauucccugagcucuacacuuacccuguccaaggcugauuacgagaaacauaagguguacgccugugaaguuacgcaccagggacucagcucuccugugacaaagagcuuuaaucggggcgagugc

SEQ ID NO: 38812 - RNA, 396 nt, Artificial Sequence
  derived and/or modified sequence opt5 from Neliximab_HeavyChain_VH-Region
gaggugcagcugcaacagagcggccccgaacucgucaagccuggggccuccguuaagaugucuugcaaggcuagcggauacaccuucacaacguaugugaugcacugggugaaacagaagccgggccaggggcuggaguggaucggauacauuaaccccuauaaugacggcaccaacuacaaugaaaaauuuaaggggaaggccacacuuaccuccgauaaaucuagcuccacagcguauauggagcugucuacccucacaagcgaagacuccgcugucuacuauugugccgaguucaucaccaagacggugggaggcagcaacugguaccuggauguuuggggcgccgggaccacagugaccgucucuuccgcuaaaacaaccccucccaaacuu

SEQ ID NO: 38813 - RNA, 372 nt, Artificial Sequence
  derived and/or modified sequence opt5 from Neliximab_HeavyChain_VH-Region_variant1
caggugcaacugaagcagagcggccccgaacucgucaaaccuggggccuccguuaagaugucuugcaaagcuagcggauacaccuucacaacguaugugaugcacugggugaagcagaaaccgggccaggggcuggaauggaucggauacauuaaccccuauaaugacggcaccaacuacaaugagaaguuuaaggggaaagccacacuuaccuccgauaagucuagcuccacagcguauauggaacugucuacccucacaagcgaggacuccgcugucuacuauugugccgaguucaucaccaaaacggugggaggcagcaacugguaccuggauguuuggggcgccgggaccacagugaccgucucuucc

SEQ ID NO: 38814 - RNA, 318 nt, Artificial Sequence
  derived and/or modified sequence opt5 from Neliximab_LightChain_VL-Region
gacaucgugcugacccagagccccgccauuauguccgcuucuccuggcgagaaggucacaaugacgugcagcgccuccucuagcaucuccuacauucacugguuccaacagaaaccggggaccucucccaagcgcuggaucuaugauacaagcaaacucccuuccggaguucccgcgcgguuuagcggcucuggguccggaaccagcuacucucugacaauuuccagcauggaagcugaggacgccgccaccuauuacugucaucagagaucuuccuauacauggaccuucggcgggggaacgaaacuugaaaucaag

SEQ ID NO: 38815 - RNA, 354 nt, Artificial Sequence
  derived and/or modified sequence opt5 from Neliximab_LightChain_VL-Region_variant1
cagaucgugcugacccaaagccccgccauuauguccgcuucuccuggcgagaaggucacaaugacgugcagcgccuccucuagcaucuccuacauucacugguuccagcagaaaccggggaccucucccaagagauggaucuaugacacaagcaaacucccuuccggaguucccgcgcgguuuagcggcucuggguccggaaccagcuacucucugacaauuuccagcauggaagcugaggaugccgccaccuauuacugucaucagagaucuuccuauacauggaccuucggcgggggaacgaaacuugaaaucaagcgcgcugacgccgcuccuaccgugagcgccgcggcc

SEQ ID NO: 38816 - RNA, 1335 nt, Artificial Sequence
  derived and/or modified sequence opt5 from Nemolizumab_HeavyChain1
caggugcaacugguccagagcggcgcugagguuaagaaacccggggcuuccgugaaggugucuugcaaagccagcggauacaccuucacaggcuauaucaugaacugggucagacaggcgccugggcagggacucgaauggaugggccugauuaauccguacaacgggggaacggacuauaauccccaauuucaggaucgggugaccaucacagcugacaaguccaccucuacagccuacauggagcuuagcucccugcgcucugaagauaccgccguuuauuacugugcuagagacggcuaugaugacggcccuuacacacucgagaccugggggcagggaacgcuggugaccgucagcuccgccagcacaaaaggccccucuguguucccucuugcucccuccagcaagucuaccuccgggggaacagccgcgcugggcugccucguuaaggauuacuuuccugaaccggugaccgucagcuggaacucuggggcccugacguccggagugcacacauuccccgcugugcugcagagcuccggccucuauucucugagcuccgucguuaccgugccuagcucuaauuuuggcacacaaaccuacaccuguaacguggaccauaaacccuccaauacaaaggucgauaaaacgguggagcgcaagagcugcguugaguguccucccugcccggccccucccguggcugggccuucugucuuccuuuuuccgcccaaaccuaaggacacccugaugauuagccggacaccggaagugaccuguguuguggucgaugugucccaggaggaccccgaaguccaguucaacugguauguggauggaguugaggugcacaaugccaagacaaaaccuagagaggaacaguuuaacucuaccuuccgggucgugagcguucucacggugguccaucaagacuggcugaauggcaaggaguacaaaugcaagguguccaacaaagggcuucccgcgccuaucgaaaagacaauuagcaaaaccaagggacagccccgcgagccccagguguauacccugccucccucucaagaagagaugacaaagaaucagguuucccucaccugucuggucaaaggcuuuuacccuagcgacaucgccguggagugggaaucuaacgggcagcccgagaauaacuauaagacaacgccucccaugcuggauuccgacggcagcuucuuucucuacuccaaacugaccguggauaagucuagauggcaggaaggaaacgucuucagcugcuccgugaugcacgaggcccuucauaaucacuacacacaaaaaucucugagccucuccccg

SEQ ID NO: 38817 - RNA, 642 nt, Artificial Sequence
  derived and/or modified sequence opt5 from Nemolizumab_LightChain1
gacauccagaugacccaaagccccuccucucugagcgccuccgugggcgauagagucacaauuacgugccaggcuucugaggacaucuacagcuucguugccugguaucagcagaagccugggaaagcgccgaagcuccugauuuacaacgcucaaaccgaagcccagggagugcccucccgguuuucuggcagcggguccggaacagauuucacccuuacaaucagcucucugcagccugaggacuuugccaccuauuacugucagcaccauuaugauagcccccucacauucggcgggggaaccaaaguggaaauuaagcgcacggucgcugccccuuccguguuuaucuuucccccuucugacgagcaacugaaauccggcaccgcuagcguugugugccuucugaauaacuucuacccgagagaagccaagguccaguggaagguggauaaugcgcuccagucuggcaacucccaggagagcguuacagagcaagacuccaaagauucuaccuauagccuguccagcacacugacccucucuaaggccgacuacgaaaaacacaagguguacgcuugugaggucacgcaucaggggcuguccagccccgugacaaaaucuuucaaucggggagaaugc

SEQ ID NO: 38818 - RNA, 1356 nt, Artificial Sequence
  derived and/or modified sequence opt5 from Nesvacumab_HeavyChain1
gaggugcagcuggucgaaagcggcgggggacucguucagcccggcgggucccugagacuuucuugcgccgcuagcggauucaccuuuuccucuuacgacauccacugggugcggcaggccacaggcaaggggcuggagugggugagcgcgauuggaccugcuggcgauacguauuacccgggcuccgucaaagggcgcuucaccaucucuagagaaaacgccaagaauagccucuaucugcagaugaacucccuucgggccggagacacagcuguguacuauugugcccgcggccugauuaccuuugggggacucaucgcucccuucgauuacuggggccaggggacacugguuaccgugagcucugccuccacaaaaggaccuagcgucuuuccccuggcgccuucuuccaagagcaccucuggcggcacggccgcucucgggugccuggugaaagacuauuuccccgagccuguuaccguguccuggaauagcggagcccuuacauccggcguccauaccuuuccggcugugcugcaaucuagcgggcucuacucccugagcucuguggucacaguucccuccagcucucuuggaacccagacguacauuuguaacgugaaucacaagccuagcaacacaaagguggauaaaaaggucgaacccaaauccugcgacaagacccauacauguccucccugcccggccccugagcugcucggcgggcccucuguguuccuguuuccucccaaacccaaggauacccugaugaucagcagaaccccugagguuacauguguggucguggacguuucccacgaagauccggaggugaaguucaauugguaugucgacggaguggaaguccauaacgcgaaaacgaagccccgggaggagcaguacaauagcaccuaucgcgugguuucugugcucacaguccugcaccaggauuggcuuaacggcaaagaauacaagugcaaaguguccaauaaggcccugccugcucccaucgagaaaaccauuagcaaggccaagggccaaccuagagaaccccagguuuauacacucccgccuucucgggacgagcugaccaaaaaccaggugucccuuacgugucuggucaagggguuuuaccccagcgauaucgcuguggaaugggaguccaauggacagccugagaacaauuauaaaacaacacccccugugcucgacucugacggcagcuucuuucuguacuccaagcugaccguugauaaaucucgcuggcaacaggggaacgucuucagcugcuccgugaugcacgaagcccuccauaaccacuacacccaaaagagccugucucuuucccccggaaag

SEQ ID NO: 38819 - RNA, 642 nt, Artificial Sequence
  derived and/or modified sequence opt5 from Nesvacumab_LightChain1
gagaucgugcugacccagagccccggcacacucucccugucuccuggggaaagagccacgcuuagcugccgggcuucccaaucugucagcuccaccuaccuggccugguaucagcagaaaccgggacaggcgccccgccuccugauuuacggcgcuucuagcagagccacagggaucccugaccgguucuccggaagcggcucugggaccgauuuuacacuuaccauuucccgccuggagcccgaagacuucgccguuuauuacugucaacacuaugauaacagccagacauuuggacagggcaccaaaguggagaucaagagaacgguggcugccccuucugucuucauuuuucccccuuccgacgaacagcucaaaagcggcaccgcuucugugguuugccugcugaauaacuucuacccgcgggaggccaaggugcaauggaaagucgauaaugcgcuccaguccgggaacagccaggaguccgugacagaacaggacucuaaggauagcaccuauucccugagcucuacacuuacccuguccaaggccgacuacgagaaacauaagguuuacgcuugugaagugacgcaccaaggacucagcucucccgucacaaagagcuuuaaucgcggcgagugc

SEQ ID NO: 38820 - RNA, 1362 nt, Artificial Sequence
  derived and/or modified sequence opt5 from Neuradiab_HeavyChain1
gaggugcagcugcaacagagcggccccgaacucgucaagccuggggccuccguuaaaaugucuugcaaggcuagcggauacaccuucacauccuauguggugcacugggucaaacagaacccgggccaggggcuggaguggaucggauacauuaaucccuuuaacgacggcacgaaguauaaugaaaacuucaaauguaaggccacccuuacaucugauagaagcuccucuaccgcguacauggagcugagcucccucacaagcgaagagucugcuguguauuuuugcgcccgggacauggggcgcgagggauucgccuacuggggccaaggcacccugguuacaguguccgcugccaagaccacgccucccagcgucuauccucuugcucccggguguggagauaccacagggucuuccgugacccugggcugccucguuaaaggauacuuuccugaaagcgugacagucaccuggaacucuggcucccugagcuccucugugcauacguucccggcccugcuccagagcgggcuguacacaauguccagcucugugaccguccccuccagcacauggccuucucagaucguuauuuguagcguggcgcaccccgccuccucuaccaccguggacaagaaacuugagccuagcggacccaucuccacaauuaauccgugcccucccuguaaggaaugccauaaauguccugcucccaaucuggagggcggccccagcgucuuuaucuucccuccgaacaucaaggaugugcucaugauuucucugacgcccaagguuaccugcguggucguggacguuuccgaggaugacccugaugugcagaucagcugguuugucaauaacguggaaguccacacagcccaaacccagacacauagagaggacuauaauucuaccauucgggugguuuccacgcuucccauccagcaccaggauuggaugagcgggaaagaguucaaguguaaagugaacaauaaggaccugccuucccccauugaacgcacaaucucuaaaauuaagggacucgucagagcuccgcaaguguacauccugccucccccugccgaacagcugagccggaaagauguuucccugaccugccucguggucggcuuuaaccccggggacaucucuguggaguggaccagcaauggacacacagaggaaaacuauaaggacaccgcgccugugcuugauuccgacggcagcuacuucauuuauucuaagcugaacaugaaaacauccaagugggagaaaacggauagcuuuucuugcaauguucgccaugaagggcucaagaacuacuaucugaaaaagaccaucuccagaagccccggaaag

SEQ ID NO: 38821 - RNA, 657 nt, Artificial Sequence
  derived and/or modified sequence opt5 from Neuradiab_LightChain1
gacaucgugaugacccaggccgcuuucagcaaccccgucacacugggcacguccgccucuauuagcugcagauccucuaagagccuccugcacuccaaugggaucaccuaccuuuauugguaccugcaaaaaccuggacagucuccgcagcuccugauuuaucagaugagcaaccuugcguccggcguucccgaucgguuuucuagcuccgggagcggaacagacuucacccugcgcaucucuagaguggaggcugaagaugugggcgucuacuauugugcccaaaaucucgagcugccucggacauuugggggaggcaccaagcuggaaauuaaacgcgccgacgcugcccccacaguguccaucuucccucccagcucugagcagcucaccuccggcggggcuagcguugugugcuuucugaacaauuucuacccuaaggauaucaacgucaaauggaagauugacggauccgaaagacagaauggcgugcuuaacucuuggacggaucaggacagcaaggauuccaccuauagcaugucuuccacacugacccucacaaaagacgaguacgagcggcauaauagcuacaccugugaagccacgcacaagacaucuaccagcccgaucguuaaauccuuuaaccgcaaugagugc

SEQ ID NO: 38822 - RNA, 369 nt, Artificial Sequence
  derived and/or modified sequence opt5 from Nimotuzumab_HeavyChain1
caggugcaacugcagcagagcggcgccgaggucaagaaacccggguccucuguuaaggugagcugcaaggcuuccggauacaccuucacaaacuauuacaucuauugggugagacaggccccuggccaagggcucgaauggauuggaggcaucaauccgacgucugggggaagcaacuuuaaugagaaauucaaaacccgggucacaauuaccguggacgaauccacaaacaccgcguacauggagcugucuagccuucgcuccgaagauacagcuuuuuauuucugugccagacagggccugugguuugacagcgauggccggggguucgacuuuuggggacagggcucuaccguuacgguguccagc

SEQ ID NO: 38823 - RNA, 342 nt, Artificial Sequence
  derived and/or modified sequence opt5 from Nimotuzumab_LightChain1
gacauccagaugacccaaagccccuccucucugagcgccuccgugggcgauagagucacaauuacgugccggucuagccagaacaucguucacuccaaugggaacaccuaccucgacugguaucagcagacaccuggaaaggcuccgaaacugcuuauuuacaaggugucuaaucgcuucagcggcgugcccuccagauuuagcgggucuggauccggcaccgauuucacauuuaccaucagcucucugcaaccugaggacauugccacauauuacuguuuccaguauucccauguccccuggaccuuugggcagggaacgaaacuccagaucacccgggaa

SEQ ID NO: 38824 - RNA, 1320 nt, Artificial Sequence
  derived and/or modified sequence opt5 from Nivolumab_HeavyChain1
caggugcaacuggucgagagcggcgggggaguugugcagcccggcagaucccuccggcuggacugcaaggccucugggaucaccuucagcaacuccggaaugcacugggugcgccaggcuccuggcaaagggcuugaaugggucgccgugauuugguacgauggaucuaagagauauuacgcggacagcguuaaaggccgguuuacaaucucccgcgauaauucuaagaacacgcuguuccuccagaugaauagccugagagcugaggacaccgccguguauuacugugccacaaacgaugacuauuggggccaagggacccuugucacaguguccagcgcuucuaccaaaggaccguccguuuuuccccuggccccuugcagccggucuacauccgaaagcaccgcugcccucggcugucuggugaaggauuacuuccccgagccugucacggugucuuggaacuccggggcgcugaccagcggagugcauacauuucccgccguccuccaguccucuggccuguauagccuuuccagcguugugaccgugccuucuuccagccuggggacaaagaccuacacgugcaaugucgaccacaaaccgucuaauacaaagguggauaaacgcguugaaagcaaguacggacccccuugucccccuugccccgcuccggaguuccucggcggcccuuccguguuucuguuucccccuaaacccaaggacacccuuaugauuucuagaacacccgaggucaccugugugguuguggaugucagccaggaagacccugaggugcaguucaacugguaugucgaugggguggaaguucauaaugccaagaccaaaccgcgggaggagcaauucaacuccacauaccgcguggucagcgugcugacgguucuccaccaggacuggcugaauggaaaggaauauaaaugcaaggugucuaacaaaggccugcccuccagcaucgagaagaccauuucuaaagcuaaggggcagccuagagaaccccaggucuacacacucccucccucccaagaggaaaugaccaagaaucaggugagccugacaugucuugugaaaggauuuuauccguccgacaucgccguugagugggagucuaacggccagccugaaaauaacuacaagaccacgcccccuguccuggauagcgacggguccuucuuucucuauucucggcugacaguggauaaaagccgcuggcaagagggaaacguguucuccugcagcgucaugcaugaagcgcuucacaaucacuacacccagaagucucugucccucagccugggcaaa

SEQ ID NO: 38825 - RNA, 642 nt, Artificial Sequence
  derived and/or modified sequence opt5 from Nivolumab_LightChain1
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagagcucuaauuggccucgcaccuuuggccaggggacaaaaguggagaucaagagaaccguggcugcccccuccgucuucauuuuuccuccgagcgaugaacagcucaaaucuggaacggcguccgugguuugccugcugaacaauuucuauccccgggaggccaaggugcaauggaaagucgacaacgcucuccagagcggcaauucccaggagucugugaccgaacaggauagcaaggacuccacauacagccugucuuccacccuuacacugagcaaggccgauuaugagaaacacaagguuuacgcuugugaagugacccaucaaggccucucuagcccugucacgaaauccuuuaaccgcggggagugc

SEQ ID NO: 38826 - RNA, 1347 nt, Artificial Sequence
  derived and/or modified sequence opt5 from Obiltoxaximab_HeavyChain1
caggugcagcugcagcagagcggccccgagcucaagaaaccuggggccuccgucaagguuucuugcaaagacagcggauacgcuuucuccucuagcuggaugaacugggugagacaggccccgggccaagggcuggaauggaucggacggauuuaucccggcgauggggacaccaauuacaacggaaaguuucagggccgcgugacaaucacggcggauaaauccucuagcaccgcuuauauggagcuuuccagccugagaucugaagacacagccgucuacuucugugcccgguccggccuccugcgcuaugcuauggauuacugggggcagggaacccuugugacaguuagcucugccuccaccaagggcccuagcguguuuccccuggcuccuucuuccaagagcacauccgggggaaccgccgcgcucggcugccuggucaaagacuauuuccccgagccugugacgguuucuuggaauagcggggcccugaccuccggagugcacacauuuccggcuguccuccagagcucuggccuguacucccuuagcucuguggugaccguccccagcuccucucugggcacacaaaccuacauuuguaacguuaaucauaagccuagcaacacgaaaguggauaagaaaguggaacccaaguccugcgacaagacacacaccuguccucccugcccggccccugagcuccugggaggacccagcgucuuccuuuuuccucccaaacccaaggauacacugaugaucucuagaaccccugaggugaccuguguuguggucgacgugucccaugaagauccggagguuaaauucaauugguauguggacggcgucgaagugcacaacgcuaagacaaaaccccgggaggagcaguacaauagcacguaucgcgucgugucuguucucaccgugcugcaucaggauuggcugaacgggaaggaauacaaaugcaaggucuccaauaaggcccucccugcgcccauugagaaaacaaucagcaaggccaaaggacagccuagagaaccccaaguguauacccugccgccuucccgggacgagcuuacaaagaaccagguuucucugaccugucucgugaaaggcuuuuaccccagcgacaucgcugucgaaugggaguccaaugggcagccugagaacaauuauaagacgacacccccugugcuggauucugacgggagcuucuuucuuuacuccaagcugaccguggauaaaagccgcuggcaacagggcaacguuuucucuugcuccgucaugcacgaagcccuccacaaccauuacacccaaaagagccugucucugucccccggcaaa

SEQ ID NO: 38827 - RNA, 642 nt, Artificial Sequence
  derived and/or modified sequence opt5 from Obiltoxaximab_LightChain1
gacauccagaugacccaaagccccuccucucugagcgccuccgugggcgauagagucacaauuacgugccgggcuucucaggacauccgcaacuaccucaauugguaucagcagaagccugggaaagccguuaagcugcuuauuuacuauaccagcagacugcucccgggagugcccucccgguucucuggcagcggguccggaacagauuacagccugaccaucucuucccaagagcaggaagacauuggcacauauuuuugucagcaggggaacacccuuccuuggacauucggacaaggcaccaaaguggagauccgcagaacggucgcggcucccagcguguuuaucuucccucccucugaugaacagcugaaguccggcaccgccagcguugugugccuccugaauaacuuuuacccucgggaggccaaaguccaguggaagguggacaaugcucugcagucugggaacucccaagaaagcguuacagagcaggauuccaaggacucuaccuauagccucuccagcacacugacccuuucuaaagccgauuacgagaagcacaaaguguacgcuugugaagucacgcaucagggacuguccagcccggugacaaagucuuucaaucgcggcgagugc

SEQ ID NO: 38828 - RNA, 1347 nt, Artificial Sequence; identical to SEQ ID NO: 38232
  derived and/or modified sequence opt5 from Obinutuzumab_HeavyChain1

SEQ ID NO: 38829 - RNA, 657 nt, Artificial Sequence; identical to SEQ ID NO: 38233
  derived and/or modified sequence opt5 from Obinutuzumab_LightChain1

SEQ ID NO: 38830 - RNA, 1350 nt, Artificial Sequence
  derived and/or modified sequence opt5 from Ocaratuzumab_HeavyChain1
gaggugcagcugguccagagcggcgccgaaguuaagaaacccggggagucccucaagaucucuugcaaaggaagcggcagaaccuucacauccuacaacaugcacugggugcggcagaugccugggaagggacuggaauggaugggcgcuauuuauccgcuuacgggggacaccucuuacaaucagaaaagcaagcuccaggugacaaucuccgccgauaagucuauuagcaccgcguaucugcaaugguccagccugaaggcuucugacacagccauguacuauugugcccgcuccaccuacgucggaggcgauuggcaguuugacguguggggcaaggggacaaccguuacggugagcucugcuuccaccaaaggacccagcgucuucccucuugcccccucuuccaagagcacauccggcgggaccgcugcccugggaugccucgugaaagauuauuuuccugagcccguuacagugucuuggaacagcggcgcgcugaccuccgggguccauacguucccugccgugcugcagagcucuggacucuacucccugagcucuguggucacaguuccgagcuccucucuuggcacccagacauacaucuguaaugugaaccacaagcccagcaauaccaagguggacaaaaaggucgaaccuaaauccugcgauaagacccauacaugucccccuugccccgcuccggagcugcucggcgggccuagcguguuucuguuucccccuaaaauuaaggacacgcuuaugaucucuagaacccccgagguuacauguguggucguggauguuucccacgaagaccccgaggugaaauucaacugguaugucgauggaguggaaguccauaaugccaagaccaagccucgggaggagcaauacaacagcacauaucgcgugguuucugugcugaccguccuccaccaggacuggcugaauggcaaagaauacaagugcaaaguguccaacaaggcucugccggcccccaucgagaaaacgauuagcaagcagaaggggcagccuagagaaccccaaguuuauacacucccucccucccgggaugagcugaccaaaaaucaggugucucuuaccugucuggucaagggauucuacccgagcgacaucgcgguggaaugggaguccaacggccagccugagaauaacuauaaaacaacacccccugugcucgacucugaugggagcuuuuuccuguacuccaaacuuaccguugacaaaagccgcuggcaacagggaaaugucuuuucuugcuccgugaugcacgaagcccugcauaaccacuacacgcaaaagagccucucucugucccccggc

SEQ ID NO: 38831 - RNA, 639 nt, Artificial Sequence
  derived and/or modified sequence opt5 from Ocaratuzumab_LightChain1
gagaucgugcugacccagagccccggcacacucucccugucuccuggggaaagagccacgcuuagcugccgggcuuccucuagcgucccguacauucacugguaucaacagaagcccggacaggccccucgccugcucaucuacgcgaccuccgcucuggccucuggcauucccgacagauucagcggguccggaagcggcacagauuuuacccuuacaaucucucggcuggagccugaagacuucgccguuuauuacugucagcaauggcucuccaaucccccuaccuuugggcagggaacaaaacuggagauuaagcgcaccguggcugccccgagcguguucaucuuucccccuucugaugaacagcugaaauccggcacggcuagcgucgugugccuccugaacaacuucuaucccagagaggccaagguucaguggaaaguggacaaugcgcuucaaucuggcaacucccaggagagcgucaccgaacaggauuccaaggacucuacauacagccuguccagcacccucacacugucuaaggccgauuaugagaaacauaagguguacgcuugugaaguuacccaccaggggcuuuccagcccugugacgaaaucuuuuaaucggggagagugc

SEQ ID NO: 38832 - RNA, 1356 nt, Artificial Sequence
  derived and/or modified sequence opt5 from Ocrelizumab_HeavyChain1
gaggugcaacuggucgaaagcggcgggggacucguucaacccggcgggucccugagacuuucuugcgccgcuagcggauacaccuucacauccuauaacaugcacugggugcggcaggccccuggcaaggggcuggagugggugggagcgaucuacccgggcaauggcgacacgucuuauaaccagaaauuuaaggggcgcuucaccauuagcgucgauaaauccaagaauacacucuaccugcagaugaacucucuuagagcugaagacaccgccguguauuacugugcccggguuguguauuacagcaauuccuacugguauuuugaugucuggggacaaggcacacuggugaccguuagcucugcuuccacaaaagggcccagcguguucccucucgcccccucuuccaagagcaccucuggaggcacggcugcccuggggugccuggucaaggacuacuuuccugagcccgugaccguguccuggaacagcggagcgcucacauccggcguccauaccuucccugccguucugcagucuagcggccuuuauucccugagcucuguggugacagucccguccagcucucucgggacccagacguacaucuguaaugugaaccacaaacccagcaauacaaagguugauaaaaagguggaaccuaaauccugcgacaagacccauacaugucccccuugccccgcuccggagcugcuuggaggcccuucugucuuucuguuucccccuaagcccaaagauacccucaugauuagccgcacccccgaggugacauguguuguggucgacgugucccacgaagauccugaggucaaguucaacugguauguggacgggguugaagugcauaaugccaaaacgaagccgagagaggagcaguacaacagcaccuaucgggucgugucuguucugacagugcugcaccaagauuggcucaauggaaaagaauacaagugcaaagucuccaacaaggcucugcccgccccuaucgagaagaccauuagcaaagcgaagggccagccccgcgaaccucagguguacacacuucccccgucuagagaggaaaugaccaaaaaucaggugucccugacgugucucguuaagggguucuauccuagcgacaucgccgucgagugggaguccaacggacaacccgaaaacaauuacaaaacaaccccucccgugcuggauucugacggcagcuuuuuccuuuauuccaagcugaccguggacaagucucgguggcagcagggcaacgucuuuagcugcuccgugaugcacgaggcucuccauaaucacuacacacagaaaagccugucucuguccccugggaag

SEQ ID NO: 38833 - RNA, 639 nt, Artificial Sequence
  derived and/or modified sequence opt5 from Ocrelizumab_LightChain1
gacauccagaugacccaaagccccagcucucugagcgccuccgugggcgauagagucacaauuacgugccgggcuucuagcuccguuucuuacaugcacugguaucagcagaagccugggaaagccccgaagccccucaucuacgcgccuagcaaccuggcuuccggagugcccagccgcuucucuggcuccgggagcggaaccgacuuuacacuuaccauuucuucccugcagccugaggauuucgccacauauuacugucaacaguggagcuuuaaucccccuaccuucggccaggggacaaaaguggaaaucaagagaaccgucgccgcuccgucuguguuuauuuuucccccuuccgacgagcagcucaaaagcggaacggccuccguugugugccugcuuaacaauuucuauccccgggaagcuaagguccaauggaagguggauaacgcccugcagucuggcaauagccaggaguccguuaccgaacaggacagcaaagauucuacauacucccucagcucuacccugacacugagcaaggcggacuaugagaaacauaagguguacgccugugaggucacccaccaaggccucuccucuccugugacgaaauccuucaaccgcggggaaugc

SEQ ID NO: 38834 - RNA, 1356 nt, Artificial Sequence
  derived and/or modified sequence opt5 from Ofatumumab_HeavyChain1
gaggugcagcuggucgaaagcggcgggggacucguucaacccggcagaucccugcggcuuucuugcgccgcuagcggguucaccuuuaacgacuacgccaugcacugggugcgccaggcgccuggaaagggccuggaguggguguccacaaucucuuggaauagcggguccauuggauaugcugauucugucaaaggcagauucacgaucagccgggacaacgccaagaaaucccucuaccugcagaugaauagccuucgcgccgaagauaccgcucuguauuacugugccaaggacauucaguauggcaacuacuauuacgggauggauguguggggacaaggcacaaccguuacagugucuuccgcuagcaccaaagggccgucugucuuuccccucgccccuuccagcaagucuacauccggaggcaccgcggcccuggggugccuggugaaggacuacuuccccgagccuguuacggugagcuggaacuccggagcucucaccucuggcguccauacauuucccgccgugcugcagagcuccggccuuuauagccugucuuccguggucaccguuccuagcucuagccucgggacacagaccuacaucuguaaugugaaucacaaaccguccaacacgaagguggauaaaagagucgaacccaagucuugcgacaaaacacauaccuguccucccugcccugcucccgagcugcuuggaggcccgagcguguuccuguuuccucccaagccuaaggauacacucaugauuucccggacccccgagguuaccuguguggucguggacguuagccacgaagaucccgaggugaaauucaauugguaugucgacgggguggaaguccauaacgccaagacaaaaccucgcgaggagcaguacaauucuacguauagagugguuuccgugcugaccguccugcaccaagauuggcucaacggaaaggaauacaaaugcaaggugagcaauaaagcgcugccggcccccaucgagaagacaaucucuaaggcuaaaggccagccucgggaaccccagguuuauacccuuccucccucccgcgaggaaaugacaaagaaccaggugagccugaccugucucgucaaaggguuuuacccguccgacauugccguggagugggagucuaauggacaaccugaaaacaacuacaagacgacacccccugugcuggacagcgauggcuccuucuuucuuuauucuaaacugaccguugacaagagcagauggcagcagggcaaugucuucuccugcagcgugaugcacgaggcucuccauaaccacuacacccaaaagucucugucccugagccccgggaaa

SEQ ID NO: 38835 - RNA, 642 nt, Artificial Sequence
  derived and/or modified sequence opt5 from Ofatumumab_LightChain1
gagaucgugcugacgcagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccuaucaccuuuggccaggggacaagacucgagauuaaacggaccguggcugcccccucuguguucaucuuuccuccguccgaugaacagcucaagagcggaacggcgucugucgugugccugcugaacaauuucuauccccgcgaggccaaaguucaauggaagguggacaacgcucugcaguccggcaauagccaggaguccgucaccgaacaggauucuaaagacagcacauacucccuuagcucuacccugacacucuccaaggccgauuaugagaagcacaaaguguacgcuugugaaguuacccaucaaggccugagcucuccugugaccaagagcuuuaacagaggggagugc

SEQ ID NO: 38836 - RNA, 1371 nt, Artificial Sequence
  derived and/or modified sequence opt5 from Olaratumab_HeavyChain1
cagcugcaacuccaggagagcggccccgggcuggugaagccuuccgaaacccuuucucugacaugcacggucagcggaggcuccaucaacucuagcuccuacuauuggggguggcucagacagucuccgggaaaaggccuggaguggauugggagcuucuuuuacaccggauccacauauuacaaucccagccuucggucucgccugaccaucuccguugacacaagcaagaaccaguucucucucaugcuguccagcgugaccgccgcugauacagccguguauuacugugcgagacaaucuaccuauuacuacggcuccggcaauuauuacgggugguuugaccggugggaucagggaacgcuggucaccgugagcuccgcuucuacaaaaggcccuagcguuuucccccucgccccuuccagcaagucuaccuccgggggaacagccgcucugggcugccuugugaaagacuauuuucccgaaccugucaccgugagcuggaacucuggggcccugacgagcggaguucacacauucccggcugugcuccaguccucuggccuguacagccuuuccagcgucgugaccgugcccucuuccagccugggcacacagaccuauauuuguaaugucaaccauaagccuucuaauaccaagguugauaaacgcguggagcccaaguccugcgacaaaacacacacguguccucccugcccggccccugaacuccucgggggacccagcguguuucuguucccucccaagcccaaagauacccugaugaucuccagaacaccugaggucaccugugugguuguggacgucucucaugaggauccggaagugaaguuuaacugguacguugacggcguggagguccacaaugcgaagacaaaaccccgggaggaacaauauaacagcaccuaccgcguggucuccgugcugacgguucuucaucaggauuggcugaaugggaaggaguacaaaugcaaggugucuaacaaagcccucccugcucccauugaaaagacaaucagcaaagccaagggacagccuagagagccccaggucuauacccugccgccuucccgggaagagaugaccaagaaucaagugagccuuacaugucugguuaaaggcuucuaccccucugacaucgcuguggaaugggaguccaacgggcagccugagaauaacuauaagaccacacccccuguccucgauagcgacggauccuuuuuccuguacucuaaacugacgguggacaagagccgcuggcagcaaggcaacguguuuucuugcagcguuaugcacgaagcccuccacaaucauuauacccagaaaucccugagccuuucucccggcaag

SEQ ID NO: 38837 - RNA, 642 nt, Artificial Sequence
  derived and/or modified sequence opt5 from Olaratumab_LightChain1
gagaucgugcugacccagagccccgccacacucucccugucuccuggcgaaagagcuacgcuuagcugccgggccucccaaucugucagcuccuaccuggcgugguaucagcagaaaccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccucccgcuuuuggccaggggaccaaaguggagaucaagagaacaguggccgcgccuucugucuucauuuuuccgcccuccgaugaacagcucaaaagcggaaccgccucugugguuugccugcugaacaauuucuauccucgggaggcuaaggugcaauggaaagucgacaacgcccuccaguccggcaauagccaggaguccgugacggaacaggauucuaaggacagcaccuacucccugagcucuacacuuacccuguccaaggcugauuaugagaaacacaagguuuacgccugugaagugacacaucaaggccucagcucucccgucaccaagagcuuuaaccgcggggagugc

SEQ ID NO: 38838 - RNA, 1341 nt, Artificial Sequence
  derived and/or modified sequence opt5 from Olizuab_HeavyChain1
gaggugcagcuggucgaaagcggcgggggacucguucagcccggcgggucccugagacuuucuugcgccgugagcggauacuccaucaccucuggcuauagcuggaacuggauucggcaggcuccugggaagggacuggaguggguggccuccaucacauacgacggcucuacgaauuauaacccgagcgucaaaggccgcauuaccaucuccagagaugacagcaagaauacauucuaccuccagaacucucugcgggcggaagauaccgcuguguauuacugugcccgcgggucccacuauuuuggacauuggcacuucgccguuuggggccaggggacacuugugaccgucagcucugcuuccacaaaaggacccagcguguuuccucuggcccccucuuccaagagcaccuccggcgggacggcugcccucggaugccugguuaaagacuacuucccugagcccgugaccgucucuuggaauagcggcgcgcugacauccggcgugcauaccuuuccugccgugcuccaaagcucugggcuguacucccuuagcucugucguuacagugccgagcuccucucugggaacccagacguauauuuguaacgugaaucacaagcccagcaacacaaaggucgauaaaaagguggaaccuaaauccugcgacaagacccauacaugucccccuugccccgcuccggagcuccugggcgggccuagcguuuuccuuuuucccccuaaacccaaggauacccugaucucuagaacccccgaggugacaugugucgugguugacgugucccacgaagauccugaggucaaguucaauugguacguggacggagucgaagugcacaacgccaaaacgaagccgcgggaggagcaguauaauagcaccuaccgcguugugucuguccucacagugcugcaucaggauuggcugaacggcaaagaauauaagugcaaaguuuccaauaaggcucuccccgccccuaucgagaaaaccauuagcaaggcgaaggggcaacccagagaaccucagguguacacacugcccccgucccgggaggaaaccaaaaaccaggucucucuuacgugucuggugaagggauuuuauccuagcgacaucgccguggagugggaguccaauggccagcccgaaaacaacuacaaaacaaccccucccguucucgauucugacggcagcuucuuucuguacuccaaacuuaccgucgacaagagccgcuggcaacaggggaauguguucucuugcuccgugcacgaggcucugcauaaccacuauacacaaaagagccucucucuguccccuggaaag

SEQ ID NO: 38839 - RNA, 651 nt, Artificial Sequence
  derived and/or modified sequence opt5 from Olizuab_LightChain1
gacauccagcugacccaaagccccuccucucucagcgccuccgugggcgauagagucacaauuacgugccgggcuucucagagcguugacuacgauggggacuccuauaacugguaccagcagaagccuggaaaagccccgaagcugcuuaucuaugcggcuucuuaccuggagagcggcgugcccucccgcuucagcgggucuggauccggcaccgauuuuacacucaccauuagcucucugcaaccugaagacuucgccacauauuacugucagcagucccacgaggaucccuauaccuuugggcagggaacaaaaguggaaaucaagagaaccgucgccgcuccuagcguguucauuuuucccccuucugacgagcaacuuaaauccggcacggccagcguugugugccugcucaauaacuucuacccgcgggaagcuaagguccaguggaagguggauaaugcccugcaguccggcaacucucaggagagcguuaccgagcaagacuccaaagauagcacauacucucuguccagcacccucacacugucuaaggcggacuaugaaaaacauaagguguacgccugugaggucacccaccaggggcuuagcucccccgugacgaaaucuuuuaaucgcggagaaugc

SEQ ID NO: 38840 - RNA, 1341 nt, Artificial Sequence
  derived and/or modified sequence opt5 from Olokizumab_HeavyChain1
gaggugcagcuggucgaaagcggcgggggacucguucaacccggcgggucccugagacuuucuugcgccgcuagcggauucaacuuuaaugacuacuucaugaacugggugcggcaggccccuggcaaggggcuggaguggguggcgcagaugcgcaauaaaaacuaucaguacggaaccuauuacgcugaaucccucgagggcagauuuacaaucucucgggaugacagcaaaaauucccuguaucuucaaaugaacucucugaagacggaagauaccgccgucuacuauugugcccgcgagagcuacuacggcuucacauccuauugggggcagggaacccucgugacaguuagcucugcuuccaccaagggcccgagcguguuuccccuggccccuugcucuagauccacaagcgagucuaccgcugcccuggggugucucgucaaagacuacuuccccgaaccugugacgguuuccuggaauagcggagcgcugaccuccggcgugcacacauuucccgccguccuucagucuagcgggcuguauucccucagcucuguggugaccgucccuuccagcucucugggaacaaagaccuacacgugcaacguugaucauaagccgagcaauacaaaaguggacaagcggguggaguccaaauaugggcccccuugucccccuugccccgcuccggaguuccuuggcggcccuucugucuuucuguuucccccuaagcccaaagauacccucaugauuagccgcacacccgaggugaccuguguuguggucgacgugucccaggaggauccugaaguucaauucaacugguacguggacggagucgaggugcacaaugccaagaccaagccgagagaagaacaguucaacagcacauaucgggucgugucuguucugacggugcugcaucaggauuggcucaauggcaaagaauacaagugcaaagucuccaacaaggggcugcccagcucuaucgagaaaaccauuuccaaggcuaaaggacagccucgcgagccccaaguguacacacuuccucccagccaggaagagaugaccaagaaucagguuucccugacaugucucgugaagggcuuuuauccgucugacaucgccgucgaaugggagagcaacgggcaaccugaaaacaauuacaaaaccacgcccccugugcuggauuccgacggaucuuucuuccuuuauagcagacugacaguggacaagucccgguggcaggagggcaacguuuuuagcugcucugucaugcacgaggcgcuccauaaucacuacacccagaaaucccugagccugucucucggcaag

SEQ ID NO: 38841 - RNA, 642 nt, Artificial Sequence
  derived and/or modified sequence opt5 from Olokizumab_LightChain1
gacauccagaugacccaaagccccagcucucugagcgccuccgugggcgauagagucacaauuacgugccaggcuucucaggacaucgggauuagccucuccugguaccagcaaaagccuggaaaagccccgaagcugcuuaucuauaacgcgaauaaccuggcugauggcguucccucucgguucagcggguccggaagcggcaccgacuuuacacucaccauuucuucccugcagccugaggauuucgccacauacuauugucuucagcacaauagcgcccccuacaccuuugggcagggaacaaaacuggaaaucaagcgcaccguggcugccccuucuguguucaucuuucccccuuccgacgagcaacucaaaagcggcacggcuucugucgugugccugcugaacaauuucuauccgagagaagccaagguucaguggaagguggauaacgcgcuccaguccggcaauagccaggaguccgucaccgaacaagacucuaaagauagcacauacucccugagcucuacccuuacacuguccaaggccgacuaugagaaacauaagguguacgcuugugagguuacccaccaggggcucagcucucccgugacgaaauccuuuaaccggggagaaugc

SEQ ID NO: 38842 - RNA, 1341 nt, Artificial Sequence
  derived and/or modified sequence opt5 from Omalizumab_HeavyChain
gaggugcagcuggucgaaagcggcgggggacucguucaacccggcgggucccugagacuuucuugcgccgugagcggauacuccaucaccucuggcuauagcuggaacuggauucggcaggcuccugggaagggacuggaguggguggccuccaucacauacgacggcucuacgaauuaugcggauagcgucaaaggccgcuucaccauuuccagagacgauagcaagaacacauuuuaccuccagaugaacucucugcgggcugaagacaccgccguguauuacugugcccgcgggucccacuauuucggacauuggcacuuugcuguuuggggccaggggacacuugugaccgucagcucuggaccguccguguucccccuggccccuagcucuaaauccacaagcggcgggaccgcugcccucggaugccugguuaaggauuacuuucccgagccugugacggucuccuggaacucuggcgcgcugaccagcggcgugcauacauuccccgccgugcuccaauccagcgggcuguacucucuuuccagcgucguuaccgugccuucuagcucccugggaacacagaccuauaucuguaaugugaaucacaaaccgucuaauacgaaggucgacaagaaagcugaacccaagagcugcgauaaaacacauaccuguccucccugcccugcccccgagcuccugggcgggccguccguguuucuuuucccucccaagccuaaagacacacugaugauuagcagaacccccgagguuaccuguguggucguggauguuucucacgaagaccccgaggugaaguuuaacugguacgucgauggaguggaaguccacaaugcuaagacaaaaccucgggaggagcaguauaacuccacguaccgcgugguuagcgugcucaccguccugcaucaggacuggcugaauggcaaggaauauaaaugcaaggugucuaacaaagcccucccggcgcccaucgagaagacaaucuccaaagccaaggggcaaccuagagaaccccagguuuacacccugccucccagccgggaugagcuuacaaagaaucaggugucccugaccugucucgucaaaggauucuauccgucugacauugcuguggaaugggagagcaacggccagccugagaauaacuacaagacgacacccccugugcuggacuccgauggcagcuuuuuccuuuacucuaaacugaccguugacaagucccgcuggcaacaggggaacgucuuuagcugcucugugaugcacgaagcccuccauaaucacuauacccagaaaucccugagccugucucccggaaag

SEQ ID NO: 38843 - RNA, 645 nt, Artificial Sequence
  derived and/or modified sequence opt5 from Omalizumab_LightChain
gacauccagcugacccaaagccccuccucucucagcgccuccgugggcgauagagucacaauuacgugccgggcuucucagagcguugacuacgauggggacuccuauaugaacugguaccagcagaagccuggaaaagccccgaagcugcuuaucuaugcggcuucuuaccuggagagcggcgugcccucccgcuucagcgggucuggauccggcaccgauuuuacacucaccauuagcucucugcaaccugaagacuucgccacauauuacugucagcagucccacgaggaucccuauaccuuugggcagggaacaaaaguggaaaucaagagaaccgucgccgcuccuagcguguucauuuuucccccuucugacgagcaacuuaaauccggcacggccagcguugugugccugcucaauaacuucuacccgcgggaagcuaagguccaguggaagguggauaaugcccugcaguccggcaacucucaggagagcguuaccgagcaagacuccaaagauagcacauacucucuguccagcacccucacacugucuaaggcggacuaugaaaaacauaagguguacgccugugaggucacccaccaggggcuuagcucccccgugacgaaaucuuuuaaucgc

SEQ ID NO: 38844 - RNA, 1347 nt, Artificial Sequence
  derived and/or modified sequence opt5 from Onartuzumab_HeavyChain1
gaggugcagcuggucgaaagcggcgggggacucguucaacccggcgggucccugagacuuucuugcgccgcuagcggauacaccuucacauccuauuggcugcacugggugcggcaggccccuggcaaggggcucgagugggugggaaugaucgacccgucuaacagcgauacgcgcuuuaaucccaacuucaaagacagauuuaccauuuccgcggauacaucuaagaauaccgcuuaccugcagaugaacagccuucgggccgaagacacagccgucuauuacugugcuaccuaucgcuccuacgugacaccucuggauuauuggggccagggcacccucguuacggugagcucugccuccaccaaagggcccagcgucuucccucuggcucccucuuccaagagcacaucuggaggcaccgccgcgcuggggugccucgugaaagacuacuuuccugagccgguuacaguguccuggaauagcggagcccugaccuccggcguccauacguuccccgcugugcuucaaucuagcgggcuguacucccucagcucuguggucacaguuccuuccagcucucugggaacccagacauauaucuguaacgugaaucacaagcccagcaacaccaagguggauaaaaaggucgaaccuaaauccugcgacaagacccauacaugucccccgugcccugcccccgagcuucugggcggcccuucuguguuucucuucccucccaaacccaaggauacgcugaugauuagcagaaccccggagguuacauguguggucguggacguuucccacgaagaucccgaggugaaguuuaauugguacgucgacgggguggaaguccauaacgcuaaaaccaagccucgggaggagcaguauaauagcacauaccgcgugguuucugugcugaccguccuccaccaggauuggcugaacggaaaagaauauaagugcaaaguguccaauaaggcccuucccgcgccuaucgagaaaacgauuagcaaggccaagggccaacccagagaaccgcagguuuacacacugccucccucucgggaggaaaugaccaaaaaccaggugucccucagcugugcugucaagggguucuauccuuccgacaucgccguggagugggagucuaauggacagcccgaaaacaacuacaaaaccacaccucccgugcuggacagcgauggcuccuuuuuccuuguuucuaagcugaccgucgacaaaagccgcuggcaacaggggaauguguuuuccugcagcgugaugcacgaggcucuccauaaccacuacacacagaagucucugucccugagcccgggaaag

SEQ ID NO: 38845 - RNA, 681 nt, Artificial Sequence
  derived and/or modified sequence opt5 from Onartuzumab_HeavyChain2
gacaagacccacacaugucccccuugcccggcccccgagcugcucggcgggccuagcguguuccuguuucccccuaaacccaaggauacgcuuaugaucuccagaaccccugaagucacaugcguugugguggacgucucucaugaggauccggaagugaaauucaacugguacguugacggaguggagguccacaaugcuaagaccaaaccccgggaagaacaguauaacagcacauaccgcgugguuuccgugcugaccguccuccaucaggauuggcugaauggcaaggaguauaaguguaaagugucuaacaaggcccuuccugcgcccauugagaaaacaaucagcaaggcuaaagggcagccuagagagccccagguguacacccugccgccuucccgggaagagaugacgaagaaucaggucucucucuggugccugguuaagggauuuuaucccagcgacauugccguggagugggaauccaacggccaaccugagaauaacuacaaaaccacaccucccgugcuggauagcgacgggucuuucuuucucuauuccaagcugaccgucgauaaaagccgcuggcagcagggaaauguguucucuuguuccguuaugcacgaagcccuucauaaccacuacacacaaaagagccugucucucucccccggcaaa

SEQ ID NO: 38846 - RNA, 660 nt, Artificial Sequence
  derived and/or modified sequence opt5 from Onartuzumab_LightChain1
gacauccagaugacccaaagccccuccucucugagcgccuccgugggcgauagagucacaauuacgugcaagucuagccagucccuccuguacaccucuagccagaaaaacuaucuugcuugguaccagcaaaagccugggaaagccccgaagcugcucaucuauugggcguccacacgggagagcggaguucccucucgcuucuccggcagcgggucuggaaccgacuuuacacugaccauuuccagccuucagccugaagauuucgcuacauacuauugucagcaguacuaugccuaccccuggaccuuuggccaagggacgaaaguggagaucaagagaaccguggccgcuccuucugucuucauuuuucccccuuccgacgaacagcucaagagcggaacagccuccgugguuugccugcugaauaacuucuacccgcgggaggcuaaagugcaguggaaggucgauaaugcccugcagucuggcaacagccaagaauccgugaccgagcaggacagcaaagauucuacauauucccucagcucuacccugacgcuuagcaaggcggacuacgagaaacacaagguuuaugccugugaagugacacaucagggccuguccucucccgucaccaagagcuuuaaucgcggggagugc

SEQ ID NO: 38847 - RNA, 1362 nt, Artificial Sequence
  derived and/or modified sequence opt5 from Ontuxizumab_HeavyChain1
caggugcaacugcaggagagcggccccgggcucgucagaccuucccagacccugucucuuacaugcacggccagcggauacaccuucacagacuauguuauccacugggugaagcagccgcccggccgggggcuggaauggauuggauacaucaacccuuaugaugacgauaccacauacaaucaaaaauuuaagggccgcgugaccaugcucgucgacacauccucuaacaccgcuuaucugagacuuagcuccgugacggccgaggauaccgcgguuuacuauugugcucggcgcggaaauucuuacgacggguacuucgauuauagcauggacuacuggggcuccggcacacccgugaccgucagcucugccuccacaaaagggccuagcguguuuccccuggccccuucuuccaagagcaccucuggaggcacggcugcccucgggugccugguuaaagauuauuucccggaacccgugacagucuccuggaacagcggagcucugaccuccggcgugcauacauuuccugccgugcuccagucuagcgggcuguacucccuuagcucugucguuaccgugcccuccagcucucugggaacccagacauauauuuguaaugugaaccacaagccuagcaauacgaaggucgacaaaaagguggagcccaaauccugcgauaagacccauacauguccgccuugccccgcgccugaacuccugggcggccccucuguuuuccuuuuucccccuaaaccgaaggacacccugaugaucagcagaacacccgaggugaccugugucgugguugaugugucccacgaggacccugaagucaaguucaacugguacguggacggggucgaggugcauaaugccaaaacgaagccccgggaagaacaguauaacagcacauaccgcguugugucuguccucaccgugcugcaccaagauuggcugaauggaaaagaguacaagugcaaaguuuccaacaaggcucucccugcccccauugagaaaaccaucagcaaggcuaagggccagccgagagagccucagguguauacacugcccccuucucgggacgaacuuaccaaaaaucaggucucccugacaugucucgugaagggguuuuaccccagcgauaucgccguggagugggaauccaacggacaaccugagaauaacuauaaaacgacacccccgguucuggacucugauggcuucuuuuuccuuuacagcaagcugaccgucgacaaaucccgcuggcagcaggggaacguguuuucuugcagcgugaugcacgaggcgcuccauaaucacuauacccaaaagucccugagccugucuccuggaaag

SEQ ID NO: 38848 - RNA, 645 nt, Artificial Sequence
  derived and/or modified sequence opt5 from Ontuxizumab_LightChain1
gacauccagaugacccaaagccccuccucucugagcgccuccgugggcgauagagucacaauuacgugccgggcuucucagaacguugggaccgccguggcguggcuccagcagacaccuggaaaggcuccgaaacugcuuaucuacagcgccuccaaucgcuauaccggcgugcccucuagauucagcggguccggaagcggcacagacuacaccuuuacaauuucuucccugcaaccugaggauaucgccaccuauuacugucagcaguauacgaacuaccccauguauaccuucgggcagggaacaaagguccaaauuaaacggaccguggcugccccuagcguuuuuaucuuucccccuucugacgaacagcucaaguccggcacagcuagcguggucugccugcuuaauaacuucuacccgcgcgaggccaaagugcaguggaagguugauaaugcgcugcagucuggcaacucccaagaaagcgugaccgagcaggacuccaaggauucuacguacagccucuccagcacacugacccugucuaaagccgacuaugaaaagcacaaagucuacgcuugugaggugacacaucaggggcucuccagccccgugaccaagucuuucaauagaggagagugc

SEQ ID NO: 38849 - RNA, 1341 nt, Artificial Sequence
  derived and/or modified sequence opt5 from Opicinumab_HeavyChain1
gaggugcagcugcucgaaagcggcgggggacugguccagcccggcgggucccuuagacugucuugcgccgcuagcggauucaccuuuuccgccuacgagaugaaguggguucggcaggcgccuggcaaagggcucgaaugggugucugugaucggaccgagcggcggcuucacauuuuaugcugacuccgucaaggggcgcuucacgauuucuagagauaacagcaaaaauacccuguaccuucagaugaacucccugcgggccgaggacacagccguguauuacugugcuaccgaaggagauaaugacgccuuugauaucuggggccaggggacaaccguuacagugagcucugcuuccaccaagggacccagcgucuucccucucgcccccucuuccaaaagcacgucuggcgggaccgcggcccugggaugccuggugaaggacuauuuuccugagcccguuacaguguccuggaacagcggcgcucucaccuccggcguccacacauucccugccgugcugcaaucuagcgggcuuuacucccugagcucuguggucaccguuccguccagcucucucggaacgcagacauauauuuguaaugugaaccauaagcccagcaauaccaaaguggauaagaaagucgagccuaaguccugcgacaaaacacacaccugucccccuugccccgcuccggaacugcuuggcgggccuucuguguuucuguuucccccuaagcccaaggauacccucaugaucagccgcacacccgagguuacguguguggucguggacguuucccaugaagauccugaggugaaauucaacugguacgucgacggaguggagguccacaaugccaagaccaaaccgagagaggaacaguacaacagcgcguaucgggugguuucugugcugacaguccugcaucaggauuggcucaauggcaaggaauacaaaugcaagguguccaacaaagcccugcccgcuccuauugagaagaccaucagcaaggccaaagggcaaccccgcgaaccucagguuuauacacuucccccgucuagagacgagcugaccaagaaucaggugucccucacgugucuggucaaaggauucuacccuagcgacaucgcuguggagugggaauccaacggccagcccgagaauaacuauaagacaaccccucccgugcuugauucugacggcagcuuuuuccuguacuccaaacucaccguugauaagucucgguggcaacaggggaacgucuucagcugcuccgugaugcacgaagcccugcacaaucauuauacacaaaagagccugucucucuccccugga

SEQ ID NO: 38850 - RNA, 645 nt, Artificial Sequence
  derived and/or modified sequence opt5 from Opicinumab_LightChain1
gacauccagaugacccaaagccccgccacacugagccucucuccuggcgagagagcuacgcugagcugccgggccucccagucugugagcuccuaccuugcgugguaucagcagaagccggggcaagcuccccgccugcucauuuacgaugccucuaacagagccaccggaaucccugcucgguucagcggcuccgggagcggaacagacuuuacccugacaauuucuucccuugaacccgaggauuucgccgucuauuacugucagcagcgcagcaauuggccuauguauaccuuuggccaggggacaaaacuggaaaucaagagaaccguugcugcccccucuguguucauuuuuccuccguccgacgagcaacucaaaagcggaacggcgucuguggucugccugcugaacaauuucuacccccgggaagccaaggugcaguggaaaguugauaacgcucuccaguccggcaauagccaggaguccgugaccgagcaagacucuaaggauagcacauauucccugagcucuacccuuacacuguccaaggccgacuacgaaaaacacaaggucuacgcuugugaggugacccaucagggccucagcucuccuguuacgaaauccuuuaaccgcggggaaugc

SEQ ID NO: 38851 - RNA, 1941 nt, Artificial Sequence
  derived and/or modified sequence opt5 from Oportuzumab_monatox_HeavyChain1
caccaucaccaucaccaugacauccagaugacccaaagccccuccucucugagcgccuccgugggcgauagagugacaauuacgugccggucuaccaagagccuccugcacuccaacgggaucacauaccuuuauugguaccagcagaaaccuggaaaggcuccgaaacugcucauuuaucagaugucuaaucuggccagcggcguucccucccgcuucucuagcuccgggagcggaaccgacuuuacacuuaccaucucuucccugcaaccugaggauuucgcgacauacuauugugcucagaaccucgaaauucccagaaccuuuggccaggggacgaagguggagcugaaacgggccaccccuagccacaauucucaucaggugcccuccgccggaggcccuacagcuaacagcggcaccuccgggucugaaguccaacuggugcagagcggaccgggccucguucagcccgggggauccgugcgcaucagcugcgccgcuucuggcuacacauucaccaauuaugggaugaacugggucaagcaggccccuggaaagggccuggaguggaugggcuggaucaauacguacacaggggaauccaccuacgcggacagcuuuaaaggaagauucacauuuucucuugauaccagcgccuccgcugccuaucugcaaauuaacucucuccgggcugaggacaccgccguguacuauugugcgcgcuucgccaucaagggcgauuacugggggcagggaacacugcuuacgguuagcuccgaguuuggcggggcucccgaguucccuaaacccagcaccccgccuggaucuuccggccuggagggcgggagccucgccgcucugacagcccaccaggccugccaucugccccucgaaaccuuuacaagacaccggcaaccucgcggaugggagcagcuggagcaguguggcuaucccgugcagagacuugucgcucuguaccucgcggcccggcugucuuggaaucaaguggaccaggugauucgcaacgcucuugccucccccgggagcggaggcgaucugggggaagccaucagagagcagccugaacaggcucggcucgcccugacccuggcggcugccgaguccgaacgcuucgucagacaaggcacgggaaaugacgaggccggcgcugccucugcugauguugugagccucacaugcccgguggccgcgggggagugugccggacccgcugacuccggcgaugcccugcuugaacggaacuauccuaccggggcugaguuucugggagacggcggggacgucucuuucagcaccagaggcacacagaauuggaccguggaacgccuccugcaggcccaccggcagcuugaggaaagaggauacguuuucgugggcuaccaugggacauuucuggaggcggcccaauccauugucuucggaggcgugcgcgcucggagccaggaucucgacgccaucuggagaggguuuuauauugcuggagaucccgcccuggccuacggcuaugcucaggaccaggagccugaugcgcgcgggcggaucagaaacggcgcccugcuccgcguuuacgugccccggucuucccugccgggauucuauagaacgggccuuacccuggcugccccugaagccgcuggggaggucgaacgccucaucggacacccccugccucugcggcuugacgccauuacaggccccgaggaagaagggggaagacucgagaccauccugggcuggccucuggcggaacggacaguggucauucccagcgcuaucccgaccgauccucgcaaugucgggggcgaccucgaucccucuuccauucccgacaaggagcaagccaucagcgcccugccugauuacgcuucucagccgggaaaacccccucaucaccaucaccaccauaaggacgaacuu

SEQ ID NO: 38852 - RNA, 1941 nt, Artificial Sequence; identical to SEQ ID NO: 38851
  derived and/or modified sequence opt5 from Oportuzumab_monatox_SingleChain_variable_fragment

SEQ ID NO: 38853 - RNA, 762 nt, Artificial Sequence
  derived and/or modified sequence opt5 from Oreptacog_alfa_HeavyChain1
aucgugggcgggaaggucugccccaagggagaguguccuuggcagguucugcuccuggugaacggcgcccaacuuugcgggggaacccugauuaauacaaucuggguggucagcgcugcccacuguuucgacaagauuaaaaacuggagaaaucucaucgcggugcugggcgaacaugaucuuuccgagcacgacggggaugaacagucucggcgcguugcucaggugauuaucccgagcacguacguccccggaaccacaaaccaugacaucgcccugcucagacugcaccagccugugaaucugaccgaucauguugugccccucugccugccugagcggacauuuuccgaacgcacccuugccuucgucagauuuucucuggugagcggcuggggccaacuccuggaccgcggggcuacagcccuugagcugauggugcucaacgucccccggcugaugacccaggauugucugcagcaguccagaaagguuggagacucuccuaauauuacggaguauauguucugcgcuggcuacagcgauggguccaaagacagcuguaagggagauucuggcgggccgcacgccacccacuaucggggaacaugguaccucaccggcaucguguccuggggccaagggugcgcgacagugggacauuuuggcgucuauacccgcgugagccaguacauugaauggcugcagaaacuuaugagaucugagccccggccugggguucugcuccgcgcccccuucccu

SEQ ID NO: 38854 - RNA, 456 nt, Artificial Sequence
  derived and/or modified sequence opt5 from Oreptacog_alfa_LightChain1
gccaacgcuuuccuggaggaacucagacagggcagccuggagcgggaaugcaaggaggaacaauguuccuuugaggaggcccgcgaaaucuucgaggacgaagaggagaccaaacuguuuuggauuucuuacagcgauggggaccagugcgcguccucucccugucagaauggaggcagcugcaaggaucagcuucaauccuauaucuguuucugccucccugcuuuugaagggagaaacugugagacacacaaagacgaucagcugauuugcgugaaugaaaacggaggcugugagcaguacugcucugaccauaaugggacgaagcggagcugucgcugccacgaaggauauucccuucuggccgauggcgucagcugcaccccgacaguugaguaccccuguggcaaaaucccuauucucgagaagagaaacgccucuaagccccaggggcgg

SEQ ID NO: 38855 - RNA, 1353 nt, Artificial Sequence
  derived and/or modified sequence opt5 from Orticumab_HeavyChain1
gaggugcagcugcucgaaagcggcgggggacugguccaacccggcgggucccuuagacugucuugcgccgcuagcggauucaccuuuuccaacgccuggaugucuuggguucggcaggcgccuggcaaggggcucgagugggugagcuccaucucugugggaggccaccgcacauacuaugcugacagcgucaaaggcagauccacgauuagccgggauaauucuaagaacacccuguaccuucagaugaauagccugcgcgccgaagacacagccguguauuacugugcuagaauccggguugggccguccggaggcgccuucgauuauugggggcagggaacccucgugacagucucuuccgcuagcaccaaaggccccucuguguuuccucuggcccccuccagcaaguccacaucugggggaaccgcggcccugggcugccucguuaaagacuacuucccugagcccgugacggucagcuggaacuccggcgcucugaccagcggggugcauacauuuccugccgugcuucaaucuuccggacuguauagccucucuagcgucguuaccgugccguccucuagccugggcacacagaccuacauuuguaaugugaaccacaagcccuccaauacgaaggucgauaaaaagguggaaccuaaaagcugcgacaagacacauaccugucccccuugccccgcuccggagcuucucgggggaccuucuguuuuccuguuucccccuaaacccaaggauacacugaugaucucccgcacccccgaggugaccugugucgugguugacgugagccacgaagauccugaggucaaguucaacugguacguggacggcgucgaagugcauaaugccaaaacaaagccgagagaggagcaguauaacucuacguaccggguuguguccguccugaccgugcuccaccaggauuggcugaaugggaaagaauauaagugcaaaguuagcaacaaggcgcuucccgccccuauugagaaaacaaucuccaaggcuaagggacaaccccgcgaaccucagguguacacccugcccccgucuagagacgagcucaccaaaaaucaggucagccugacaugucuugugaagggcuuuuauccuuccgauaucgccguggaaugggagucuaacggccagcccgagaauaacuacaaaacgacaccucccguucuggacagcgacggguccuucuuucucuauagcaagcugaccgucgauaaaucucgguggcaacagggaaacguguucuccugcagcgugaugcacgaagcucugcauaaucacuacacccagaagucucucucccugagcccuggcaag

SEQ ID NO: 38856 - RNA, 648 nt, Artificial Sequence
  derived and/or modified sequence opt5 from Orticumab_LightChain1
cagagcgugcugacccaacccccuuccgccucuggcacaccggggcagagagucacgaucagcugcuccggaucuaacaccaauauuggcaagaacuacguuagcugguaucagcagcuccccgggacagcuccuaaacugcuuaucuacgccaauuccaaccggcccucuggagugccugaccgcuucagcggcuccaagagcgggaccucugcgucccuggcuauuagcggacucagaucugaggaugaagccgacuauuacugugccuccugggaugcuagccugaauggcuggguguuuggcgggggaacaaaacuuaccguccugggccaacccaaggccgcuccuucugugacacucuucccgcccuccagcgaggaacugcaggccaacaaagcgacccugguuugccucaucuccgacuuuuauccuggggccgugacggucgcuuggaaggccgauucuagccccgugaaggcuggaguugagaccacaaccccuuccaaacagagcaauaacaaguacgccgcgucuuccuaucugagccuuacacccgaacaguggaaaucucaccggagcuacuccugucaagugacccaugagggcucuacggucgagaagacaguggccccgaccgaaugcagc

SEQ ID NO: 38857 - RNA, 1347 nt, Artificial Sequence
  derived and/or modified sequence opt5 from Otelixizumab_HeavyChain1
gaggugcagcugcucgaaagcggcgggggacugguccaacccggcgggucccuuagacugucuugcgccgcuagcggauucaccuuuuccucuuucccuauggccuggguucggcaggcgccgggcaaggggcucgagugggugagcacaaucuccacgucuggaggccgcaccuacuauagagacagcgugaaaggccgguuuacaauuucccgcgauaacagcaagaauacccuguaccuucagaugaacucucugagagcugaagacacagccgucuauuacugugccaaauuccggcaguauuccgggggauuugauuacuggggccaagggacccucgugacaguuagcucugcuuccaccaagggacccagcguguucccucuggcccccucuuccaaaagcacguccggcgggaccgcugcccugggaugccucgucaaggacuauuuuccugagcccgugacaguuucuuggaauagcggcgcgcugaccuccggcgugcacacauucccugccguccuucagagcucugggcuguacucccucagcucuguggugaccgucccgagcuccucucugggaacgcagacauacaucuguaacguuaaucauaagcccagcaacaccaaaguggauaagaaaguggaaccuaaguccugcgacaaaacacacaccugucccccuugccccgcuccggagcuucugggcgggccuagcgucuuucucuuucccccuaagcccaaggauacccugaugauuucucgcacacccgaggugacguguguuguggucgacgugucccaugaagauccugagguuaaauucaauugguauguggacggagucgaagugcacaacgccaagaccaaaccgagagaggagcaguacgcuagcacauaucgggucgugucuguucugaccgugcuccaucaagauuggcugaauggcaaggaauacaaaugcaaggucuccaacaaagcccuucccgcgccuaucgagaagacaauuagcaaggccaaagggcagccccgcgaaccucagguguauacccugcccccguccagagacgagcucacgaagaaucagguuucucugacaugucuugugaaaggauucuacccuagcgauaucgcugucgaaugggaguccaacggccaacccgagaauaacuauaagaccaccccucccgugcuggacucugacggcagcuuuuuccucuacuccaaacugacaguggauaagagccgguggcagcaggggaauguuuucucuugcuccgucaugcacgaagcccugcacaaccauuacacccaaaagagccucucucuguccccuggaaaa

SEQ ID NO: 38858 - RNA, 648 nt, Artificial Sequence
  derived and/or modified sequence opt5 from Otelixizumab_LightChain1
gacauccagcugacccaacccaacagcguguccacaucucucggcagcacggucaagcuguccugcacccuuucuagcgggaauauugagaacaauuacguucacugguaucagcuguacgaaggaagauccccuacaaccaugaucuaugaugacgauaaacggccggacggcgugcccgaucgcuucucugggagcauugacagauccagcaacucugccuuucucacaauccauaauguggcuauugaggaugaagccaucuacuucugucacuccuaugucagcucuuuuaacguguucggaggcgggaccaagcugacaguucuucggcagccuaaagcggcucccuccgugacccuguuuccucccagcucugaggaacuccaggccaauaaggccacgcuggucugccugaucuccgacuucuacccuggagcugugaccguugccuggaaagcugauagcuccccggugaaggccggcgucgagacaaccacacccucuaagcaaagcaacaauaaauaugcggccuccagcuaccucucucugaccccugagcaguggaagucccaucgcagcuacucuugucaggugacgcacgaaggcagcacaguggagaaaaccgucgcucccacagaaugcucc

SEQ ID NO: 38859 - RNA, 1449 nt, Artificial Sequence
  derived and/or modified sequence opt5 from Otlertuzumab_HeavyChain1
gaggugcagcugguccagagcggcgccgaaguuaagaaacccggggagucccucaagaucucuugcaaaggaagcggcuacuccuucaccggguauaacaugaauugggugagacagaugccuggaaagggccuggaauggauggggaacauugacccguacuauggaggcacaacguacaaucggaaauuuaagggccaggugaccaucucugcugauaagagcauuuccacagccuaucuucaguggucuagccugaaagcguccgacaccgcuauguacuauugugcccgcagcgucgggcccuucgauucuuggggacaaggcacacucgugaccguuuccagcgggggaggcgggucuggaggcggcggguccggaggcgggggaagcggcgggggaggcucuggcgggggaggcuccgagaucgugcugacacagagcccugccacccuuucccugucucccggggaaagagcuacgcucagcugccgggccuccgagaacgucuacagcuaccuggcuugguaucagcagaagccuggacaagcgccccgccugcucauuuacuuugccaaaacccuggccgagggcaucccugcuagauucucuggguccggcagcggaacagacuuuacccuuacaaucucuagccuggaaccggaggauuucgccguguauuacugucagcaccauuccgacaaucccuggaccuuuggccaggggacgaagguugaaauuaaaggagaucaggagccuaagucuagcgacaagacacacaccuccccucccugccccgcuccggagcuccugggcgggccuagcguguuccuuuuucccccuaaacccaaggauacacugaugaucucucggacccccgaagucaccugugugguggucgacguuucccaugaggauccugaagugaaauucaacugguauguggacggagucgaggugcacaaugccaagacaaaaccgcgcgaagaacaauacaacagcacguauagaguugugucuguccucaccgugcugcaucaggauuggcugaauggcaaggaguacaaaugcaagguuuccaacaaggcgcuccccgccccuauugagaaaacaaucagcaaggcuaaagggcagccccgggagccucaaguguacacccugcccccgucccgcgacgaacuuacaaagaaucaggucucucugaccugucucgugaaaggcuuuuauccuagcgacauugccgucgagugggaauccaacggacagcccgagaauaacuacaagacgacaccucccgugcuggauucugacggcagcuucuuucuuuauuccaagcugaccguugauaaaagcagauggcagcaagggaauguguucucuugcuccgucaugcacgaggcucuccacaaccauuacacccaaaagagccugucucuguccccuggaaaa

SEQ ID NO: 38860 - RNA, 1347 nt, Artificial Sequence
  derived and/or modified sequence opt5 from Oxelumab_HeavyChain1
gaggugcagcugcucgaaagcggcgggggacugguccaacccggcgggucccuuagacugucuugcgccgcuagcggauucaccuuuaacuccuacgccaugucuuggguucggcaggcgccuggcaaggggcucgagugggugagcaucauuuccggaucuggcggcuucacauauuacgcugacagcgugaaagggcgcuuuacgaucuccagagauaauagccggaccacacuguaucuucagaugaacucucugcgcgccgaagacaccgccgucuacuauugugcuaaggauagacucguggccccgggaacauucgacuacuggggccagggggcucugguuaccguguccagcgccucuacaaaaggacccuccgucuuuccucuggcgcccagcucuaaguccaccagcggcgggacggccgcucucggaugccuggugaaagauuauuucccugagcccguuaccguguccuggaacucuggcgcccuuacaagcggcguccacaccuuuccugcugugcugcaauccagcgggcucuacucucuguccagcguggucacaguuccgucuagcucccuuggaacccagacguacauuuguaaugugaaucauaagcccucuaacacaaagguggacaaaaaggucgaaccuaaaagcugcgauaagacccacacaugucccccuugccccgccccggagcugcucggcgggccuuccguguuccuguuucccccuaaacccaaggacacccugaugaucagccggacccccgagguuacauguguggucguggauguuucucaugaagacccugaggugaaguucaauugguaugucgauggaguggaaguccacaacgcgaaaacgaagccgcgcgaggagcaguacaauuccaccuauagagugguuagcgugcucacaguccugcaucaggacuggcuuaacggcaaagaauacaagugcaaagugucuaauaaggcccugcccgcuccuauugagaaaaccaucuccaaggccaaggggcaaccccgggaaccucagguuuauacacugcccccgagccgcgaugagcucaccaaaaaccaggugucccuuacgugucuggucaagggauuuuacccuucugacaucgcuguggaaugggagagcaauggccagcccgagaacaauuauaaaacaaccccucccgugcucgacuccgauggcucuuucuuucuguacagcaagcugaccguugacaaauccagauggcaacaggggaacgucuucagcugcucugugaugcacgaagcccuccacaaccauuacacacagaagucccugagccuuucuccugga

SEQ ID NO: 38861 - RNA, 642 nt, Artificial Sequence
  derived and/or modified sequence opt5 from Oxelumab_LightChain1
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccuacaccuuuggccaagggacaaaacuggagauuaagagaaccguggcugccccuuccguguucaucuuucccccuagcgacgaacagcuuaaauccggaacggcuucugucgugugccugcucaauaacuucuauccgcgggaggccaagguucaguggaagguggauaaugcgcugcagagcggcaacucccaagaaagcgucaccgagcaggacucuaaagauuccacauacagccugucuagcacccucacacuguccaaggccgacuacgagaaacacaagguguaugcuugugaaguuacccaucagggccuuucuagccccgugacgaaauccuuuaaucgcggggagugc

SEQ ID NO: 38862 - RNA, 1329 nt, Artificial Sequence
  derived and/or modified sequence opt5 from Ozanezumab_HeavyChain1
caggugcaacugguccagagcggcgccgagguuaagaaacccggggcuuccgugaaggugucuugcaaagccagcggauacaccuucacauccuauuggaugcacugggucagacaggcgccuggccaggggcucgaauggaucggaaacauuaauccgucuaacggcgggacgaauuacaacgagaaguuuaaaagcaaggcuaccaugacacgggacaccuccacaucuaccgccuauauggaacugagcucccuucgcagcgaggauacagccguguacuauugugaacugaugcaaggauacuggggccagggcacccucguuacggugucuuccgcuagcaccaaggggcccucugucuucccucuggcccccuccagcaaaucuacauccggaggcaccgcugcccuugggugccuggugaaggacuauuuuccugagcccguuacagugagcuggaacuccggagcgcucaccucuggcguccauacguucccugccgugcugcagagcuccgggcuguacagccucucuuccguggucacaguuccgagcucuagccugggaacccagacauacaucuguaaugugaaucacaaacccuccaacaccaagguggauaaaaaggucgagccuaagucuugcgacaaaacccauacaugucccccuugccccgcuccggaacuugccggcgcuccuagcguguuucuguuucccccuaagcccaaagauacgcucaugauuuccagaacccccgagguuacauguguggucguggacguuagccacgaagauccugaggugaaguucaauugguaugucgacggcguggagguccauaacgccaaaaccaagccgcgggaggaacaauacaauucuacauaucgcgugguuuccgugcugaccguccuucaccaggauuggcugaacgggaaagaauacaagugcaaggugagcaauaaagcgcuccccgccccuaucgagaagacgauuucuaaagcuaagggacagcccagagaaccucagguuuauacacugcccccgucccgggacgagcugaccaaaaaccaagugagccucaccugucuggucaagggcuucuacccuuccgauaucgccguggagugggaaucuaaugggcagcccgagaacaacuauaagacaaccccucccgugcuugacagcgauggauccuuuuuccuguacucuaaacucacaguugacaagagccgcuggcagcaaggcaaugucuuuuccugcagcgugaugcacgaagcucugcauaaccacuacacgcagaaaucucuuucccugagcccugggaag

SEQ ID NO: 38863 - RNA, 657 nt, Artificial Sequence
  derived and/or modified sequence opt5 from Ozanezumab_LightChain1
gacaucgugaugacccagagcccccuguccaacccugucacacucggccaaccgguuucuauuagcugccgguccucuaagagccugcuuuacaaagaugggaagacguaucugaauugguuccuccagcggcccggacaguccccucagcugcuuaucuaccugaugucuacccgcgccagcggcgugcccgacagauuuuccgggggaggcagcgggacagauuucacccucaaaauuucucggguggaggcugaagacgucggaguguauuacugucaacagcugguugaguauccucugacauuuggccagggcaccaagcucgaaaucaaacgcacaguggccgcgcccuccgucuucauuuuuccuccgagcgaugagcagcugaagucugggaccgcuuccgugguuugccuucugaacaauuucuaccccagagaagccaaggugcaauggaaagucgacaacgcccuccagagcggaaauucucaggaguccgugacggagcaggauagcaaggacuccaccuauucucugagcuccacacuuacccugagcaaagcugauuacgaaaagcacaaaguguacgccugugaggucacacaucaaggccucucuuccccuguuaccaagagcuuuaacagaggggaaugc

SEQ ID NO: 38864 - RNA, 1089 nt, Artificial Sequence
  derived and/or modified sequence opt5 from Ozoralizumab_HeavyChain1
gaggugcagcuggucgaaagcggcgggggacucguucaacccggcgggucccugagacuuucuugcgccgcuagcggauucaccuuuuccgacuacuggauguauugggugcggcaggccccuggcaaggggcuggagugggugucugaaaucaacacaaauggacucauuacgaaauacccggauagcgucaagggccgcuucaccaucuccagagacaacgcgaaaaauacacuguaucuucagaugaacucucugcggcccgaggauaccgcuguguacuauugugcccgcagcccuuccggcuuuaauagagggcagggaacacucguuaccgugagcucuggcgggggaggcuccgggggaggcagcgaaguccaacugguggagucuggcgggggacugguucagcccggcaacucccuccggcugagcugcgccgcuucuggguucacauuuuccagcuucggaauguccugggugcgccaggccccuggcaaggggcuugagugggucucuagcauuuccggaagcggcucugacacccuguacgcugauuccgugaaaggcagauuuacgaucagccgggacaaugccaagaccacacucuaucugcagaugaacucucuucgccccgaagauaccgcgguguacuacuguacaauugggggaagccuguccagaucuagccaaggcacccucgucacgguuuccagcgggggaggcgggucuggcggaggcuccgaggugcagcugguggaaagcgggggaggccugguccagccugggggaucucuccggcuguccugcgccgcuagcggcuucacauuuuccgacuauuggauguacugggugcgccaggccccggggaagggccuugaguggguuucugagaucaauaccaacggacugaucacaaaauaucccgauagcgugaagggcagauucaccauuucccgggacaaugcuaaaaacacccucuaccugcaaaugaacucucuucgcccugaagauacagccgucuauuacugugcgagaagccccuccggguuuaaucggggacagggcacgcuggugaccguuagcucu

SEQ ID NO: 38865 - RNA, 1350 nt, Artificial Sequence
  derived and/or modified sequence opt5 from Palivizumab_HeavyChain
caggugacccugagagagagcggccccgcccucgucaagccuacacaaacgcugacccuuacaugcaccuucuccggguuuucucugagcacauccggaaugucuguuggcuggauccggcagccgcccgggaaagcucucgaauggcuggccgacauuuggugggaugacaagaaagauuacaacccuagccuuaagucccgccugaccaucucuaaagacacaagcaagaaucagguggugcucaaggucaccaacauggaucccgcggacacggcuaccuauuacugugccagauccaugauuacaaauugguauuucgauguguggggagccggcaccacaguuaccgugagcucugcuuccacgaaagggccuagcgucuuuccccuggccccuucuuccaagagcacaucuggaggcaccgcugcccugggcugccucgugaaagacuacuucccggagcccguuacaguguccuggaacagcggggcgcugaccuccggaguccacaccuuuccugccgugcuucagucuagcggccuguauucccucagcucuguggucacaguucccuccagcucucuggggacgcaaaccuacaucuguaaugugaaccauaagccuagcaauacaaaaguggauaagcgggucgaacccaaguccugcgacaaaacccacacauguccgccuugccccgcuccugagcuucugggaggccccucuguguuccucuuucccccuaagccgaaagauacccugaugauuagccgcacgcccgaaguuacauguguggucguggacguuucccaugaggauccugaggugaaguucaacugguaugucgacgggguggaaguccacaaugccaaaaccaagcccagagaggaacaguacaacagcaccuaccgggugguuucugugcugacaguccuccaucaggacuggcugaauggaaaagaguauaagugcaagguguccaacaaagcccuuccugcucccaucgagaagaccaucagcaaagcgaagggccagccgcgcgaaccucaaguuuacacacugcccccuucuagagaggaaaugacgaaaaaucaggugucccucaccugucuggucaagggcuuuuaucccagcgauauugccguggagugggaauccaacgggcagccugagaauaacuacaagacaacacccccggugcuugacucugauggcagcuucuuucuguauuccaaacucaccguugacaagucucgguggcagcaaggaaacgucuucagcugcuccgugaugcacgaggcucugcacaaucauuacacccagaaaagccugucucucuccccugggaag

SEQ ID NO: 38866 - RNA, 639 nt, Artificial Sequence
  derived and/or modified sequence opt5 from Palivizumab_LightChain
gacauccagaugacccaaagccccuccacacugucugccagcgugggcgauagagucacgauuaccugcaagugucagcucuccguuggguacaugcacugguaucagcagaaaccuggaaaggcuccgaaacugcuuaucuacgacacaucuaagcuggccagcggcgugcccucccgguucucugggagcggauccggcaccgaguuuacacucaccauuagcucucugcaaccugaugacuucgcgacauauuacugcuuucagggguccggauaucccuucaccuuuggcggcgggacgaaacuugaaaucaagcgcaccguggcugccccuagcgucuucauuuuucccccuucugaugagcagcugaaguccggaacagccagcgugguuugucuccugaacaauuucuacccgagagaagcuaaagugcaguggaaggucgacaacgcccugcaaucuggcaauucccaggagagcgugaccgaacaggauuccaaagacucuacauauagccucuccagcacccugacgcuuucuaaggcugauuacgagaaacauaagguuuacgccugcgaggugacacaccaggggcuguccagccccgucaccaagucuuuuaaccggggagaaugu

SEQ ID NO: 38867 - RNA, 360 nt, Artificial Sequence
  derived and/or modified sequence opt5 from Palivizumab_VH-Region
caggugacccugagagagagcggccccgcccucgucaagccuacacaaacgcugacccuuacaugcaccuucuccggguuuucucugagcacauccggaaugucuguuggcuggauccggcagccgcccgggaaagcucucgaauggcuggccgacauuuggugggaugacaagaaagauuacaacccuagccuuaagucccgccugaccaucucuaaagacacaagcaagaaucagguggugcucaaggucaccaacauggaucccgcggacacggcuaccuauuacugugccagauccaugauuacaaauugguauuucgauguguggggagccggcaccacaguuaccgugagcucu

SEQ ID NO: 38868 - RNA, 1347 nt, Artificial Sequence; identical to SEQ ID NO: 38504
  derived and/or modified sequence opt5 from Pamrevlumab_HeavyChain1

SEQ ID NO: 38869 - RNA, 642 nt, Artificial Sequence; identical to SEQ ID NO: 38505
  derived and/or modified sequence opt5 from Pamrevlumab_LightChain1

SEQ ID NO: 38870 - RNA, 1305 nt, Artificial Sequence
  derived and/or modified sequence opt5 from Panitumumab_HeavyChain1
caggugcaacugcaggagagcggccccgggcucgucaagccuuccgaaacccugucucuuacaugcacgguuagcggaggcuccgugucuagcggggacuacuauuggaccuggaucagacaguccccgggaaaaggccuggaguggauugggcacaucuacuauucuggaaacacaaauuacaaccccagccucaagucccggcugaccauuagcaucgauacaucuaaaacccaguucucccuuaagcugagcucugugacagccgcugacaccgccauuuauuacuguguccgcgauagagugacgggcgcguuugacaucuggggccaagggaccaugguuacaguguccagcgcuucuaccaaaggaccuuccgucuucccccucgccccuugcagccgguccacaucugaaagcaccgccgcucugggcugucuggugaaggauuauuuucccgagccuguuacgguguccuggaauagcggggcccucacaucuggaguccauaccuucccggcugugcugcaguccagcggccuuuacucucugagcuccguggucacaguucccucuagcaacuuugggacccagaccuacacaugcaauguggaccacaagccuuccaacacgaaaguggaugaacgcaaguguugcgucgagugucccgccggaccuagcguguuccucuuucccccgaaaccuaaggacacccugaugaucucuagaacacccgagguuaccugcguggucguggauguuucccaugaagacccugaggugcaguucaauugguaugucgauggcguggaaguccacaacgcgaaaacaaagccccgggaggagcaauuuaauagcaccuuccgcgugguuucugugcuuacggucgugcaucaggacuggcugaacggcaaggaauacaaauguaagguuuccaauaaagggcuccccgccccuauugagaagacaaucagcaaaaccaagggacagccgagagaaccccagguguauacccugccucccucccgggaggaaaugaccaaaaaccaagucucucugacaugccucgugaagggcuuuuacccuagcgauauugcuguggagugggaguccaaugggcagcccgaaaacaauuauaagacaacgccgccuaugcuggacucugacggcagcuucuuucuuuacuccaaacugaccguugauaagagccgcuggcagcaaggaaacgucuucucuuguuccgugaugcacgaggcccuccacaaccauuauacacagaaaagccugucucuuucccccgggaag

SEQ ID NO: 38871 - RNA, 642 nt, Artificial Sequence
  derived and/or modified sequence opt5 from Panitumumab_LightChain1
gacauccagaugacccaaagccccuccucucugagcgccuccgugggcgauagagucacaauuacgugccaggcuucucaggacaucagcaacuaccucaauugguaucagcaaaagccugggaaagccccgaagcugcuuauuuacgaugcguccaaccuggagaccggaguucccucucgguucagcggcuccgggagcggaacagacuuuaccuucacaaucucuucccuccagccugaagauauugcuaccuauuuuugucagcacuucgaccaucugccccuugccuuuggcgggggaacaaaaguggagaucaagcgcaccguggccgcuccuagcgucuucaucuuucccccuucugaugaacagcugaaauccggcacggccagcgugguuugccuccugaauaacuucuacccgagagaggcuaaggugcaauggaaggucgacaaugcccugcagucuggcaacucccaggaaagcgugaccgagcaggauuccaaagacucuacauauagccucuccagcacccugacacuuucuaaggcggauuacgagaaacacaagguuuaugccugugaagugacccaucaagggcuguccagccccgucacgaaaucuuuuaaucggggagagugc

SEQ ID NO: 38872 - RNA, 1326 nt, Artificial Sequence
  derived and/or modified sequence opt5 from Pankoab_HeavyChain1
gaggugcagcuggucgaaagcggcgggggacucguucaacccggcggguccagacugucuugcguggccagcggauucccuuuuuccaacuacuggaauugggugcggcaggcuccgggcaaggggcuugagugggucggagaaauccgccugaaaucuaacaauuauaccacacacuacgccgagagcgugaagggcagauucacgauuucccgggacgauucuaaaaacagccucuaucugcaaaauucccuuaagaccgaagacacagcgguuuacuauuguacccgccauuacuauuuugauuacuggggccaggggacacuggugaccgucagcucugcuuccacaaaaggacccagcguguucccucucgcccccucuuccaagagcaccucuggcgggacggccgcucugggaugccugguuaaggacuacuuuccugagcccgugaccgucuccuggaacagcggcgcccucacauccggggugcacaccuucccugcugugcugcagucuagcggacuuuauucccugagcucugucguuacagugccguccagcucucucggcacccagacguacaucuguaaugugaaccauaaacccagcaauacaaaggucgauaaaaagguggagccuaaauccugcgacaagacccacacaugucccccuugccccgccccggaacugcuuggcgggccuucuguuuuucuguuucccccuaagcccaaagauacccucauuagcagaacccccgaggugacaugugucgugguugacgugucccaugaagauccugaggucaaguucaacugguauguggacggagucgaggugcacaaugcgaaaacgaagccgcgggaggaacaguacaacagcaccuaucgcguugugucuguccugacagugcugcaccaggauuggcucaauggcaaagaauacaagugcaaaguuuccaacaaggcccugcccgcuccuaucgagaagaccauuagcaaagccaaggggcaacccagagaaccucagguguauacacuucccccgucucgggacgagcugaccaaaaaucaggucucccucacgugucuggugaagggauucuacccuagcgauaucgcuguggagugggaauccaacggccagcccgagaacaauuacaaaacaaccccucccguucuugacucugacgggagcuuuuuccuguauuccaagcucaccgucgauaagucucgcuggcaacagggaaacguguuuagcugcuccgugcaugaaggccugcacaaucauuacacacagaaaagccugucucucuccccuggcaag

SEQ ID NO: 38873 - RNA, 651 nt, Artificial Sequence
  derived and/or modified sequence opt5 from Pankoab_LightChain1
gacaucgugacccagagcccccuguccaacccugucacaccgggcgagcccgccucuauuagcugcagauccucuaagagccuccugcacuccaaugggaucacguacuucuuuugguaucuucaaaaaccuggacagucuccccagcugcucauuuaccagagcaaccuggcuuccggcguuccugaucgguucagcgggucuggauccggcaccgacuuuacacuucgcaucagcagaguggaagccgaggaugugggggucuauuacugugcgcaaaaucuggaacugcccccuaccuucggacagggcacaaagguggagauuaaacggaccguugcugccccgucuguguuuaucuuucccccuuccgacgaacagcucaagagcggcacagccucugucgugugccugcucaacaauuucuauccccgcgaggcuaaaguucaguggaagguggauaacgcccugcaauccgggaauagccaggaguccgucaccgaacaggacucuaaggauagcacguacucccuuagcucuacccugacacucuccaaagcugacuaugagaagcauaaaguguacgccugugaagugacccaccagggacugagcucuccugucacaaagagcuucaacagaggcgagugc

SEQ ID NO: 38874 - RNA, 651 nt, Artificial Sequence
  derived and/or modified sequence opt5 from Pankoab_LightChain2
gacaucgugacccagagcccccuguccaacccugucacaccgggcgagcccgccucuauuagcugcagauccucuaagagccuccugcacuccaaugggaucacguacuucuuuugguaucuucaaaaaccuggacagucuccccagcugcucauuuaccagagcaaccuggcuuccggcguuccugaucgguucagcgggucuggauccggcaccgacuuuacacuucgcaucagcagaguggaagccgaggaugugggggucuauuacugugcgggaaaucuggaacugcccccuaccuucggccaaggcacaaagguggagauuaaacggaccguugcugccccgucuguguuuaucuuucccccuuccgacgaacagcucaagagcgggacagccucugucgugugccugcucaacaauuucuauccccgcgaggcuaaaguucaguggaagguggauaacgcccugcaguccggaaauagccaagaguccgucaccgaacaggacucuaaggauagcacguacucccuuagcucuacccugacacucuccaaagcugacuaugagaagcauaaaguguacgccugugaagugacccaccagggccugagcucuccugucacaaagagcuucaacagaggggagugc

SEQ ID NO: 38875 - RNA, 351 nt, Artificial Sequence
  derived and/or modified sequence opt5 from PankoMab_HeavyChain_VDJ-Region
gaggugaagcuggucgaaagcggcgggggacucguucagcccggcggguccaugaaacugucuugcguggccagcggauucaccuuuuccaacuacuggaugaauugggugagacaaucuccugagaagggccuugaaugggucgcugagauccggcugaaaagcaacaauuauacaacgcacuacgccgaauccgugaaggggcgcuucaccauuucuagagacgauagcaaauccagcguuucucuccagaugaacaaucugcggguggaggacacaggaaucuauuacuguacccgccauuauuacuuugauuauuggggccagggcacaacccuuacagucuccagc

SEQ ID NO: 38876 - RNA, 339 nt, Artificial Sequence
  derived and/or modified sequence opt5 from PankoMab_LightChain_VJ-Region
gacaucgugaugacccaggccgcuuucagcaaccccgucacacugggcacguccgccucuauuagcugcagauccucuaagagccuccugcacuccaaugggaucaccuacuuuuucugguaucuucaaaaaccuggacugucuccgcagcuccugauuuaccagaugagcaaccuugcguccggcguucccgaucgguuuucuagcuccgggagcggaacagacuucacccugcgcaucucuagaguggaggcugaagaugugggcgucuauuacugugcccagaaucucgagcugccucccacauuugggggaggcaccaagcuggaaauuaaacgg

SEQ ID NO: 38877 - RNA, 1707 nt, Artificial Sequence
  derived and/or modified sequence opt5 from Panobacumab_HeavyChain1
gaggaacagguggucgagagcggcgggggauucguucaacccggcgggucccugagacucucuugcgccgcuagcggauuuaccuucuccccuuacuggaugcacugggugcggcaggccccgggcaaggggcuggugugggucucucgcaucaacagcgacggauccacauauuacgcggauucugugaaaggcagauuuacgauuagccgggacaaugcucgcaacacccuuuaucugcagaugaacucccucagagccgaagauacagccguuuacuauugugcucgggaccgcuacuauggccccgagaugugggggcagggaaccauggugacagucagcucuggcuccgccagcgcuccuacccuguucccccuugugucuugcgaaaauuccccuagcgauacaucuuccguugccguggggugucuggcgcaagacuuucuccccgauagcaucaccuucuccuggaaguacaaaaauaacucugacauuagcuccacgagaggauuuccuagcguccugcggggcgggaaguacgccgcuaccucucaggugcugcucccguccaaagaugugaugcagggaacagacgagcaugucguuugcaaggugcagcaccccaauggcaacaaggagaaaaaugugccucugcccgucaucgccgaacuuccucccaaggugagcguuuucgugccgccucgcgauggcuuuuucgggaaccccagaaaaucuaagcugauuugucaagcuaccggauuuagcccucggcagauccaggucuccuggcuccgcgagggcaaacagguggggucuggaguuacaaccgaccaagugcaggccgaagcgaaggagagcggccccacgacauauaaggucaccuccacacugaccaucaaagagagcgauuggcuuucucaguccauguuuaccugcagaguggaccaucgggggcugacauuccaacagaaugccagcucuauguguguccccgaccaggauacggcuauucgcguguucgccaucccuccguccuucgcuagcauuuuucucaccaaguccacaaaacugaccugccugguuacagaccucaccacguacgauucugugacaaucagcuggaccagacagaacggagaagccgucaagacccacacaaauauuuccgagucucaucccaacgccaccuucagcgcugugggcgaagcguccaucugugaggacgauuggaauagcggcgaacgguuuacaugcacgguuacccacacagaccugccuucuccccuuaaacaaaccauuuccagaccuaaggggguggcccugcaccgccccgaugucuaucuccugccgccugcucgggagcagcuuaaccugagagagagcgccacaaucaccugucucgugacgggauucucucccgccgacguguuuguucaguggaugcagcgcggccaaccucugucccccgaaaaauacgucaccagcgcuccuaugcccgagccgcaggccccugggcgguauuucgcgcauucuauccugacagugagcgaagaggaauggaacaccggagagacauauaccugcguggucgcucacgaggcccuccccaauagagugacggaacgcacaguugauaaguccaccggcaagcccacacuguacaacgugagccuugucaugucugacaccgccgggaccugcuac

SEQ ID NO: 38878 - RNA, 657 nt, Artificial Sequence
  derived and/or modified sequence opt5 from Panobacumab_LightChain1
gacguggucaugacccagagcccccugucccucccuguuacacugggccaaccggccucuaucagcugcagauccucucagagccuuguguacuccgaugggaacacguaucugaauugguuccagcagcggcccggacaaucuccucgcagacucauuuacaaggugagcaaccgggacuccggcguccccgaucgcuuuagcgggucuggauccggcaccgacuucacacugaaaaucagcagaguggaggcugaagauguugggguguauuacuguaugcagggaacccacuggccucuuacauuuggcggcgggaccaaggucgagauuaaacggacaguggccgcgcccucuguuuucaucuuuccuccguccgacgaacagcucaagagcggaaccgcuucuguggucugccugcugaauaacuucuauccccgcgaggccaaagugcaguggaagguggauaaugcccugcaauccggcaacagccaggaauccgucacggagcaggacucuaaggauagcaccuacucccucagcucuacacugacccuuuccaaagcugacuaugagaagcauaaaguuuacgccugugaagugacacaccaggggcugagcucuccugugaccaagagcuuuaauagaggagagugc

SEQ ID NO: 38879 - RNA, 414 nt, Artificial Sequence
  derived and/or modified sequence opt5 from Panobacumab_LightChain2
ggcgacgaugaggccaccauccuggcugacaacaagugcauguguacaagagugacgagccggauuauccccuccaccgaagauccuaaugaggacauugucgaacgcaacaucagaauuguugugccgcucaauaaccgggagaauaucucugaucccacaagcccucugcgcagaaacuucguguaccaccuuuccgacgucugcaaaaagugugaucccguggaaguugagcuggaggaccagguggucaccgccacacaaucuaauaucugcaacgaagaugacggggugccugagaccuguuauauguacgaucggaauaaaugcuauacaaccaugguuccccuccgcuaccauggagaaacgaagauggugcaggcggcucugaccccugacagcuguuauccggau

SEQ ID NO: 38880 - RNA, 1359 nt, Artificial Sequence
  derived and/or modified sequence opt5 from Parsatuzumab_HeavyChain1
gaggugcagcuggucgaaagcggcgggggacucguucaacccggcgggucccugagacuuucuugcgccgcuagcggauacaccuucaucgacuauuacaugaacugggugcggcaggccccuggcaaggggcuggagugggugggagauauuaaucucgacaacuccggcacacacuauaaucagaaauuuaagggccgcuucacgaucucuagagauaaaagcaagaacaccgcguaccugcagaugaacucccuucgggcugaagacacagccgucuauuacugugcccgcgaggggguguaucaugauuacgacgauuacgcuauggacuauuggggacaaggcacccugguuacagugucuagcgccuccaccaaagggccgagcgucuuuccccucgcuccuucuuccaagagcacaucuggaggcaccgccgcgcuggggugccuggugaaggauuacuuccccgaaccuguuacgguguccuggaauagcggagcccucaccucuggcguccacacauuucccgcugugcugcaguccagcggccuuuauucccugucuagcguggucaccguuccuuccagcucucucgggacacagaccuacauuuguaaugugaaccauaaaccguccaauacgaagguggacaaaaaggucgagcccaaaagcugcgauaagacacacaccuguccucccugcccugcccccgagcugcuuggaggcccgucuguguuccuguuuccucccaagccuaaagacacacucaugaucagcagaacccccgaaguuaccuguguggucguggauguuucccaugaggaccccgaagugaaguucaacugguaugucgacgggguggagguccacaaugcuaaaacaaagccucgggaggaacaguacaacucuacguaucgcgugguuagcgugcugaccguccugcaccaagauuggcucaauggaaaagaguacaagugcaaaguguccaacaaggcccugccggcgcccauugaaaagacaaucagcaaagccaagggccagccuagagagccccagguuuacacccuuccucccucucgggaagagaugaccaaaaaucaggugucccugacaugucucgucaagggguuuuauccgagcgacaucgcuguggagugggaaucuaacggacaaccugagaacaauuacaaaacgacacccccugugcuggauuccgacggcagcuucuuucuuuauuccaagcugaccguugauaagucucgcuggcagcagggcaacgucuucagcugcuccgugaugcaugaagcccuccacaaucauuacacccaaaaaucucugagccugucccccgggaag

SEQ ID NO: 38881 - RNA, 657 nt, Artificial Sequence
  derived and/or modified sequence opt5 from Parsatuzumab_LightChain1
gacauccagaugacccaaagccccuccucucugagcgccuccgugggcgauagagucacaauuacgugccggaccucucagagccucguucacaucaacgcuauuacauaccugcauugguaucagcagaagccugggaaagccccgaaacuucugaucuaccgcguguccaauagauucucuggagugcccagccgguuuuccggcagcgggucuggaaccgacuucacacucaccauuuccagccugcaaccugaggauuuugcgacauauuacuguggccagucuacccacgucccccuuacguucgggcagggaaccaagguggaaaucaagcgcacaguugcugccccuuccguguuuaucuuucccccuagcgacgagcagcugaaaucuggcaccgccuccgucgugugccuccugaacaauuucuauccgagagaagcuaagguucaauggaagguggauaacgcccugcagagcggcaauucccaggagucugucacagaacaggacagcaaagauuccaccuacagccucucuuccacgcugacacuuagcaaggcugacuaugagaaacauaagguguacgccugugaggugacccaccaagggcugucuagccccgucacaaaauccuucaaccggggagaaugc

SEQ ID NO: 38882 - RNA, 1353 nt, Artificial Sequence
  derived and/or modified sequence opt5 from Pascolizumab_HeavyChain1
caggugacccugagagagagcggccccgcccucgucaagccuacacaaacgcugacccuuacaugcaccuucuccggguuuucucugagcacauccggaaugggcguuucuuggauccggcagccgcccgggaaaggacucgaauggcuggcucacauuuacugggacgaugacaagcgcuauaacccuagccuuaaauccagacugaccaucucuaaggauacaagccggaaucagguggugcucaccaugacgaacauggaccccgucgauaccgccacauacuauugugcgcgcagagagaccguguucuacugguauuuugacguuuggggccgggggacaccugugaccgucuccagcgcuucuacgaaaggacccuccguguucccucuggccccgagcucuaaguccacaagcggcggcaccgccgcucuggggugccucguuaaggauuacuuucccgaaccugugacagucucuuggaacuccggagcccugaccagcggcgugcauaccuuccccgcugugcuucaguccucugggcuguauagccucuccagcgucguuacagugccuucuuccagccugggaacgcaaaccuacauuuguaaugugaaucacaaacccucuaacacaaaggucgacaaacgcguggagccgaagucuugcgauaaaacccauacauguccucccugcccugcccccgaacuucugggcgggcccuccguuuuucucuucccuccgaagcccaaggacacccugaugaucucuagaacgccugaggugacaugugucgugguugaugugagccacgaggaccccgaagucaaauuuaauugguacguggauggagucgaggugcauaacgcgaagaccaaaccucgggaggaacaguauaauuccaccuaccgcguugugagcguccugacagugcuccaccaggacuggcugaacggcaaggaguauaaaugcaagguuucuaauaaagcccuucccgcuccgauugaaaagaccaucuccaaggccaaaggccagccuagagagccccaaguguacacacugccucccagccgggaagagaugacgaagaaccaggucucucucaccugucuggugaaaggguucuauccuuccgacaucgcuguggaaugggagagcaauggacagcccgagaacaauuacaagacaaccccgccuguucuugauuccgacggcagcuuuuuccuguauagcaaacucacagucgauaagucccgcuggcagcaagggaacguguuuucuugcagcgugaugcacgaagcccugcauaaccacuacacccagaagucccugagccucucucccggaaaa

SEQ ID NO: 38883 - RNA, 654 nt, Artificial Sequence
  derived and/or modified sequence opt5 from Pascolizumab_LightChain1
gacaucgugcugacccagagccccuccucucucagcgccuccgucggcgauagaguuacaauuacgugcaaggcuucucaaagcguggacuacgauggggacuccuauaugaacugguaccagcagaaaccuggaaaggccccgaaacugcuuaucuaugcggcuucuaaucuggagagcggcauucccucccgguucagcgggucuggauccggcaccgauuuuacauucaccaucagcucucuccagccugaagacauugccacauacuauugucaacaguccaacgaggaucccccuaccuuugggcagggaacaaagguggaaaucaaacgcaccgucgccgcucccagcguguucaucuuuccuccgucugacgagcagcugaaguccggcacggccagcguugugugccuucugaauaacuucuaccccagagaagcuaagguccaauggaaaguggauaaugcccuccaguccggcaacucucaggagagcguuaccgagcaggacuccaaggauagcacauauucucuguccagcacccugacacucucuaaagcggacuacgaaaagcacaaaguguacgccugugaggucacccaucaagggcugagcuccccugugacgaagucuuuuaaucggggagaaugc

SEQ ID NO: 38884 - RNA, 1512 nt, Artificial Sequence
  derived and/or modified sequence opt5 from Pasotuxizumab_HeavyChain1
caggugcaacuggucgagagcggcgggggacucguuaagcccggcgaaucccugagacuuucuugcgccgcuagcggguucaccuuuuccgacuacuauauguacugggugcggcaggccccuggaaaaggccuggaguggguggcgaucauuucugaugggggauauuacacauauuacagcgacaucauuaagggccgcuucacgaucuccagagauaacgcuaaaaauucucucuaucugcagaugaacagccuuaaggccgaagacaccgccgucuacuacugugcucggggcuuuccgcugcuccgccacggggccauggauuauuggggacagggcacacuggugaccguuuccagcgggggaggcgggucuggaggcggcggguccggaggcgggggaagcgacauucaaaugacacagucucccuccagccugucugcuuccgugggcgauagagucaccaucacaugcaaagccagccagaauguggacaccaacguugcgugguaccagcaaaagccugggcaggcccccaagucccucaucuauucugcuagcuaccgguauuccgaugugccuagccgcuucucuggauccgccagcggcacggacuuuacccugacaauuucuagcguccaguccgaggauuucgcuaccuacuauugucagcaauacgacucuuaccccuauacauuuggcgggggaaccaaacuugaaaucaagagcggcgggggaggcuccgaggugcagcugguggagagcgggggcggacucguccagccuggcgggucucugaaacuuuccugcgccgcgagcggauucacguuuaauaaguacgccaugaacuggguuagacaagcuccgggcaaagggcuggaauggguggcccggauucgcucuaaguauaauaacuacgcuacauauuacgccgauuccgugaaggacagauucaccaucagccgggacgauuccaaaaauacagccuaucuccagaugaacaaucugaagaccgaggacaccgcugucuacuacugugugcgccauggaaacuuuggcaauucuuauauuagcuacugggcguauugggggcagggcacacugguuacgguguccucuggaggcgggggaagcggcgggggaggcuccgggggcggaggcagccagaccgucgugacacaagaacccucucucaccguuuccccugggggaacagugacccugacgugcggcagcucuacaggggccgucaccuccggaaacuaccccaauugggugcagcagaaaccuggccaggcucccagagggcuuaucggcggaaccaaguuccuggccccgggcaccccugcccgguuuagcgggucucuccugggaggcaaagcugcccuuacacugagcgggguccaacccgaggaugaggcggaauauuacugugugcucugguauuccaaccgcuggguuuucggaggcggcacaaagcugacggugcugcaccaucaccaucaccac

SEQ ID NO: 38885 - RNA, 1512 nt, Artificial Sequence
  derived and/or modified sequence opt5 from Pasotuxizumab_SingleChain
caggugcaacugguccagagcggcgggggacucguuaagcccggcgagucccugagacuuucuugcgccgcuagcggguucaccuuuuccgacuacuauauguacugggugcggcaggccccuggaaaaggccuggaauggguggcgaucauuucugaugggggauauuacacauauuacagcgacaucauuaagggccgcuucacgaucuccagagauaacgcuaaaaauucucucuaucugcagaugaacagccuuaaggccgaggacaccgccgucuacuacugugcucggggcuuuccgcugcuccgccacggggccauggauuauuggggacaaggcacacuggugaccguuuccagcgggggaggcgggucuggaggcggcggguccggaggcgggggaagcgacauucagaugacacagucucccuccagccugucugcuuccgugggcgauagagucaccaucacaugcaaagccagccagaauguggacaccaacguugcgugguaccaacagaagccugggcaggcccccaagucccucaucuauucugcuagcuaccgguauuccgaugugccuagccgcuucucuggauccgccagcggcacggacuuuacccugacaauuucuagcguccaguccgaagauuucgcuaccuacuauugucaacaguacgacucuuaccccuauacauuuggcgggggaaccaaacuugagaucaagagcggcgggggaggcuccgaagugcagcugguggagagcgggggcggacucguccaaccuggcgggucucugaaacuuuccugcgccgcgagcggauucacguuuaauaaguacgccaugaacuggguuagacaggcuccgggcaaagggcuggaguggguggcccggauucgcucuaaguauaauaacuacgcuacauauuacgccgauuccgugaaggacagauucaccaucagccgggacgauuccaaaaauacagccuaucuccagaugaacaaucugaagaccgaagacaccgcugucuacuacugugugcgccauggaaacuuuggcaauucuuauauuagcuacugggcguauugggggcagggcacacugguuacgguguccucuggaggcgggggaagcggcgggggaggcuccgggggcggaggcagccaaaccgucgugacacaggagcccucucucaccguuuccccugggggaacagugacccugacgugcggcagcucuacaggggccgucaccuccggaaacuaccccaauugggugcagcagaaaccuggccaagcucccagagggcuuaucggcggaaccaaguuccuggccccgggcaccccugcccgguuuagcgggucucuccugggaggcaaagcugcccuuacacugagcgggguccagcccgaagaugaggcggaguauuacugugugcucugguauuccaaccgcuggguuuucggaggcggcacaaagcugacggugcugcaccaucaccaucaccac

SEQ ID NO: 38886 - RNA, 1341 nt, Artificial Sequence
  derived and/or modified sequence opt5 from Pateclizumab_HeavyChain1
gaggugcagcuggucgaaagcggcgggggacucguucaacccggcgggucccugagacuuucuugcgccgcuagcggauacaccuucacauccuaugugauccacugggugcggcaggccccuggcaaggggcuggagugggucggauacaacaauccguauaacgcgggcacgaauuacaacgaaaaauuuaagggccgcuucaccauuucuagcgacaaauccaagaauacagcuuaucuccagaugaacucucugagagccgaggauaccgccguguacuauuguagccggcccacaaugcuuccuugguuugcuuacugggggcagggaacccugguuacaguguccagcgccucuaccaaaggccccuccgucuucccucucgcucccagcucuaaguccacgagcgggggaaccgccgcgcugggcugccuggugaaggacuacuuuccugaaccgguuacagugucuuggaacuccggggcccucaccagcggaguccauacauuccccgcugugcugcaauccucuggccuuuauagccuguccagcguggucaccguuccuucuuccagccucggcacgcagacauacaucuguaaugugaaucacaaacccucuaacaccaagguggauaaaaaggucgagccuaaaagcugcgacaagacacauaccugucccccgugcccugcccccgagcugcuugggggaccuuccguguuucuguucccucccaagcccaaagauacccucaugauuucucgcacaccggaaguuacguguguggucguggacguuagccacgaggaucccgaagugaaguuuaauugguaugucgacggcguggagguccauaacgcuaaaaccaagccuagagaggaacaguacaauuccacauaucgggugguuagcgugcugaccguccugcaccaggauuggcucaacgggaaagaguacaagugcaaagugucuaauaaggcccugcccgcgccuaucgaaaagacaauuuccaaagccaagggacaaccccgcgagccgcagguuuauacccuuccucccagcagagaagagaugacgaaaaaccaggugucucugacaugucucgucaagggcuucuacccuuccgacaucgcuguggagugggaaagcaacgggcagcccgagaauaacuacaaaaccaccccucccgugcuggauuccgacggaucuuucuuucuuuauagcaagcugacaguugauaagucccgguggcaacagggcaaugucuuuucuugcagcgugaugcacgaagcccuccauaaccacuacacccagaaaucccugagccugucuccgggc

SEQ ID NO: 38887 - RNA, 642 nt, Artificial Sequence
  derived and/or modified sequence opt5 from Pateclizumab_LightChain1
gacauccagaugacccaaagccccuccucucugagcgccuccgugggcgauagagucacaauuacgugccgggcuucucaggccguuagcuccgcgguggcuugguaccagcagaaaccugggaaagccccgaagcuccugaucuauucugccagccaccgcuacaccggagugcccuccagauucagcggcucuggguccggaacagacuuuacccuuacaauuagcucucugcaaccugaggauuucgcuaccuauuacugucaggaauccuauagcacacccuggaccuuuggccaggggacgaaagucgagaucaagcggaccguggccgcuccuucuguuuucauuuuucccccuuccgacgaacagcucaaaagcggaacagccuccguggucugccugcuuaacaauuucuacccgcgcgaggcgaaggugcaauggaagguugauaacgcccugcagucuggcaauagccaggaauccgugaccgagcaggacagcaaagauucuacauauucccucagcucuacccugacgcugagcaaggcugacuacgagaaacauaaggucuacgccugugaagugacacaccaaggccucuccucucccgugaccaagagcuuuaacagaggggagugc

SEQ ID NO: 38888 - RNA, 1341 nt, Artificial Sequence
  derived and/or modified sequence opt5 from Patritumab_HeavyChain1
caagugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagaucaaccacucuggaagcacgaauuauaaccccucccugaagucucggguuaccauuagcguggaaacauccaaaaaucaauuuagccuuaagcugucuuccgugaccgccgcggacacagcugucuacuauugugcccgcgauaaauggaccugguacuucgaccucuggggcagaggcacacuggugaccguuagcucugccuccacgaaggggccuagcguguuuccccuggcuccuucuuccaagagcaccuccggaggcacagccgcucucgggugccuggucaaagauuauuuccccgagccugugaccguuucuuggaacagcggagcccuuacauccggcgugcauaccuuuccggcgguccugcagagcucugggcucuacucccugagcucuguggugacgguccccagcuccucucuuggaacacagaccuacaucuguaauguuaaccacaagccuagcaauacaaaaguggacaagcggguggaacccaaauccugcgauaagacccauaccuguccucccugcccggccccugagcugcucggcggccccagcgucuuccuguuuccucccaagcccaaagacacacugaugauuucucgcacgccugaggugaccuguguuguggucgaugugucccacgaagacccggagguuaaguucaacugguauguggauggggucgaagugcauaaugcuaaaacaaagcccagagaggagcaguacaacagcaccuaucgggucgugucuguucucacagugcugcaccaagacuggcuuaauggaaaagaauacaagugcaaagucuccaacaaggcccugccugcucccaucgagaagaccaucagcaaagccaagggccagccucgcgaaccccagguguauacgcucccgccuuccagagaggaaaugaccaaaaaucagguuucucugacaugucuugugaagggguuuuaccccagcgauauugcggucgagugggaguccaacggacaaccugaaaauaacuauaaaaccacacccccugugcuggacucugauggcagcuucuuucucuacuccaagcugaccguggacaagagccgguggcagcaggggaacguuuucucuugcuccgucaugcacgaggcccugcauaaucacuacacacagaaaagccucucucugucccccggaaag

SEQ ID NO: 38889 - RNA, 681 nt, Artificial Sequence; identical to SEQ ID NO: 38845
  derived and/or modified sequence opt5 from Patritumab_hinge-CH2-CH3

SEQ ID NO: 38890 - RNA, 660 nt, Artificial Sequence
  derived and/or modified sequence opt5 from Patritumab_LightChain1
gacaucgagaugacccagagccccgauucccuggccgugucucucggcgaaagagcuacaauuaacugccggagcucccaaucuguccuguacagcuccucuaaucgcaacuaucuugccugguaccagcagaauccugggcagccgcccaagcugcucaucuauugggcgagcacgagagaguccggaguuccugaccgguucagcggcucuggguccggaaccgauuuuacacugaccauuagcucucuucaagcugaagacguggccguguacuauugucagcaguacuauuccacaccccgcaccuucggccaggggacaaaagucgagaucaagagaaccguggccgcuccuagcguuuuuauuuuucccccuucugaugaacaacugaaauccggaacggccagcguggucugccuccugaacaauuucuacccgcgggaggcuaaggugcaguggaaaguugacaacgcccugcaguccggcaauucucaggagagcgugaccgaacaagauuccaaggacagcacauacucucucuccagcacccugacacuuucuaaggcggauuaugagaaacacaaggucuacgccugugaagugacccaucagggccugagcucccccgugacgaaaucuuucaaccgcggggagugc

SEQ ID NO: 38891 - RNA, 1341 nt, Artificial Sequence; identical to SEQ ID NO: 38706
  derived and/or modified sequence opt5 from Pembrolizumab_HeavyChain1

SEQ ID NO: 38892 - RNA, 654 nt, Artificial Sequence; identical to SEQ ID NO: 38707
  derived and/or modified sequence opt5 from Pembrolizumab_LightChain1

SEQ ID NO: 38893 - RNA, 1356 nt, Artificial Sequence
  derived and/or modified sequence opt5 from Perakizumab_HeavyChain1
gaggugcagcuggucgaaagcggcgggggacucguucagcccggcgggucccugagacuuucuugcgccgcuagcggauucaccuuuuccgacuacacaaugcugugggugcggcaggccccuggcaaggggcucgaguggguggcgaucauuaaaucuggaggcagcuauuccuacuauccggauucugucaagggccgcuucacgaucagcagagacaacgcuaaaaauucccuguaccuucagaugaacagccugcgggccgaagauaccgccguguauuacugugcucgcgacggggauuauggaucuuccuacggcgccauggacuacugggggcagggaacacucguuaccgugagcucugcuuccacaaagggccccagcgucuuuccucuggcccccucuuccaaaagcaccuccgggggaacagcggcccugggcugccucgugaaggauuauuucccugagcccguuaccgugucuuggaauagcggcgcucugacguccgggguccacaccuuuccugccgugcuucaaagcucuggacuguacucccucagcucuguggucacaguuccgagcuccucucugggcacccagacauauauuuguaacgugaaucauaagcccagcaacaccaaaguggacaagaaagucgaaccuaaguccugcgauaaaacgcacacaugucccccuugccccgcuccggaggccgccgggggaccuagcguguuccuuuuucccccuaagcccaaggacacccugaugaucucuagaacacccgagguuaccuguguggucguggauguuucccaugaagacccugaggugaaauucaauugguacgucgauggcguggaaguccacaacgcgaagaccaaaccgcgggaggagcaguauaauagcacauaccgcgugguuucugugcucacgguccugcaucaggacuggcugaacgggaaggaauauaaaugcaagguguccaauaaagcucuccccgccccuauugagaagaccaucagcaaggcuaaaggacaacccagagaaccucagguuuacacacugcccccgucccgggacgagcuuaccaagaaccaggugucucugacaugucucgucaaaggcuuuuacccuagcgauaucgccguggaaugggaguccaauggccagcccgagaacaauuauaagaccacgccucccgugcuggacucugaugggagcuucuuucuuuacuccaaacugacaguugacaagagccgcuggcaacagggaaacgucuucucuugcuccgugaugcacgaagcccuccacaaccauuauacccaaaagagccugucucuguccccuggcaaa

SEQ ID NO: 38894 - RNA, 645 nt, Artificial Sequence
  derived and/or modified sequence opt5 from Perakizumab_LightChain1
gacauccagaugacccaaagccccuccucucugagcgccuccgugggcgaucgggucacaauuacgugccgggcuucucaggacaucaacagcuaccucuccugguuccagcagaagccugggaaagccccgaagucucugauuguucgcgcgaauagacuuguggauggagugcccagccgguuuuccggcagcgggucuggacaagacuauucccugaccaucagcucucuccagccugaggauuucgcuacauacuauugucugcaguacgacgccuuucccccuuauaccuucggccaggggacaaaacuugaaauuaagcgcaccgucgccgcucccuccguguuuaucuucccuccgagcgaugagcaacugaaaucuggaacagccuccguugugugccuccugaacaauuuuuaccccagagaagcuaagguccaguggaagguggacaacgcccugcagagcggcaauucccaggagucuguuaccgaacaagauagcaaagacuccacguauagccucucuuccacccugacacuuagcaaggcggauuacgagaaacacaagguguacgccugugaggucacccaucagggccugucuagcccugugacaaaauccuucaacagaggggaaugc

SEQ ID NO: 38895 - RNA, 1332 nt, Artificial Sequence
  derived and/or modified sequence opt5 from Pertuzuab_HeavyChain1
gaggugcagcuggucgaaagcggcgggggacucguucaacccggcgggucccugagacuuucuugcgccgcuagcggauucaccuuuacagacuacacggauugggugcggcaggccccuggcaaggggcuggaguggguggcggacgucaaccccaauuccggaggcucuaucuauaaccagcgcuucaaaggcagauuuacccucagcguggaucgguccaagaauacacuguaccuucagaacucucugcgcgcugaagacaccgccguuuauuacugugccagaaaucucgggcccagcuucuauuuugauuacuggggacaaggcacacuggugaccgucuccagcgcuucuacaaaagggccuuccguguucccccuggccccuagcucuaaguccaccagcggaggcacggcugcccucgggugccugguuaaagacuauuuucccgagccugugaccgucucuuggaacuccggagcgcuuacaagcggcgugcacaccuucccggccgugcugcaguccucuggccucuacagccuguccagcgucguuacagugcccucuuccagccuugggacccagacguacauuuguaaugugaaccauaagccuucuaauacaaaggucgauaaaaagguggaacccaaaagcugcgacaagacccacacauguccucccugcccggcuccugagcugcucggaggccccuccguuuuucuguucccucccaaacccaaggauacccugaucucucggaccccugaggugacaugugucgugguugacgugagccaugaagauccggaggucaaguuuaacugguauguggacggggucgaagugcacaaugccaaaacgaagccccgcgaggagcaguacaacuccaccuauagaguugugagcguccucacagugcugcaucaagauuggcuuaauggaaaagaauacaagugcaaaguuucuaacaaggcucugccugcccccauugagaaaaccaucuccaaggcgaagggccagccucgggaaccccagguguauacacucccgccuagccgcgaggaaaccaaaaaucaggucucucugacgugucuugugaagggguucuaccccuccgacauugccguggagugggagagcaacggacaaccugaaaacaauuauaaaacaaccccgccuguucuggacuccgauggcagcuuuuuccucuacucuaagcugaccgucgacaaauccagauggcagcagggcaacguguucucuugcagcgugcacgaggcucugcacaaucauuacacacaaaagucccucagccugucucccgggaag

SEQ ID NO: 38896 - RNA, 639 nt, Artificial Sequence
  derived and/or modified sequence opt5 from Pertuzuab_LightChain1
gacauccagacccaaagccccuccucucugagcgccuccgugggcgauagagucacaauuacgugcaaggcuucucaggacguuagcaucgggguggccugguaccagcagaaaccuggaaaggcgccgaaacuccugauuuauuccgcuucuuaccgguauaccggcgugcccagccgcuucuccgggagcggaucuggcacagauuuuacccuuacaaucuccagccugcaaccugaggacuucgccaccuacuauugucagcaguacuauauuuaccccuacacauuugggcagggaaccaaggucgaaaucaaaagaacgguggccgcuccuucuguuuucaucuuucccccuuccgaugagcaacucaagagcggcaccgccucuguggucugccugcuuaacaauuucuauccgcgggaagcuaaggugcaguggaaaguugacaacgcccugcaguccggcaauagccaggaguccgugacagaacaagauucuaaggacagcaccuacucccucagcucuacacugacccuguccaaagcggauuaugagaagcacaaagucuacgccugugaggugacgcaucaggggcucagcucucccgugacaaagagcuuuaaccgcggagaaugc

SEQ ID NO: 38897 - RNA, 642 nt, Artificial Sequence
  derived and/or modified sequence opt5 from Pertuzumab_HeavyChain
gacauccagaugacccaaagccccuccucucugagcgccuccgugggcgauagagucacaauuacgugcaaggcuucucaggacguuagcaucgggguggccugguaccagcagaaaccuggaaaggcgccgaaacuccugauuuauuccgcuucuuaccgguauaccggcgugcccagccgcuucuccgggagcggaucuggcacagauuuuacccuuacaaucuccagccugcaaccugaggacuucgccaccuacuauugucagcaguacuauauuuaccccuacacauuugggcagggaaccaaggucgaaaucaaaagaacgguggccgcuccuucuguuuucaucuuucccccuuccgaugagcaacucaagagcggcaccgccucuguggucugccugcuuaacaauuucuauccgcgggaagcuaaggugcaguggaaaguugacaacgcccugcaguccggcaauagccaggaguccgugacagaacaagauucuaaggacagcaccuacucccucagcucuacacugacccuguccaaagcggauuaugagaagcacaaagucuacgccugugaggugacgcaucaggggcucagcucucccgugacaaagagcuuuaaccgcggagaaugc

SEQ ID NO: 38898 - RNA, 1344 nt, Artificial Sequence
  derived and/or modified sequence opt5 from Pertuzumab_LightChain
gaggugcagcuggucgaaagcggcgggggacucguucaacccggcgggucccugagacuuucuugcgccgcuagcggauucaccuuuacagacuacacgauggauugggugcggcaggccccuggcaaggggcuggaguggguggcggacgucaaccccaauuccggaggcucuaucuauaaccagcgcuucaaaggcagauuuacccucagcguggaucgguccaagaauacacuguaccuucagaugaacucucugcgcgcugaagacaccgccguuuauuacugugccagaaaucucgggcccagcuucuauuuugauuacuggggacaaggcacacuggugaccgucuccagcgcuucuacaaaagggccuuccguguucccccuggccccuagcucuaaguccaccagcggaggcacggcugcccucgggugccugguuaaagacuauuuucccgagccugugaccgucucuuggaacuccggagcgcuuacaagcggcgugcacaccuucccggccgugcugcaguccucuggccucuacagccuguccagcgucguuacagugcccucuuccagccuugggacccagacguacauuuguaaugugaaccauaagccuucuaauacaaaggucgauaaaaagguggaacccaaaagcugcgacaagacccacacauguccucccugcccggcuccugagcugcucggaggccccuccguuuuucuguucccucccaaacccaaggauacccugaugaucucucggaccccugaggugacaugugucgugguugacgugagccaugaagauccggaggucaaguuuaacugguauguggacggggucgaagugcacaaugccaaaacgaagccccgcgaggagcaguacaacuccaccuauagaguugugagcguccucacagugcugcaucaagauuggcuuaauggaaaagaauacaagugcaaaguuucuaacaaggcucugccugcccccauugagaaaaccaucuccaaggcgaagggccagccucgggaaccccagguguauacacucccgccuagccgcgaggaaaugaccaaaaaucaggucucucugacgugucuugugaagggguucuaccccuccgacauugccguggagugggagagcaacggacaaccugaaaacaauuauaaaacaaccccgccuguucuggacuccgauggcagcuuuuuccucuacucuaagcugaccgucgacaaauccagauggcagcagggcaacguguucucuugcagcgugaugcacgaggcucugcacaaucauuacacacaaaagucccucagccugucucccggg

SEQ ID NO: 38899 - RNA, 750 nt, Artificial Sequence
  derived and/or modified sequence opt5 from Pexelizumab_h5g1.1-scFv
auggccgacauccagaugacccaaagccccuccucucugagcgcuuccgugggcgauagagucacaauuacgugcggggccucugagaacaucuacggagcgcucaauugguaucagcggaagccuggcaaagcuccgaagcugcuuauuuacggggccaccaaccuggccgacggaguucccagccgcuucuccggcucugggagcggaacagauuauacccucacaaucuccagccugcagccugaagacuuugcuaccuacuauugucagaaugugcuuaacacaccccugaccuucggccaaggcacgaaaguggagauuaagagaaccgggggaggcgggucuggaggcgggggauccggcggcgggggaagccagguccagcucgugcagucuggcgccgaaguugagaaaccuggggcuuccgugaagaaggucagcugcaaagccucuggauacaucuuuuccaauuauuggauccaaugggugcggcaggcgcccggccaggggcuggaauggaugggagagauucugccuggcagcggcuccacagaguacgcccagaaguuccaagggcgcguuaccaugacagcugauaccucuacgagcacagccuacauggaacucuccagccugagaucugaggacaccgcuguguauuacugugcccgguacuuuuucggauccagcccgaacuauugguauuuugaugucuggggccaggggacacuugugaccgugucuagc

SEQ ID NO: 38900 - RNA, 345 nt, Artificial Sequence
  derived and/or modified sequence opt5 from Pexelizumab_h5g1.1VHC_+_F_Heavy_Chain_V-Region
caggugcaacugguccagagcggcgccgagguuaagaaacccggggcuuccgugaaggugucuugcaaagccagcggauacaucuucuccaacuauuggauucagugggucagacaggcgccuggccaagggcucgaauggaugggagagauccugccgggcucugggagcaccgaauacgcucagaaguuucagggacgggugacaaugacggccgacaccuccacaucuaccgccuauauggagcuuagcucccugcgcagcgaagauacagcuguuuacuauugugccagauacuucuuugggucuucccccaauugguauuucguguggggccagggcacc

SEQ ID NO: 38901 - RNA, 318 nt, Artificial Sequence
  derived and/or modified sequence opt5 from Pexelizumab_h5g1.1VHC_+_F_Light_Chain_V-Region
gacauccagaugacccaaagccccucccugucugccagcgugggcgauagagucacaauuacgugcggggcuuccgagaacaucuacggagcccucaauugguaucagcggaagccuggcaaagcgccgaagcugcuuauuuacggggcuaccaaccuggccgacggaguucccucucgcuucagcggcuccgggucuggaacagauuauacccucacaaucagcucccugcagccugaagacuuugccaccuacuauugucagaaugugcuuaacacaccccugaccuucggccaaggcacgaaaguggagauuaag

SEQ ID NO: 38902 - RNA, 1326 nt, Artificial Sequence
  derived and/or modified sequence opt5 from PF-05082566_HeavyChain1
gaggugcagcugguccaaagcggcgccgaaguuaagaaacccggggagucccucagaaucucuugcaagggaagcggcuacuccuucucuaccuauuggauuagcugggugcggcagaugccugggaaaggacuggaauggaugggcaagaucuacccgggggacuccuauacaaacuacucucccagcuuucagggacaggugacgauuuccgcugauaaaagcaucucuaccgccuaucuucaaugguccagccugaaggcgucugacacagcuauguacuauugugcccgcggcuacggcauuuucgauuacugggggcagggaacccucgucacaguguccagcgccucuaccaagggcccuuccguuuuuccccuggcuccuugcagcagauccacaucugagagcaccgccgcucuugggugucuggugaaagacuauuuccccgaaccugucacgguguccuggaauagcggagcccucaccucuggcguucacacauuuccggcggugcugcaguccagcgggcuguacucucucagcuccgucgugaccgugcccucuagcaacuucggaacacagaccuauacgugcaaugucgaucauaagccuuccaacacaaaaguugacaagaccguggagcggaaauguugcguggagugucccccuugccccgccccgccugucgcuggccccagcguguuucuguucccucccaagcccaaggauacacuuaugaucucucgcaccccugaaguuaccuguguggucguggacguuucccacgaggauccggaagugcaauuuaauugguacgucgacggcguggagguccauaacgccaaaacaaagcccagagaggaacaguucaauagcacguuucgggugguuucugugcugaccgucgugcaccaggauuggcucaacgggaaagaguauaagugcaaaguuuccaauaagggacugccugcucccaucgaaaagacaauuagcaagaccaagggccagccucgcgagccccaaguguacacacuuccgccuuccagagaagagaugaccaaaaaccaggucucucugacgugucucgugaagggguucuaucccagcgacaucgccguggagugggaauccaauggacagccugagaacaauuacaaaacaacacccccuaugcuggauucugacggcagcuuuuuccuguacuccaagcucaccguugacaaaagccgguggcaacaggggaacgucuucucuugcuccgugaugcaugaagcgcugcacaaucacuauacccagaaaagccuuucucugucccccggaaag

SEQ ID NO: 38903 - RNA, 642 nt, Artificial Sequence
  derived and/or modified sequence opt5 from PF-05082568_LightChain1
agcuacgagcugacccagcccccuuccgugucugucagcccgggccaaacagccuccaucacgugcucuggggacaacauuggagaucaguaugcucacugguaccagcagaagcccggccaaagcccuguucucgugaucuaucaggacaaaaauagacccuccgggauuccugaacgguucucuggaagcaacuccggcaauaccgccacacugaccaucagcgggacacaggcgauggaugaggcugacuacuauugugccaccuacacaggauuuggcucucuugccguguucggcgggggaaccaagcugacgguccucggccagcccaaagcugccccuuccgugacccuguuuccgcccagcucugaagaacuucaagcuaacaaggccacacugguuugccucauuuccgauuucuauccuggggcggugaccgucgccuggaaagcugacagcucucccgugaaggccggaguugaaacaaccacgccuuccaagcagagcaauaacaaauacgcugccuccucuuaccugagccugacacccgagcaguggaagucccaucgcagcuauucuugucaggugacccacgagggcuccacagucgagaaaaccguggcgccgaccgagugcagc

SEQ ID NO: 38904 - RNA, 1341 nt, Artificial Sequence
  derived and/or modified sequence opt5 from Pidilizumab_HeavyChain1
caggugcaacugguccagagcggcuccgagcucaagaaacccggggccucuguuaagaucagcugcaaggcuuccggauacaccuucacaaacuauggcaugaauugggugagacaggccccugggcagggacugcaauggaugggcuggauuaacacggacucuggggaaagcaccuacgcggaggaauuuaaaggacgguucguguuuucccuugauacaucugucaauaccgcuuaucugcagaucacaagccucaccgccgaggacacaggcauguacuucugugugcgcguuggcuaugaugcccuggacuacugggggcagggaacccuugugacggucuccagcgcuucuaccaaaggcccguccguguuuccccuggccccuagcucuaaguccacaagcgggggaaccgcugcccucggcugccugguuaaggauuauuuccccgaaccugugacagucucuuggaacuccggggcgcugaccagcggagugcacacguuucccgccgugcuccaguccucuggccuguacagccuuuccagcgucguuacagugccuucuuccagccugggcacccaaacauacauuuguaaugugaaccauaaaccgucuaauaccaaggucgacaaaagaguggagcccaagagcugcgauaaaacccacacauguccucccugcccugcucccgagcuccuugggggaccguccguuuuccuguuuccucccaagccuaaggacacgcugaugaucucucggacccccgaagugacaugugucgugguugaugugagccaugaggaccccgaagucaaauucaacugguauguggauggcgucgaggugcacaaugccaagaccaaaccucgcgaggaacaguacaacuccacauauagaguugugagcguccucaccgugcugcaucaggacuggcugaaugggaaggaguacaaaugcaagguuucuaacaaagcucucccggcccccauugaaaagacgaucuccaaggcgaaaggacagccucgggagccccaaguguauacacugccucccagccgcgaagagaugaccaagaaucaggucucucuuaccugucuggugaaaggcuuuuacccguccgauaucgccguggagugggaaagcaacgggcagccugagaauaacuauaagacaacacccccuguucucgacuccgacggaucuuucuuucuguacagcaaacuuaccgucgauaaguccagauggcaacagggcaacguguucucuugcagcgugaugcacgaagcucugcacaaucauuacacgcagaagucccucagccugucucccggcaaa

SEQ ID NO: 38905 - RNA, 639 nt, Artificial Sequence
  derived and/or modified sequence opt5 from Pidilizumab_LightChain1
gagaucgugcugacccagagccccuccucucucagcgccuccgucggcgacagaguuacaauuacgugcucugcucggagcuccgugucuuacaugcacugguuccaacagaagccugggaaagccccgaagcuguggaucuaucgcaccagcaaccuugcguccggagugcccagcagauuuucuggcuccgggagcggaacaucuuacugucugaccauuaauucccuccagccugaagauuucgcuacauauuacugccagcaacggagcucuuuuccccugaccuucggcgggggaacaaaacuugagaucaagcgcaccgucgccgccccuuccguguuuauuuuucccccuagcgacgaacagcugaaauccggcacggcuucuguugugugucuccugaacaauuucuauccgagagaggccaagguccaguggaagguggauaacgcucugcagagcggcaauucccaagaaagcguuaccgagcaggacucuaaagauuccacauacagccucucuagcacccugacacuuuccaaggccgacuaugagaaacauaagguguacgcgugcgaagucacccaccaggggcugucuagccccgugacgaaauccuucaaccggggagagugu

SEQ ID NO: 38906 - RNA, 1350 nt, Artificial Sequence
  derived and/or modified sequence opt5 from Pinatuzumab_vedotin_HeavyChain1
gaggugcagcuggucgaaagcggcgggggacucguucaacccggcgggucccugagacuuucuugcgccgcuagcggauacgaguucucccggucuuggaugaacugggugcgccaggccccuggcaaggggcuggaaugggugggaagaaucuauccgggcgacggcgauaccaauuacagcgggaaauuuaagggacgguucacaauuuccgcggacacgucuaaaaacaccgcuuaucuccagaugaauagccugcgcgccgaggauacagccgucuacuauugugcuagagacggcuccagcugggauugguacuuugacgugugggggcagggaacccuuguuacagugucuuccgccagcaccaagggccccucugucuucccucuggcucccuccagcaaaucuacauccgggggaaccgccgcgcucggcugccuggugaaggauuauuuuccugaacccguuacggugagcuggaacuccggcgcccugaccucugggguccacacauucccugcugugcuccaaagcuccggacuguacagccuuucuuccguggucaccguuccgagcucuagccugggcacacagaccuacaucuguaaugugaaccauaagcccuccaauacgaaaguggacaagaaagucgagccuaagucuugcgauaaaacacacaccugucccccuugccccgccccggagcuccuugggggaccuagcguguuucuguuucccccuaagcccaaggacacacugaugauuucccggacccccgaaguuaccuguguggucguggauguuagccaugaggacccugaagugaaauucaacugguaugucgauggcguggagguccacaaugcuaagacaaaaccgcgcgaggaacaguacaacucuacguauagagugguuuccgugcucaccguccugcaucaggacuggcugaaugggaaggaguacaaaugcaaggugagcaacaaagcccuccccgcgccuaucgaaaagacaauuucuaaggccaaaggacaaccccgggagccucagguuuauacccugcccccgucccgcgaagagaugacaaagaaucaggugagccuuaccugucuggucaaaggcuucuacccuuccgacaucgcuguggagugggaaucuaacggccagcccgagaauaacuauaagacgacaccucccgugcucgauagcgacggguccuuuuuccuguacucuaaacuuaccguugauaagagcagauggcaacagggaaacgucuuuuccugcagcgugaugcacgaagcccugcacaaucauuacacccagaagucucucucccugagcccuggcaaa

SEQ ID NO: 38907 - RNA, 657 nt, Artificial Sequence
  derived and/or modified sequence opt5 from Pinatuzumab_vedotin_LightChain1
gacauccagaugacccaaagccccuccucucugagcgccuccgugggcgauagagucacaauuacgugccggucuagccaguccaucguucacucuguggggaacaccuuccucgagugguaccagcagaagccuggaaaagcuccgaagcugcuuauuuauaaagugagcaaucgcuuuuccggcguccccagcagauucucuggguccggaagcggcacagacuuuacccugacaaucucuucccuccaaccugaagauuucgccaccuacuauuguuuucaggggagccaguuccccuacacauuuggacagggcaccaagguggagauuaaacggacgguugcggcuccuucuguguucaucuuucccccuuccgacgaacaacuuaagagcggcaccgccuccgucgugugccugcugaacaauuucuauccgcgcgaggccaagguucaguggaaaguggauaacgcucuccagucugggaauagccaggaauccgucacagagcaagacagcaaggauucuaccuacucccugagcucuacacugacccucagcaaagccgacuaugagaagcauaaaguguacgcuugugaagugacgcaccagggacuguccucucccgucacaaagagcuuuaacagaggcgagugc

SEQ ID NO: 38908 - RNA, 1023 nt, Artificial Sequence
  derived and/or modified sequence opt5 from Placulumab_chain1
gacauccagaugacccaaagccccuccucucugagcgccuccgugggcgauagagucacaauuacgugccgggcuucucaggccaucgacagcuaccuccacugguaucagcagaagccugggaaagcgccgaagcugcuuauuuacuccgcuucuaaccuggagaccggaguucccagccgcuucuccggcagcgggucuggaacagauuuuacccucacaaucuccagccugcuuccugaagacuucgccaccuauuacugucaacaggugguguggagacccuuuacauucggccaggggaccaaagucgagauuaagcggguggaaccuaaaucuuccgauaagacgcauaccugucccccuugcccggcccccgagcugcucggaggcccuagcguuuuucuguuucccccuaagcccaaagacacacugaugaucucucgcaccccggaagugacaugcgucgugguugaugugucccacgaggacccugaggucaaguuuaauugguauguggauggcguggaaguccauaacgcuaaaaccaagcccagagaggaacaguacaauagcacguaucggguuguguccgugcucacaguccugcaccaagacuggcuuaacgggaaagaguacaaguguaaggugucuaauaaagcccugccugcucccaucgagaagaccauuagcaaagccaagggacagccccgcgaaccucagguuuacacacucccgcccuccagagaugagcugaccaaaaaccaggugagccuuaccugccuggucaagggcuucuauccuucugacaucgcgguggaaugggaguccaaugggcaacccgaaaacaauuacaaaacaacgccucccguucucgauagcgacggaucuuucuuccuguauagcaagcugaccguggacaagucccgguggcagcagggcaacgucuuuucuuguagcgugaugcaugaggcccuccacaaucacuacacacaaaaaucccugagccuuucuccggggaag

SEQ ID NO: 38909 - RNA, 1023 nt, Artificial Sequence; identical to SEQ ID NO: 38908
  derived and/or modified sequence opt5 from Placulumab_HeavyChain1

SEQ ID NO: 38910 - RNA, 1341 nt, Artificial Sequence
  derived and/or modified sequence opt5 from Plozalizumab_HeavyChain1
gaggugcagcuggucgaaagcggcgggggacucguuaagcccggcgggucccugagacuuucuugcgccgcuagcggauucaccuuuuccgccuacgcgaugaacugggugcggcaagcuccuggcaaagggcuggagugggugggacgcaucagaacaaagaauaacaauuaugccacguacuaugccgacucugucaaagaucgguucaccauuagccgcgacgauuccaagaacacacucuaccugcagaugaauagccuuaaaaccgaagacacagcuguguauuacuguaccacauuuuauggcaacggcguuugggggcagggaacccuggugacggucagcuccgccagcaccaagggcccgucuguguucccccucgcuccuuccagcaagucuacauccgggggaaccgccgcgcugggcugccugguuaaagauuacuuucccgagccugugacagucagcuggaauagcggggcccucaccuccggagugcacacguuccccgcugugcugcagagcuccggccuuuacucucugagcuccgucguuacagugccuucuucuucccucggcacccaaacauauaucuguaacgugaaucauaagccgagcaacaccaaagucgacaagaaaguggaacccaagucuugcgauaagacccacacauguccucccugcccugcccccgagcuggcuggggccccgagcguuuuucuuuucccucccaaaccuaaggacacgcugaugauuuccagaacccccgaggugacaugugucgugguugaugugucucaugaagaccccgaggucaaauuuaauugguacguggauggagucgaagugcacaacgcgaagaccaaaccucgggaggagcaguauaauagcacauaccgcguuguguccguccucaccgugcugcaucaggacuggcugaacggcaaggaauauaaaugcaagguuagcaauaaggcccucccggcucccaucgagaaaacgauuucuaaggccaaagggcagccuagagaaccccaaguguacacacugccucccucccgggaugagcuuaccaagaaccaggucagccugaccugucucgugaaaggauucuauccgucugacaucgcuguggaaugggaguccaacggccagccugagaauaacuacaagacaacacccccuguucuggacagcgauggguccuuuuuccuuuacucuaagcugaccgucgacaaaagccgcuggcagcaaggaaauguguuuuccugcucugugaugcacgaagcccuccacaaccauuauacgcagaagucucugucccugagccccggcaaa

SEQ ID NO: 38911 - RNA, 657 nt, Artificial Sequence
  derived and/or modified sequence opt5 from Plozalizumab_LightChain1
gacguggucaugacccagagcccccugucccucccuguuacacugggccaaccggccucuaucagcugcaaauccucucagagccuucuggauuccgacgggaaaacguuccucaacugguuucagcagagacccggacaaucuccucggcgccugauuuaccuugugagcaagcuggauuccggcgugcccgacagauucagcgggucuggauccggcaccgauuuuacacucaaaaucagccgggucgaggcugaagacguggggguuuauuacuguuggcagggaacccacuucccuuauacauuuggccagggcacccgccuggagauuaagagaacaguggccgcgcccucugucuucaucuuuccuccguccgaugaacagcugaaaagcgggaccgcuucugugguuugccuccugaauaacuucuacccccgggaggccaaggugcaauggaaggucgacaaugcccuucaguccggaaacagccaggaauccgugacggagcaggauucuaaagacagcaccuauucccugagcucuacacucacccuguccaaggcugauuacgagaaacauaagguguaugccugugaagucacacaccaaggccuuagcucuccuguuaccaagagcuuuaaucgcggggagugc

SEQ ID NO: 38912 - RNA, 1341 nt, Artificial Sequence
  derived and/or modified sequence opt5 from Pogalizumab_HeavyChain1
gaggugcaacugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacugugugcucgcuccccgcugguauuucuccgucugggggcaaggaacacuggugaccguuagcucugcuuccacgaaaggcccuagcguguuuccccuugccccuucuuccaagagcaccuccggcgggacagcugcccugggaugccucgucaaggacuacuuccccgagccugugaccgugucuuggaacagcggcgcgcugacauccgggguccacaccuuuccggccguucugcagagcucuggacucuacucccugagcucuguggugacgguccccagcuccucucuuggcacacagaccuauaucuguaaugugaaccauaaaccuagcaauacaaagguugauaaaaagguggagcccaaauccugcgacaagacccacaccuguccucccugcccggcuccugaacugcucgggggacccagcgucuuccuguuuccucccaagcccaaagauacacuuaugauuucuagaacgccugaggugaccuguguuguggucgacgugucccaugaagauccggaggucaaguucaacugguacguggacggcguugaggugcacaaugccaaaacaaagccccgggaggaacaguauaacagcaccuaccgcgucgugucuguucugacagugcuccaucaagauuggcugaauggcaaagaauauaagugcaaagucuccaacaaggcucugccugcccccaucgagaagaccauuagcaaagcgaaggggcagccuagagaaccccagguguacacgcucccgccuucccgggaggagaugaccaaaaaucaggugucucugacaugucuuguuaagggauuuuaucccagcgacaucgccgucgaaugggaguccaacggccaaccugaaaauaacuacaaaaccacacccccugugcuggacucugaugggagcuucuuucucuacuccaagcugaccguggacaagagccgcuggcagcagggaaaugucuucucuugcuccgugaugcacgaggcccuucacaaccauuauacacagaaaagccugucucucucccccggcaag

SEQ ID NO: 38913 - RNA, 642 nt, Artificial Sequence
  derived and/or modified sequence opt5 from Pogalizumab_LightChain1
gacauccagaugacccaaagccccuccucucugagcgccuccgugggcgauagagucacaauuacgugccgggcuucucaggacaucagcaacuaccucaauugguaucagcagaaaccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacacacuucccccuaccuuugggcagggaacgaaaguggaaauuaagcgcaccguggcugcccccucugucuucaucuuuccuccguccgaugagcaacugaaaagcggcacagccucugugguuugccuccugaacaauuucuaccccagagaagcuaaggugcaguggaaggucgacaacgcccugcaguccggcaauagccaggaguccgugaccgaacaagauucuaaagacagcacauauucccucagcucuacccugacgcuuuccaaggcugauuacgagaaacauaagguuuacgccugugaggugacacaccaggggcugagcucuccugucaccaagagcuuuaaccggggagaaugc

SEQ ID NO: 38914 - RNA, 1341 nt, Artificial Sequence
  derived and/or modified sequence opt5 from Polatuzumab_vedotin_HeavyChain1
gaggugcagcuggucgaaagcggcgggggacucguucaacccggcgggucccugagacuuucuugcgccgcuagcggauacaccuucuccucuuauuggaucgagugggugcggcaggccccuggcaaggggcuggaauggauuggagagauccucccgggcggcggggacacaaacuacaaugaaauuuuuaaaggacgcgcgacguucagcgcugauaccuccaagaacacagccuaucugcagaugaauagccuuagagccgaggacaccgcuguguacuauuguacacggcgcguccccaucagacuggauuacuggggccaggggacccucgugacaguuagcuccgccagcaccaaaggaccuucuguguuuccccuggcuccuuccagcaagucuacguccggcgggaccgccgcgcugggaugccucgucaaagacuauuuccccgagccugugacaguuagcuggaacucuggcgcccugaccuccggcgugcacacauuuccggcuguccuucaaagcuccgggcuguacucucucagcuccguggugaccguccccucuucuucccugggaacgcagacauacauuuguaauguuaaccauaagccuagcaauaccaagguggauaaaaagguggaacccaaaucuugcgacaagacacacaccuguccucccugcccggccccugagcuucugggcgggcccagcgucuuccucuuuccucccaaacccaaggauacccugaugaucucccggacaccugaagugacguguguuguggucgacgugucucaugaggauccggagguuaaguucaacugguauguggacggagucgaagugcacaaugcuaaaaccaagccccgcgaggaacaguacaacagcacauauagagucguguccguucugaccgugcuccaucaggauuggcugaauggcaaagaguacaagugcaaagucagcaacaaggcccuuccugcgcccaucgaaaagacaauuucuaaggccaaggggcaaccucgggagccccagguguauacccugccgccuucccgcgaggaaaugacgaaaaaucagguuagccucacaugucuggugaagggauuuuaccccucugacaucgcugucgagugggaauccaacggccagccugagaauaacuauaaaaccacacccccugugcuugauagcgacggcuccuucuuucuguacucuaagcucaccguggacaaaagcagauggcaacaggggaacguuuucuccugcucugucaugcacgaagcccugcacaaucauuacacccagaaaagccugucccucagccccggaaag

SEQ ID NO: 38915 - RNA, 654 nt, Artificial Sequence
  derived and/or modified sequence opt5 from Polatuzumab_vedotin_LightChain1
gacauccagcugacccaaagccccuccucucucagcgccuccgugggcgauagagucacaauuacgugcaaggcuucucagagcguugacuacgagggggauuccuuccugaacugguaucagcagaaaccuggaaaggccccgaaacuucugaucuacgcggcuucuaaucucgaaagcggcgugcccucccgguuuagcgggucuggauccggcaccgacuucacacugaccauuagcucucuucaaccugaggauuuugccacauauuacugucagcaguccaacgaagacccccugaccuucgggcagggaacaaagguggagaucaaacgcaccgucgccgcuccuagcguguuuauuuuucccccuucugaugaacaacucaaguccggcacggccagcguugugugccugcugaauaacuucuauccgagagaggcuaagguccaguggaaaguggacaaugcccuccaguccggcaacucucaggagagcguuaccgaacaagauuccaaggacagcacauacucucuguccagcacccuuacacugucuaaagcggauuaugagaagcacaaaguguacgccugugaagucacccaucaggggcucagcucccccgugacgaagucuuucaaucggggagagugc

SEQ ID NO: 38916 - RNA, 1326 nt, Artificial Sequence
  derived and/or modified sequence opt5 from Ponezumab_HeavyChain1
caggugcagcugguccagagcggcgccgagguuaagaaacccggggcuuccgugaaggugucuugcaaagccagcggauacuauaccgaagcguacuauauccacugggucagacaggcuccuggccaggggcucgaguggaugggacggauugacccggccacaggcaacacgaaguacgcuccccgccugcaagauagagugaccaugacacgggacaccuccacaucuaccguuuauauggaacuuagcucccugcgcucugaggauacagcuguguacuauugugccagccucuacucccugccugucuacugggggcagggaaccacggugaccguuagcucugcuuccacaaaaggccccagcguguucccucuugcccccugcucuagauccaccagcgaaucuacagcggcccugggcugucucgucaaggacuauuuuccugagccggugaccguguccuggaauagcggggcucugacguccggaguccauacauuccccgccguucugcagucuagcggccucuacucccugagcucuguggugaccgucccuuccagcaacuuugggacacagaccuauaccugcaauguggaucacaagcccucuaacacaaaaguugacaagacgguggagcggaaauguugcgucgaauguccucccugcccggcuccucccguggccggaccuagcguuuuccuuuuuccucccaagcccaaagauacccugaugaucucccgcacaccggaggugaccugugucguggucgacgugucucaugaagaucccgagguucaauucaauugguacguggacggcgucgaggugcacaacgcgaagacaaagccuagagaggaacaguuuaauagcaccuuccggguuguguccguccucacgguggugcaucaggauuggcugaacgggaaagaauauaagugcaaaguuagcaauaagggacuucccucuuccauugagaaaacaaucagcaagaccaaaggccagccucgcgaaccccaagucuacacccugccgccuucuagagaggagaugacaaagaaccaggugucccucaccugucuggugaagggcuuuuaucccagcgacauugccgucgaaugggaguccaaugggcagccugaaaacaauuacaaaacaacgcccccuaugcuggauucugacggcagcuucuuucucuacuccaagcugaccguggacaaaucucgguggcaacagggaaacguuuucagcugcuccgugaugcacgaggcccuucacaaucauuauacacaaaagagccugucucucucccccgggaaa

SEQ ID NO: 38917 - RNA, 657 nt, Artificial Sequence
  derived and/or modified sequence opt5 from Ponezumab_LightChain1
gacguggucaugacccagagcccccugucccucccuguuacacugggccaaccggccucuaucagcugcaaguccucucagagccuucuguacuccgaugcuaaaacguaucucaacugguuccagcagagacccgggcaaucuccucggcgccugauuuaccagaucagcagacuugaccccggagugccugaucgguuuuccggcagcgggucuggaaccgacuucacacugaagauuucccgcguggaggccgaagaugucggcguguauuacugucuccaggggacccacuaucccguucuguuuggacagggcacaagacuggagaucaaacggaccguggcggcuccuagcgucuucauuuuuccgcccucugacgaacaacucaaguccggcacagccagcgugguuugccugcuuaauaacuucuacccucgcgaggccaaagugcaguggaaggucgauaaugcucugcagucugggaacucccaggaaagcgugaccgagcaagacuccaaggauucuacguauagccucuccagcacccugacacuuucuaaagccgacuacgagaagcauaaaguguacgcuugugaagucacccaccagggacuguccagccccguuacaaagucuuuuaauagaggcgagugc

SEQ ID NO: 38918 - RNA, 1362 nt, Artificial Sequence
  derived and/or modified sequence opt5 from Pritoxaximab_HeavyChain1
caggugcaacugcaggagagcggcgcugaacucgucagauccggggcuucuguucggaugagcugcaaggccuccggauacaccuucacaucuuauaacaugcacugggugaaacagacgcccggccaggggcuggaguggaucggauacauuuauccuggcaaugggggaaccaacuacauccaaaaguuuaaaggcaaggcgauucuuacagcugacaccagcuccucuacagccuauaugcagaucagcucccugaccagcgaagauucugccguguacuucuguacacgcuccccgagccauuauucuuccgaccccuacuuugauuacuggggccaggggaccacgcucaccgucagcucugaguucgcuuccacaaaaggaccuagcguguuuccccuggccccuuccucuaagagcaccuccggcgggacagcugcccuuggaugccugguuaaggacuauuuccccgaaccugugaccgucagcuggaacucuggcgcgcucacguccggggugcacacauuuccggccguucugcagagcucuggacuguacagccucuccucuguggucaccgugcccagcuccagccugggcacacaaaccuauauuuguaaugugaaucauaaaccuucuaacaccaaggucgauaaaaagguugagcccaaauccugcgacaagacacacacguguccucccugcccggcuccugagcuucugggcgggcccagcguguuccucuuuccucccaagcccaaagauacccugaugaucucuagaacaccugaagugaccugugucgugguugacgugucccaugaggauccggaagucaaguucaauugguacguggacggaguugaggugcacaacgccaaaacaaagccccgggaggaacaguauaauagcaccuaccgcgucguguccguccuuacggugcugcaccaggauuggcucaacggcaaagaguauaagugcaaaguuucuaauaaggcucugccugcccccaucgaaaagacaauuagcaaagcgaaggggcagccuagagagccccaaguguacacccugccgccuucccgggacgaacucaccaaaaaccaggucucucugacaugucuugugaagggauuuuaccccagcgauaucgccguugagugggaguccaauggccagccugaaaacaauuauaaaaccacacccccugugcuggacagcgacgggucuuucuuucucuacuccaagcugacggucgauaagagccgcuggcaacagggaaacguguucucuugcuccgugaugcaugaggcccuucacaaccauuauacccagaaaagccugucucucagccccggcaag

SEQ ID NO: 38919 - RNA, 642 nt, Artificial Sequence
  derived and/or modified sequence opt5 from Pritoxaximab_LightChain1
gacaucgugaugagccagucccacaaguucaugucuaccagcgucggcgauagaguuuccauuacaugcaaagccucucaagacguggggacggcuguggccugguaccagcagaaccccggacagagcccuaaguuucugaucuauugggcguccacccggcauacaggcgucccggaucgcuucaccgggucuggaagcggcacagacuuuacccucacaauuaccaaugugcaauccgaggaucuggcugacuacuucugucagcaguauagcucuuacccccuuacguuuggggccggaaccucccuggaacucaaaagaacaguugccgcuccuagcguguucaucuuucccccuucugaugagcagcugaaguccggcaccgccagcgucgugugccuucugaacaauuucuauccccgggaagcuaaaguucaauggaagguggacaacgcccuccagucuggcaauucccaggagagcgucacagaacaggauuccaaggacucuaccuacagccuguccagcacgcugacacucucuaaagcggauuaugagaagcacaaaguguacgccugugaggugacccaucaagggcuguccagcccugucacaaagucuuuuaaccgcggagaaugc

SEQ ID NO: 38920 - RNA, 1350 nt, Artificial Sequence
  derived and/or modified sequence opt5 from Pritumumab_HeavyChain1
gaggugcaacugcucgaaagcggcggggaccugguccaacccggaggcucccuuagacugucuugcgccgcuagcggguucaccuuuuccaacuacgccaugucuuggguucggcaggcgccuggaaagggccucgagugggugagcgcuaucacaccguccgggggaucuacgaauuaugccgauagcgugaaaggccgcuucaccauuuccagagacaacagccagaauacacuguaccuucagaugaacucucugcgggucgaagauaccgccguguauaucuguggccgcguucccuacagauccacaugguauccucucuacugggggcaaggaacccuggugacagucagcucugcuuccaccaagggccccagcguguuuccucuggcccccucuuccaaaagcacguccgggggaaccgcugcccucggcugccugguuaaggacuauuucccugagccggugacagucucuuggaauagcggggcgcuuaccuccggagugcacacauuucccgccgugcugcagagcucuggccucuacucccugagcucugucguuaccgugccuagcuccucucuuggcacgcagacauacauuuguaacgugaaucauaaacccagcaacaccaaggucgauaagaaaguggaaccuaaguccugcgacaaaacacacaccugucccccgugcccugcucccgagcugcucgggggaccuagcguuuuccuguuuccgcccaagccuaaagauacccugaugaucucucggacaccggaggugacgugugucgugguugacgugucccaugaagaucccgaggucaaguucaauugguauguggacggcgucgaagugcacaacgccaagaccaaaccucgcgaggagcaguacaauagcacauauagaguugugucuguccucaccgugcugcaucaagauuggcuuaacgggaaggaauacaaaugcaagguuuccaauaaagcucugcccgccccuauugagaagacaaucagcaaagcgaagggacagccccgggaaccccagguguauacccucccucccucccgcgacgagcugacgaagaaccaggucucucuuacaugucuggugaaaggcuuuuacccuagcgauaucgccguggaaugggaguccaaugggcaacccgagaacaacuauaagaccaccccucccguucucgacucugacggcagcuucuuucuguacuccaaacugacagucgauaagagcagauggcagcagggaaauguguucucuugcuccgugaugcacgaagcucuccacaaccauuacacccagaaaagccugucucuuuccccgggcaag

SEQ ID NO: 38921 - RNA, 642 nt, Artificial Sequence
  derived and/or modified sequence opt5 from Pritumumab_LightChain1
gacauccagaugacccaaagccccuccucucugagcgccuccgugggcgaucgggucacaauuacgugccgggcuucucaggacaucagcaacuaccucgccugguuccagcagaagccugggaaagcgccgaagucccugauuuaugcugccucuagccuucacuccaaaguucccacccaauuuagcggaucuggcuccgggacagauuucacccugacaaucagcucucuccagccugaggacuuugccaccuacuauugucugcaguacuccacauaucccauuaccuucggaggcgggacgaagguggaaaucaaacgcaccguggcugccccuagcgucuuuaucuuucccccuucugaugagcagcuuaaguccggaacagcuagcgugguuugccugcucaauaacuucuacccgagagaagccaaggugcaauggaaagucgacaaugcgcugcaguccggcaacucucaggagagcgugaccgaacaggauuccaaggacagcacauauucucuguccagcacccucacgcugucuaaagccgauuacgagaagcauaaaguuuacgcuugugaggugacacaccaaggccuuagcucccccgucaccaagucuuucaauagaggggaaugc

SEQ ID NO: 38922 - RNA, 1341 nt, Artificial Sequence
  derived and/or modified sequence opt5 from Quilizumab_HeavyChain1
gaggugcagcuggucgaaagcggcgggggacucguucaacccggcgggucccugagacuuucuugcgccgcuagcggauucaccuuuuccgacuacggcaucgccugggugcggcaggcgccugggaagggacuggaguggguggcuuucauuucugaucucgccuauacaaucuacuaugccgacacggucaccggccgcuuuacaauuagcagagauaacuccaaaaauacccuguaccuucagaugaacucucugcgggcugaagacacagccguguauuacugugcucgcgauaauugggacgccauggauuauuggggccaggggacccucguuacagugagcuccgcgagcaccaagggaccgucugucuucccccuggccccuuccagcaaaucuacguccggcgggaccgcugcccugggaugccucgugaaggacuacuuucccgagccuguuacagugagcuggaacucuggcgcucugaccuccgggguccacacauuccccgccgugcuucaaagcuccggacuguacucucucagcuccguggucaccguuccuucuagcucccugggcacgcagacauauaucuguaaugugaaccauaaaccgagcaauaccaagguggauaagaaagucgaacccaagucuugcgacaaaacacacaccuguccucccugcccugcgcccgagcuucugggcgggccgagcguguuucucuucccucccaagccuaaagauacccugaugauuuccagaacacccgagguuacguguguggucguggacguuucucaugaagaucccgaggugaaguuuaacugguacgucgacggaguggaaguccacaaugccaagaccaaaccucgggaggagcaguauaacagcacauaccgcgugguuuccgugcugaccguccuccaucaggacuggcugaauggcaaggaauauaaaugcaaggugagcaacaaagcccuuccggcucccaucgagaagacaaucucuaaagcuaaggggcaaccuagagaaccccagguuuacacccugccucccucccgggaggaaaugacgaagaaucaggugagccucacaugucuggucaaaggauucuauccgucugauauugccguggagugggaguccaacggccagccugaaaauaacuacaagaccacacccccugugcuugacagcgauggguccuuuuuccuguacucuaaacucaccguugacaagagccgcuggcaacagggaaacgucuuuuccugcucugugaugcacgaggcccugcacaaucauuauacccagaaaagccugucccucagccccggcaag

SEQ ID NO: 38923 - RNA, 657 nt, Artificial Sequence
  derived and/or modified sequence opt5 from Quilizumab_LightChain1
gacauccagaugacccaaagccccuccucucugagcgccuccgugggcgauagagucacaauuacgugccggucuagccagucccucguucacaacaaugcuaacaccuaccugcauugguaucagcagaagccugggaaagccccgaaacuucugaucuacaaggugucuaaucgcuucagcggagugcccuccagauuuagcggcucuggguccggaacagacuucacccucacaauuagcucucugcaaccugaggauuuugcgaccuauuacuguucccagaacacacuuguccccuggaccuucggccaggggacgaagguggaaaucaaacggaccguugcugccccuagcguguuuauuuuucccccuucugacgagcagcugaaguccggaacagccagcgucgugugccuccugaauaacuucuauccgcgcgaagcuaagguucaauggaaaguggauaaugcccugcaguccggcaacucucaggagagcgucaccgaacaggacuccaaggauagcacauacucucucuccagcacccugacgcuuucuaaagcugacuaugagaagcacaaaguguacgccugugaggugacacaucaaggccugagcucccccgucaccaagucuuucaauagaggggaaugc

SEQ ID NO: 38924 - RNA, 1335 nt, Artificial Sequence
  derived and/or modified sequence opt5 from Racotumomab_HeavyChain1
caggugcaacugcagcagagcggcgccgagcucgucaagcccggggcuuccguuaaacugucuugcaaggccagcggauacaccuucacauccuaugacaucaacugggugagacagcggccugaacaaggccuugaguggauuggguggaucuuuccgggagauggcucuacgaaauacaaugaaaaguucaaagggaaggcgacccugacaaccgacaagagcuccucuacagcuuauaugcagcucagccgccugaccuccgaggauagcgccguguacuuuugugccagagaagacuauuacgauaacucuuauuacuucgacuacuggggacagggcacaacccuuacggucuccagcgcuaaaaccacacccccuucuguguauccccuggccccuggcuccgcugcccagaccaauagcaugguuacacucgggugccuggugaagggauacuuucccgagccugucaccgugacguggaacucuggcucccugagcuccgggguucacacauucccggcggugcuccaaucugaucuguauacccuuagcuccagcgucacagugcccucuuccccucggcccagcgagaccgugaccuguaaugucgcccauccugcuucuagcacaaaaguugacaagaaaauugugccccgcgauugcggauguaagccgugcaucuguacggugccugaagucuccucuguguuuauuuuucccccuaagcccaaagacguucugaccaucacacucacccccaaggugacaugcgucgugguugauaucagcaaagacgauccugaggugcaguucuccugguucgucgacgacguggaaguccacaccgcccagacgcagccgagagaggagcaauuuaacagcacauuccggucuguguccgaacugcccauuaugcaucaggauuggcuuaauggcaaggaguuuaaaugucgcguuaacagcgcugccuucccugcgcccaucgaaaagaccauuucuaaaaccaaggggagaccuaaggcuccccagguguacacaaucccgccucccaaagagcaaauggccaaggacaaagucucccugaccugcaugauuacagauuucuuuccugaagacaucacgguggaguggcaguggaauggacagcccgccgagaacuauaagaauacccagccuauuaugaacacaaauggcagcuacuucguuuauuccaaacucaacgugcaaaagucuaauugggaagcuggcaacaccuuuacauguagcguccugcacgaggggcugcauaaccaccacaccgaaaagucccucucucauagccccggaaaa

SEQ ID NO: 38925 - RNA, 642 nt, Artificial Sequence
  derived and/or modified sequence opt5 from Racotumomab_LightChain1
gacauccagaugacccaaacaacgagcagccugucugccagccucggcgauagagugaccauuuccugccgggcuucucaggacaucagcaacuaccugaauugguaucagcagaagcccgaugggacagucaaacuucugauuuacuauaccucccgccuccacucuggaguuccuagcagauucuccggcagcgggucuggaacagacuacucccugaccaucagcaaccuugagcaagaagauauugccacauauuuuugucagcagggcaauacccugccguggacguucgggggaggcaccaagcucgagaucaaacgggcggacgcugcccccacagugucuaucuuuccucccuccagcgaacagcugaccucuggcggggccuccguggucugcuuccugaacaauuuuuacccuaaggauauuaacgugaaauggaagaucgacggaagcgagcgccaaaauggcguucucaacuccuggacagaucaggacucuaaggauagcaccuauuccaugagcucuacgcugacacuuaccaaagacgaauacgagagacauaauuccuacacaugugaggcuacccacaagaccagcacaucucccauugugaaauccuucaaccggaaugaaugc

SEQ ID NO: 38926 - RNA, 1089 nt, Artificial Sequence; identical to SEQ ID NO: 38864
  derived and/or modified sequence opt5 from Racotumomab_scVH-VH'-VH_chain

SEQ ID NO: 38927 - RNA, 1071 nt, Artificial Sequence
  derived and/or modified sequence opt5 from Radretumab_HeavyChain1
gaggugcagcugcucgaaagcggcgggggacugguccaacccggcgggucccuuagacugucuugcgccgcuagcggauucaccuuuuccucuuucagcauguccuggguucggcaggccccuggcaaggggcucgagugggugucuagcaucuccggaagcucuggcacaacguacuaugcggacuccgugaaaggccgcuuuaccauuagcagagauaacucuaagaauacacuguaccuucagaugaacucccugcgggcugaagacaccgccgucuauuacugugccaaaccguuccccuauuuugauuacugggggcagggaacacucgugaccguuagcucuggcgacggguccagcggaggcuccgggggagcuucugagaucgugcugacacaaagcccuggcacccugucccucagccccggcgaacgcgccacgcugucuugcagagcuucccagagcgucucuagcuccuuccuugccugguaucagcagaagccugggcaagcgccccggcugcucauuuacuacgccucuagccgcgcuaccggaaucccugauagauuuuccggcagcgggucuggaacagacuucacccugacaauuucccggcuugagccggaggauuuugccguguauuacugucagcagaccggccgcauucccccuacguucgggcagggaacaaaaguugaaaucaagagcggcggcucugggggacccagagcugccccugagguguaugcguuugccacccccgaauggccgggcucccgggacaagcgcacacuggcuugccucauccaaaauuucaugccugaggauaucagcguccaguggcugcacaacgaggugcagcugcccgacgccagacauuccaccacccaaccucggaaaacaaaggggucuggauuuuucguguucagccgccucgaagucacgagagcugagugggaacagaaagaugaguuuauuugucgggccguucacgaagccgcuucccccucucagaccgugcagagagcggugagcgucaaucccgaguccagccgccggggcgggugc

SEQ ID NO: 38928 - RNA, 414 nt, Artificial Sequence; identical to SEQ ID NO: 38879
  derived and/or modified sequence opt5 from Radretumab_j_chain

SEQ ID NO: 38929 - RNA, 1368 nt, Artificial Sequence
  derived and/or modified sequence opt5 from Rafivirumab_HeavyChain1
caggugcaacugguccagagcggcgcugagguuaagaaacccggguccucugugaaggugagcugcaaggcuuccggaggcaccuucaacagauacacagucaauugggugcggcaggccccugggcagggacucgaauggaugggcgggaucauuccgaucuuuggaacggcgaacuaugcucaacgcuuccagggcagacugaccauuacagccgacgagucuaccagcacagccuacauggaacuuuccucucugcggagcgaugacaccgcuguuuauuuuugugcccgcgagaaucucgauaacuccggcacauacuauuacuucagcgggugguuugaccccuggggacagggcacccuggugacggucucuuccgcuagcaccaaagggccuucuguguucccccuugccccuuccagcaaaucuacauccggaggcaccgcggcccuggggugccucguuaaggauuauuuucccgaaccugugacagucagcuggaacuccggagcucugaccucuggcgugcacacguucccggccgugcugcagagcuccggccucuacagccugucuuccgucguuacagugcccagcucuagccuugggacccaaacauacaucuguaaugugaaucauaagccuuccaacaccaaagucgacaagagaguggagcccaaaucuugcgauaagacccacacauguccucccugcccggcuccugagcugcucggaggccccagcguuuuucuguucccucccaaacccaaggacacgcuuaugauuucccggaccccugaagugacaugugucgugguugaugugagccaugaggacccggaagucaaguuuaauugguauguggauggggucgaggugcacaacgccaaaaccaagccccgcgaggaacaguacaauucuacauauagaguuguguccguccugaccgugcuccaucaggacuggcugaacggaaaagaguacaagugcaaaguuagcaauaaggcgcugccugcccccaucgagaaaacgaucucuaaggcuaagggccagccucgggaaccccaaguguauacacucccgccuucccgcgaagagaugaccaaaaaccaggucagccugaccugucuugugaagggguucuaccccuccgauauugccguggagugggaaucuaauggacagccugagaacaacuauaaaacaacacccccuguucuggacagcgacggcuccuuuuuccucuacucuaagcugaccgucgauaaaagcagauggcaacagggcaauguguucuccugcagcgugaugcacgaagcccuucacaaccauuacacgcagaagucucugucccucagccccggg

SEQ ID NO: 38930 - RNA, 1368 nt, Artificial Sequence
  derived and/or modified sequence opt5 from Rafivirumab_HeavyChain
gaggugcagcugguccaaagcggcgcugaaguuaagaaacccggguccucugugaaggugagcugcaaggcuuccggaggcaccuucaacagauacacagucaauugggugcggcaggccccugggcagggacucgaguggaugggcgggaucauuccgaucuuuggaacggcgaacuaugcucagcgcuuccaaggcagacugaccauuacagccgacgaaucuaccagcacagccuacauggagcuuuccucucugcggagcgaugacaccgcuguuuauuuuugugcccgcgaaaaucucgauaacuccggcacauacuauuacuucagcgggugguuugaccccuggggacagggcacccuggugacggucucuuccgcuagcaccaaagggccuucuguguucccccuugccccuuccagcaaaucuacauccggaggcaccgcggcccuggggugccucguuaaggauuauuuucccgagccugugacagucagcuggaacuccggagcucugaccucuggcgugcacacguucccggccgugcugcagagcuccggccucuacagccugucuuccgucguuacagugcccagcucuagccuugggacccagacauacaucuguaaugugaaucauaagccuuccaacaccaaagucgacaagagaguggagcccaaaucuugcgauaagacccacacauguccucccugcccggcuccugaacugcucggaggccccagcguuuuucuguucccucccaaacccaaggacacgcuuaugauuucccggaccccugaggugacaugugucgugguugaugugagccaugaagacccggaggucaaguuuaauugguauguggauggggucgaggugcacaacgccaaaaccaagccccgcgaggaacaauacaauucuacauauagaguuguguccguccugaccgugcuccaucaggacuggcugaacggaaaagaauacaagugcaaaguuagcaauaaggcgcugccugcccccaucgagaaaacgaucucuaaggcuaagggccagccucgggaaccccagguguauacacucccgccuucccgcgaggagaugaccaaaaaccaagucagccugaccugucuugugaagggguucuaccccuccgauauugccguggaaugggagucuaauggacagccugaaaacaacuauaaaacaacacccccuguucuggacagcgacggcuccuuuuuccucuacucuaagcugaccgucgauaaaagcagauggcagcaaggcaauguguucuccugcagcgugaugcacgaggcccuucacaaccauuacacgcagaagucucugucccucagccccggg

SEQ ID NO: 38931 - RNA, 654 nt, Artificial Sequence
  derived and/or modified sequence opt5 from Rafivirumab_LightChain1
cagagcgcccugacccaacccagauccgugucuggcagcccugggcaguccgucacaaucucuugcacgggaaccagcuccgacauuggcggguacaacuucguuucuugguaucagcagcacccgggaaaggcucccaaacucaugaucuacgaugccacaaagcggccuagcggcgugcccgaccgcuuuuccgggagcaaaucuggaaauaccgcgucccugacaauuagcggccuucaagcugaggaugaagccgacuauuacuguugcucuuaugccggcgauuacaccccugggguggucuucggaggcgggacaaagcugaccgugcucggacagcccaaagcugccccuuccguuacgcuguuuccgcccagcucugaggaacuucaggcuaacaaggccacccuggugugucucaucuccgacuucuauccuggcgcggucacaguggccuggaaggcugauagcucccccguuaaagccgggguggagaccacaaccccuucuaagcagagcaauaacaaauacgcugccuccagcuaccugucucugacgcccgaacaauggaagucccauagaagcuauucuugccaggucacacacgagggaagcaccguggagaaaacaguggcgccgaccgaauguucc

SEQ ID NO: 38932 - RNA, 654 nt, Artificial Sequence
  derived and/or modified sequence opt5 from Rafivirumab_LightChain
gagagcgcccugacccagcccagauccgugucuggcagcccugggcaauccgucacaaucucuugcacgggaaccagcuccgacauuggcggguacaacuucguuucuugguaucagcagcacccgggaaaggcucccaaacucaugaucuacgaugccacaaagcggccuagcggcgugcccgaccgcuuuuccgggagcaaaucuggaaauaccgcgucccugacaauuagcggccuucaggcugaagaugaggccgacuauuacuguugcucuuaugccggcgauuacaccccugggguggucuucggaggcgggacaaagcugaccgugcucggacaacccaaagcugccccuuccguuacgcuguuuccgcccagcucugaagaacuucaggcuaacaaggccacccuggugugucucaucuccgacuucuauccuggcgcggucacaguggccuggaaggcugauagcucccccguuaaagccgggguggaaaccacaaccccuucuaagcagagcaauaacaaauacgcugccuccagcuaccugucucugacgcccgagcaguggaagucccauagaagcuauucuugccaagucacacacgagggaagcaccguggagaaaacaguggcgccgaccgaguguucc

SEQ ID NO: 38933 - RNA, 1332 nt, Artificial Sequence
  derived and/or modified sequence opt5 from Ralpancizumab_HeavyChain1
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaugggagagauccauccgucuggcgggcggacgaacuauaaugaaaaguuuaaaagccgcgugaccaugacaagagacaccuccacaucuaccguuuacauggagcugagcucccuucggagcgaagauacagcuguguauuacugugcccgcgagagaccccuguaugccucugaccucuggggacaaggcaccacggucaccguguccagcgcuucuacaaagggcccuuccguuuucccccuggccccuugcagccggucuaccuccgagagcacagcugcccuugggugucuggugaaggauuacuuucccgaaccugucaccguguccuggaacucuggagcgcucacgagcggcgugcacacauucccggccguccugcaguccagcgggcuguacucucucuccagcguugugaccgugcccucuagcaauuuuggaacacagaccuauaccugcaacgucgaccauaaaccuuccaauacaaagguggauaaaacgguugagcgcaaguguugcguggaaugucccccuugccccgcuccgccugucgccggccccucuguguuccuguuuccucccaaacccaaggacacccuuaugauuagcagaacaccugagguuaccuguguggucguggaugucucccacgaggacccggaagugcaguucaacugguacguugaugggguggagguccauaaugcuaagacaaaaccccgggaggaacaauuuaacagcaccuuccgcgugguuucugugcugacggucgugcaccaggacuggcucaauggaaaggaauauaaaugcaagguguccaacaaaggccugccuagcucuaucgagaagacaauuuccaaaaccaagggccagcccagagagccucagguuuacacccuucccccgagccgggaagagaugacaaagaaucaagucucccugaccugucucgugaaaggguuuuauccuucugauaucgccguggaaugggagagcaacggacagcccgaaaauaacuacaagacaacgccucccaugcuggacuccgauggcucuuucuuucuguauagcaaacucaccgucgacaagucccgcuggcagcaagggaauguguucagcugcucuguuaugcacgaggcgcugcauaaccacuacacacagaaaucccuuagccugucuccuggaaag

SEQ ID NO: 38934 - RNA, 642 nt, Artificial Sequence
  derived and/or modified sequence opt5 from Ralpancizumab_LightChain1
gacauccagaugacccaaagccccuccucucugagcgccuccgugggcgaucgggucacaauuacgugcaaggcuucucaggacguucacaccgccguggcgugguaccagcagaaaccugggaaggcuccgaaacuccugaucuaucaugccagcuaccgguauacaggagugcccucccgcuucucuggcagcggguccggaaccgauuuuacauucaccauuagcucucuucaaccugaggacaucgccacauacuauugucagcagagauacucccuguggcggaccuuuggccaggggacgaagcucgaaauuaaacgcaccgucgcugcccccagcguguucaucuuuccucccucugaugagcaacugaaguccggaacagcuagcguugugugccuucugaacaauuucuauccuagagaagccaagguccaguggaaaguggacaacgcgcuccagucuggcaauucccaggagagcguuaccgaacaagauuccaaggacucuacauacagccuguccagcacccugacgcucucuaaagccgauuacgagaagcacaaaguguaugcuugugaggucacacaucagggccuguccagcccggugaccaagucuuuuaacagaggggaaugc

SEQ ID NO: 38935 - RNA, 1338 nt, Artificial Sequence
  derived and/or modified sequence opt5 from Ramucirumab_HeavyChain1
gaggugcagcugguccaaagcggcgggggacucguuaagcccggcgggucccugagacuuucuugcgccgcuagcggauucaccuuuuccucuuacagcaugaacugggugcggcaggccccuggcaaagggcuggaauggguguccucuaucagcuccucuagcuccuauauuuacuaugcggacagcgucaagggacgcuucacaaucucuagagauaaugcuaaaaacucccucuaccugcagaugaauagccuucgggccgaggacacggccguguauuacugugcucgcguuaccgaugccuuugacauuuggggccagggcacaauggugaccgucucuuccgcuagcacaaaggggccguccguguucccccuggccccuucuagcaaauccaccagcggaggcacagcggcccucgggugccugguuaaggauuauuuucccgaaccugugaccgucucuuggaacuccggagcucugacgagcggcgugcacaccuuccccgccgugcuccaaucuagcgggcuguacucccuuucuagcgucguuacagugccuuccagcucucugggaacccagacauacaucuguaaugugaaccauaagccguccaauaccaaagucgacaagaaaguggagcccaagagcugcgauaaaacgcacacauguccucccugcccugcucccgaacuccugggcggcccgucuguuuuucuuuucccucccaagccuaaggacacccugaugauuuccagaacacccgaggugaccugugucgugguugaugugagccaugaggaccccgaagucaaauuuaacugguauguggauggggucgaggugcacaaugccaagaccaaaccucgggaggaacaguacaacuccacauaucgcguugugucuguccucacggugcugcaucaggacuggcugaauggaaaggaguacaaaugcaagguuagcaacaaagcgcucccggcccccaucgaaaagaccaucuccaaggcuaaaggccaaccuagagagccccagguguauacacugccucccucucgggaagagaugaccaagaaucaggucagccuuacaugucuggugaaaggguucuacccguccgauauugccguggaaugggagagcaacggacagccugagaauaacuauaagaccacgcccccuguucucgacucugacggcuccuuuuuccuguacagcaaacuuacagucgauaagucucgcuggcaacaggggaacguguuuuccugcagcgugaugcacgaagcucugcacaaucauuacacccagaagucucucagccugucccccggaaaa

SEQ ID NO: 38936 - RNA, 642 nt, Artificial Sequence
  derived and/or modified sequence opt5 from Ramucirumab_LightChain1
gacauccagaugacgcaaagccccuccucugugagcgccuccauuggcgauagagucacaaucacgugccgggcuucucaggggauugacaacuggcugggaugguaccagcagaagccuggcaaagccccgaagcuccugaucuaugaugcgagcaaucuugacaccgggguucccucccgcuucucuggaagcggcuccgggacauacuuuacccugacaauuagcucucuccaagcugaggauuucgccguguauuuuugucagcaggccaaggcuuucccucccaccuuuggaggcggcacaaaaguggacaucaaagggaccgucgccgcuccuuccguguucaucuuucccccuagcgaugaacagcugaagucuggaacggccuccguugugugccuucugaacaauuucuacccgagagaggcgaagguccaauggaaaguggacaacgcccuccagagcggcaauucucaggaauccguuaccgagcaggauagcaaggacuccacauauucucugagcuccacccugacacucagcaaagcugauuacgaaaagcacaaaguguaugccugugaggucacccaucaagggcugucuucccccgugaccaagagcuuuaaccggggagagugc

SEQ ID NO: 38937 - RNA, 687 nt, Artificial Sequence
  derived and/or modified sequence opt5 from Ranibiziuab_HeavyChain1
gaggugcagcuggucgaaagcggcgggggacucguucaacccggcgggucccugagacuuucuugcgccgcuagcggauacgacuucacccacuauggcaacugggugcggcaggccccugggaagggacuggagugggugggcuggaucaauacauacacgggcgaaccgaccuaugcggcugauuuuaaacgcagauucacauuuucccucgacaccucuaagagcacagccuaccugcagaacucccuucgggccgaggauaccgcugucuauuacugugccaaauaucccuacuacuaugggacaucucauugguacuucgacguguggggacagggcacccugguuacggugagcuccgcuagcaccaaggggccuucugucuuuccccucgccccuuccagcaaaucuacauccggaggcaccgcggcccuggggugccuggugaaggauuauuuccccgaaccuguuacagugagcuggaauagcggagcucucaccuccggcguccacacguuuccggccgugcugcaaagcuccggccuuuacucucugagcuccguggucacaguucccucuucuucccucgggacccagacauauauuuguaacgugaaucauaagccuagcaacaccaaaguggacaagaaagucgagcccaagucuugcgauaaaacccaccug

SEQ ID NO: 38938 - RNA, 642 nt, Artificial Sequence
  derived and/or modified sequence opt5 from Ranibiziuab_LightChain1
gacauccagcugacccaaagccccuccucucucagcgccuccgugggcgaucgggucacaauuacgugcucugcuagccaggacaucuccaacuaccugaauugguaucagcagaaaccugggaaagccccgaagguucuuauuuacuucaccucuagccugcacuccggagugcccagccgguuuucuggcuccgggagcggaacagauuucacccucacaaucucuucccugcaaccugaggacuuugcgaccuauuacugucagcaguauagcacagugcccuggaccuucggccaggggacgaaagucgaaauuaagcgcaccguggcugccccuucuguuuuuaucuuucccccuuccgaugagcaacuuaaaagcggaacagccuccguggucugccugcucaacaauuucuacccgagagaagcuaaggugcaguggaagguugacaacgcccugcagucuggcaauagccaggaguccgugaccgaacaagauagcaaagacucuacauauucccugagcucuacccucacgcugagcaaggcugauuacgagaaacauaaggucuacgccugugaggugacacaccagggccuuuccucucccgugaccaagagcuucaacagaggggaaugc

SEQ ID NO: 38939 - RNA, 639 nt, Artificial Sequence
  derived and/or modified sequence opt5 from Ranibizumab_fab_fragment
gacauccagcugacccaaagccccuccucucucagcgccuccgugggcgaucgggucacaauuacgugcucugcuagccaggacaucuccaacuaccugaauugguaucagcagaaaccugggaaagccccgaagguucuuauuuacuucaccucuagccugcacuccggagugcccagccgguuuucuggcuccgggagcggaacagauuucacccucacaaucucuucccugcaaccugaggacuuugcgaccuauuacugucagcaguauagcacagugcccuggaccuucggccaggggacgaaagucgaaauuaagcgcaccguggcugccccuucuguuuuuaucuuucccccuuccgaugagcaacuuaaaagcggaacagccuccguggucugccugcucaacaauuucuacccgagagaagcuaaggugcaguggaagguugacaacgcccugcagucuggcaauagccaggaguccgugaccgaacaagauagcaaagacucuacauauucccugagcucuacccucacgcugagcaaggcugauuacgagaaacauaaggucuacgccugugaggugacacaccagggccuuuccucucccgugaccaagagcuucaacagaggggaa

SEQ ID NO: 38940 - RNA, 693 nt, Artificial Sequence
  derived and/or modified sequence opt5 from Ranibizumab_HeavyChain
gaggugcagcuggucgaaagcggcgggggacucguucaacccggcgggucccugagacuuucuugcgccgcuagcggauacgacuucacccacuauggcaugaacugggugcggcaggccccugggaagggacuggagugggugggcuggaucaauacauacacgggcgaaccgaccuaugcggcugauuuuaaacgcagauucacauuuucccucgacaccucuaagagcacagccuaccugcagaugaacucccuucgggccgaggauaccgcugucuauuacugugccaaauaucccuacuacuaugggacaucucauugguacuucgacguguggggacagggcacccugguuacggugagcuccgcuagcaccaaggggccuucugucuuuccccucgccccuuccagcaaaucuacauccggaggcaccgcggcccuggggugccuggugaaggauuauuuccccgaaccuguuacagugagcuggaauagcggagcucucaccuccggcguccacacguuuccggccgugcugcaaagcuccggccuuuacucucugagcuccguggucacaguucccucuucuucccucgggacccagacauauauuuguaacgugaaucauaagccuagcaacaccaaaguggacaagaaagucgagcccaagucuugcgauaaaacccaccug

SEQ ID NO: 38941 - RNA, 654 nt, Artificial Sequence
  derived and/or modified sequence opt5 from Ranibizumab_LightChain
gaggugcagcuggucgaaagcggcgggggacucguucaacccggcgggucccugagacuuucuugcgccgcuagcggauacgacuucacccacuauggcaugaacugggugcggcaggccccugggaagggacuggagugggugggcuggaucaauacauacacgggcgaaccgaccuaugcggcugauuuuaaacgcagauucacauuuucccucgacaccucuaagagcacagccuaccugcagaugaacucccuucgggccgaggauaccgcugucuauuacugugccaaauaucccuacuacuaugggacaucucauugguacuucgacguguggggacagggcacccugguuacggugagcuccgcuagcaccaaggggccuucugucuuuccccucgccccuuccggaacagcggcccugggcugccuggugaaagauuauuuccccgaaccuguuaccgugagcuggaacucuggggcucucacauccggaguccacaccuuuccggccgugcugcaaagcucuggccuuuacucccugagcuccguggucacgguucccucuagcucccucggcacacagaccuauauuuguaaugugaaucauaagccuagcaacacaaagguggacaaaaaggucgagcccaaa

SEQ ID NO: 38942 - RNA, 642 nt, Artificial Sequence; identical to SEQ ID NO: 38938
  derived and/or modified sequence opt5 from Ranibizumab_LightChain_variant

SEQ ID NO: 38943 - RNA, 1368 nt, Artificial Sequence
  derived and/or modified sequence opt5 from Refanezumab_HeavyChain1
caggugcaacugguccagagcggcuccgagcucaagaaacccggggccucuguuaaggugagcugcaaggcuuccggauacaccuucacaaacuauggcaugaauugggugagacaggccccugggcagggacuggaauggaugggcuggaucaacacguacaccggggagccgacauaugcggacgauuuuaccggacgguucgucuuuucucuugacacaagcguguccaccgcuuaccugcaaauuucuagccucaaagccgaagauacagccguuuauuacugugcucgcaaucccaucaacuauuacggcauuaauuacgagggcuaugugauggacuacugggggcagggaacccuggucacgguguccagcgccucuaccaaaggcccuuccguuuucccccuugcuccuagcucuaaguccacaagcgggggaaccgccgcgcugggcugccucgugaaggauuauuuucccgaaccugucacagugucuuggaacuccggggcccugaccagcggagugcacacguucccggcuguccugcaguccucuggccucuacagccuguccagcguugugacagugcccucuuccagccuuggcacccagacauauaucuguaaugucaaccauaaaccuucuaauaccaagguggacaaaaagguugagcccaaaagcugcgauaagacccacacauguccucccugcccggccccugagcuggcuggggcccccuccguguuucucuucccucccaagcccaaagacacgcugaugauuucuagaaccccugaagucacaugugugguuguggaugucagccaugaggacccggaagugaaguuuaacugguacgucgauggaguggagguucacaaugcgaaaaccaagccccgggaggaacaauauaacuccacauaccgcguggucagcgugcuuaccguucugcaucaggacuggcucaauggcaaagaguacaagugcaaagugucuaacaaggcccugccugcucccaucgaaaagacgaucuccaaagccaaggggcagccuagagagccccaggucuauacacugccgccuagccgggaugaacucaccaaaaaucaagugucucugaccugucuugugaagggauucuaccccuccgacauugcuguugagugggagagcaacggccagccugaaaacaauuauaaaacaacacccccuguccuggacuccgaugggagcuuuuuccucuacucuaagcugaccguggacaagucccgcuggcagcaaggaaacguguuuucuugcagcgucaugcacgaggcccuucacaaucauuauacgcagaaaucccugagccucucucccggcaag

SEQ ID NO: 38944 - RNA, 657 nt, Artificial Sequence
  derived and/or modified sequence opt5 from Refanezumab_LightChain1
gacaucgugaugacccagagccccgauucccuggccgucucucucggcgagagagcuacaauuaacugcaagagcucccacucuguucuguacagcuccaaucagaaaaacuaucuugccugguaccaacagaagccugggcagccgcccaaacugcucaucuauugggcgucuacgcgggaaagcggagugccugaccgcuucuccggcagcgggucuggaaccgauuuuacacugaccauuuccagccuucaagcugaggacguggccgucuacuauugucaucaguaccugucuucccucacauucggccaggggaccaagcuggaaaucaaaagaacaguggccgcucccagcguuuuuauuuucccucccucugaugagcagcugaaguccggaaccgccagcguggucugccuccugaauaacuuuuauccucgggaagcuaaggugcaauggaaaguugacaaugcccuucaguccggcaacucucaggagagcgugacggagcaggauuccaaggacagcaccuacucucuguccagcacacucacccugucuaaagcggauuacgaaaagcacaaagucuaugccugugaggugacacaucaaggccuuagcuccccggugaccaagucuuucaaucgcggggaaugc

SEQ ID NO: 38945 - RNA, 1314 nt, Artificial Sequence
  derived and/or modified sequence opt5 from REGN2810_HeavyChain1
gaggugcagcugcucgaaagcggcgggguccugguucaacccggaggcucccuuagacugucuugcgccgcuagcggguucaccuuuuccaacuucggaacaugggugcggcaggccccuggcaaggggcucgagugggugucuggaaucagcggcggcgggcgcgacacguacuuugcggauuccgucaaaggaagauucaccauuucucgggacaauagcaagaacacacuguaucuucaaaauucccugaaaggcgaagauaccgcuguguacuauuguguuaagugggggaacaucuacuuugacuauuggggacagggcacacucgugaccgucagcucugccuccacaaaagggccgagcguguucccccuggccccuugcucucgcuccaccagcgagucuacggcugcccugggaugucucguuaaggauuacuuucccgaaccugugaccgucuccuggaauagcggcgcucugacauccggcgugcacaccuuccccgccgugcuucagucuagcgggcuguauucccucagcucugucguuacagugccuuccagcucucugggaaccaagacguacacaugcaacguggaccauaaaccgagcaauaccaaggucgauaaaagaguggaguccaaguacgggcccccuugucccccuugccccgcgccggaguuucuuggcggaccuucuguuuuccuguuucccccuaaacccaaggacacacucauuagccggacccccgaagugaccugugucgugguugaugugucccaggaggacccugaaguccaguucaacugguauguggauggcgucgaggugcacaaugccaagacaaaaccgcgcgaggaacaguuuaacagcacguacagaguugugucuguccugaccgugcugcaucaagacuggcucaaugggaaggaguauaaaugcaagguuuccaacaaaggacugcccagcucuaucgaaaagacaauuuccaaagcuaagggccagccucgggagccccagguguacacccuuccucccagccaggaagagacaaagaaucaagucucccugaccugucucgugaaaggcuucuauccgucugauaucgccguggagugggaaagcaacgggcagccugagaauaacuacaagacgacacccccuguucuggacuccgacggaucuuucuuucuuuauagccgccugaccgucgauaaauccagauggcaggaaggcaacguguucagcugcucugugcacgaggcucuccauaaucacuacacccaaaagucccugagccugucucucggg

SEQ ID NO: 38946 - RNA, 639 nt, Artificial Sequence
  derived and/or modified sequence opt5 from REGN2810_LightChain1
gacauccagacccaaagccccuccucucugagcgccuccgugggcgauucuauuacaaucacgugcagagcuagccucuccauuaacaccuuccugaauugguaccagcagaagccugggaaagccccgaaccuucugaucuaugcggcuucuagccuccacggaggcguccccucccgguuuagcgggucuggauccggcacagacuucacccugacaauucgcacccuucagccugaggauuuugccacauacuauugucaacagagcucuaauacccccuucacguuugggccuggaaccguuguggacuucagacggacaguggccgcucccuccgucuuuaucuucccuccgagcgaugaacagcugaagucuggcaccgccuccgugguuugccuccugaacaauuuuuacccccgcgaggcuaaagugcaguggaaggucgacaacgcccugcaaagcggcaauucccaggaaucugugacagagcaggauagcaaagacuccaccuauagccucucuuccacgcugacacuuagcaaggcggauuacgaaaagcauaaaguuuaugccugugaggugacccaccaggggcugucuagcccugucacaaaguccuucaacagaggagagugc

SEQ ID NO: 38947 - RNA, 651 nt, Artificial Sequence
  derived and/or modified sequence opt5 from rhuMab_HER2(9CI)_LightChain
gugcacagcgacauccagaugacccaaucccccucuagccuguccgccucugucggcgauagaguuacaauuacgugcaaggcuagccaggacguguccaucgggguggccugguaccagcagaaaccuggaaaggcgccgaaacuccugauuuauucugcuagcuaccgguauaccggcguccccucccgcuucagcgggucuggauccggcacagauuuuacccuuacaaucagcucucugcaaccugaggacuucgccaccuacuauugucagcaguacuauauuuaccccuacacauuugggcagggaaccaagguggaaaucaaaagaacgguugccgcuccuuccguguucaucuuucccccuagcgaugagcaacucaagucuggcaccgccuccgucgugugccugcuuaacaauuucuauccgcgggaagcuaagguucaguggaaaguggacaacgcccugcagagcggcaauucccaggagucugucacagaacaagauagcaaggacuccaccuacagccucucuuccacacugacccugagcaaagcggauuaugagaagcauaaaguguacgccugugaggugacgcaccaggggcucucuagccccgucacaaaguccuuuaaccgcggagaaugc

SEQ ID NO: 38948 - RNA, 1215 nt, Artificial Sequence
  derived and/or modified sequence opt5 from rhuMab_HER2_HeavyChain
gaggugcagcuggucgaaagcggcgggggacucguucaacccggcgggucccugagacuuucuugcgccgcuagcggauucaccuuuacagacuacacgauggauugggugcggcaggccccuggcaaggggcugaccgcgguguauuacugugcucgcaaccucggaccguccuucuauuuugacuacuggggccagggcacacuggucaccgugucuagcgccuccacaaaagggcccucuguuuucccucuugcccccagcuccaagagcaccucuggaggcacagcugcccuggggugccucgugaaagauuauuuuccugagcccgucaccguguccuggaauagcggagcucugacgucuggcguucacaccuucccugccgugcugcaguccagcgggcucuacucucuguccagcgucgugacagugccguccucuagccuuggaacccaaacauauaucuguaacgucaaucauaagcccuccaacaccaaaguugacaagaagguggaaccuaaaagcugcgauaagacgcacacaugucccccuugccccgcgccggagcugcucggcggcccuucuguguuucuguuucccccuaaacccaaggacacccuuaugauuuccagaacacccgaagucaccugugugguuguggaugucagccaugaggacccugaggugaaauucaauugguacguugaugggguggaaguccacaacgccaagaccaagccgcgggaggaacaguacaauucuacauaucgcguggucagcgugcugacgguucuccaucaggacuggcugaacggaaaagaguacaagugcaaaguguccaauaaggcucugcccgccccuaucgagaaaaccauuucuaaggcuaaaggccagcccagagaaccucaagucuauacacugcccccgagccgggaggaaaugaccaagaaccaggugucccucacaugucuuguuaagggguucuacccuagcgauaucgccguggagugggaaucuaauggacagcccgagaacaauuauaaaaccacgccucccguccuggacuccgauggcagcuuuuuccucuacucuaagcugacaguggacaaaucccgcuggcagcaagggaacguguuuagcugcuccguuaugcacgaggcgcuucacaaucauuauacccagaagucucugagccucuccccuggacccaaa

SEQ ID NO: 38949 - RNA, 645 nt, Artificial Sequence
  derived and/or modified sequence opt5 from rhuMab_HER2_LightChain
agcgacauccagaugacccaaucccccucuagccuguccgccucugugggcgauagagucacaauuacgugccgggcuagccaggacguuaacaccgccguggcgugguaccagcagaagccugggaaagcuccgaagcuccugaucuauuccgccucuuuccuuuacagcggagugcccucccgcuuuagcggcucuagauccgggacagauuucacccugacaauuagcucucuccaaccugaggacuuugccaccuauuacugucagcagcacuauacaacgcccccuaccuucggacagggcaccaaagucgaaaucaagcggacaguggcugcccccuccguuuuuauuuucccuccgagcgaugagcaacugaaaucugggaccgcuuccguggucugccuucugaauaacuuuuacccccgcgaagccaaggugcaguggaagguugacaaugcgcuccagagcggaaacucccaggagucugugacagaacaagauagcaaagacuccaccuauagccugucuuccacgcugacacucagcaaggccgauuacgagaaacauaaggucuacgcuugugaggugacccaccagggccugucuagcccugugacaaaauccuucaauagaggcgaaugc

SEQ ID NO: 38950 - RNA, 318 nt, Artificial Sequence
  derived and/or modified sequence opt5 from rhuMab_HER2_LightChain_variant1
accguggccgcucccagcgucuucaucuuuccuccguccgacgagcagcugaagucuggcacagccagcguugugugccuccugaacaauuucuaccccagagaagcgaaagugcaauggaaggucgauaacgcccuucaguccggaaauucucaggagagcgugacggaacaggacuccaaagauucuaccuauagccuguccagcacacucacccugucuaaggcugacuacgagaaacacaagguuuaugccugugaagugacacaucaagggcuuuccagcccugucaccaagucuuuuaaccggggcgagugc

SEQ ID NO: 38951 - RNA, 642 nt, Artificial Sequence
  derived and/or modified sequence opt5 from rhuMab_HER2_LightChain_variant2
gacauccagaugacccaaagccccuccucucugagcgccuccgugggcgauagagucacaauuacgugccgggcuucucaggacguuaacaccgccguggcgugguaccagcagaaaccugggaaagcuccgaagcuccugaucuauagcgccuccuuccuuuacucuggagugcccagccgcuuuuccggcagcagaucugggacagauuucacccugacaauuuccagccuccaaccugaggacuuugccaccuauuacugucagcagcacuauacaacgcccccuaccuucggacagggcaccaaagucgaaaucaagcggacaugcgcugcccccucuguguuuauuuucccuccguccgaugagcaacugaaaagcgggaccgcuucuguugugugucuucugaauaacuuuuacccccgcgaagccaagguccaguggaagguggacaaugcgcuccaguccggaaacagccaggaguccguuacagaacaagauucuaaagacagcaccuauucccugagcucuacgcugacacucuccaaggccgauuacgagaaacauaagguguacgcuugcgaggucacccaccagggccugagcucuccugugacaaagagcuucaauagaggcgaaugu

SEQ ID NO: 38952 - RNA, 642 nt, Artificial Sequence
  derived and/or modified sequence opt5 from rhuMab_HER2_LightChain_variant3
gacauccagaugacccaaagccccuccucucugagcgccuccgugggcgauagagucacaauuacgugccgggcuucucaggacguuaacaccgccguggcgugguaccagcagaaaccugggaaagcuccgaagcuccugaucuauagcgccuccuuccuuuacucuggagugcccagccgcuuuuccggcagcagaucugggacagauuucacccugacaauuuccagccuccaaccugaggacuuugccaccuauuacugucagcagcacuauacaacgcccccuaccuucggacagggcaccaaagucgaaaucaagcggacaguggcugcccccucuguuuuuauuuucccuccguccgaugagcaacugaaaagcgggaccgcuucuguggucugccuucugaauaacuuuuacccccgcgaagccaaggugcaguggaagguugacaaugcgcuccaguccggaaacagccaggaguccgugacagaacaagauucuaaagacagcaccuauucccugagcucuacgcugacacucuccaaggccgauuacgagaaacauaaggucuacgcuugugaggugacccaccagggccugagcucuccugugacaaagagcuucaauagaggcgaaugc

SEQ ID NO: 38953 - RNA, 645 nt, Artificial Sequence; identical to SEQ ID NO: 38949
  derived and/or modified sequence opt5 from rhuMab_HER2_LightChain_variant4

SEQ ID NO: 38954 - RNA, 321 nt, Artificial Sequence
  derived and/or modified sequence opt5 from rhuMab_HER2_LightChain_V-Region
gacauccagaugacccaaagccccuccucucugagcgccuccgugggcgauagagucacaauuacgugccgggcuucucaggacguuaacaccgccguggcgugguaccagcagaagccugggaaagcuccgaagcuccugaucuauagcgccuccuuccuuuacucuggagugcccagccgcuuuuccggcagcagaucugggacagauuucacccugacaauuuccagccuccaaccugaggacuuugccaccuauuacugucagcagcacuauacaacgcccccuaccuucggacagggcaccaaagucgaaaucaag

SEQ ID NO: 38955 - RNA, 1350 nt, Artificial Sequence
  derived and/or modified sequence opt5 from rhuMab_HER2_gamma1-Chain
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccuaagucuugcgacaaaacacauaccugucccccuugccccgccccggagcuccugggcgggccuagcguguuccuuuuucccccuaagcccaaggauacccugaugauuucccggacacccgagguuacguguguggucguggacguuucucacgaagauccugaggugaaauucaacugguaugucgacggaguggaaguccauaaugcgaagaccaaaccgcgcgaggagcaguacaacagcacauauagagugguuuccgugcucaccguccugcaccaggauuggcugaauggcaaggaauacaaaugcaaggugagcaacaaagcccuccccgcuccuaucgagaagacaaucucuaaggccaaagggcaaccccgggaaccucagguuuauacccugcccccgucccgcgaggaaaugacgaagaaucaggugagccuuacaugucuggucaaaggauuuuacccuucugacauugcuguggagugggaguccaacggccagcccgaaaauaacuacaagaccaccccucccgugcucgacagcgauggcuccuucuuucuguauucuaaacuuacaguugacaagagcagauggcaacaggggaacgucuucuccugcucugugaugcacgaggcccugcauaaucacuacacccaaaagagccucucccugagcccuggaaaa

SEQ ID NO: 38956 - RNA, 1350 nt, Artificial Sequence
  derived and/or modified sequence opt5 from rhuMab_HER2__gamma1-Chain
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccugcagcaccaagggacccucugucuuuccucuggcccccuccagcaaaucuacguccggcgggaccgcggcccucggaugucuggugaaggacuacuucccugagcccguuacagugagcuggaacucuggcgcucugaccuccggcguccauacauuuccugccgugcuccaaagcuccgggcuguauucucuuagcuccguggucaccguuccguccucuucccugggaacgcagacauacaucugcaaugugaaccacaagcccagcaauaccaaaguggauaagaaagucgaaccuaagucuugugacaaaacacauaccugucccccuugccccgcuccggagcuccugggcgggccuagcguguuccuuuuucccccuaagcccaaggauacccugaugauuucccggacacccgagguuacgugcguggucguggacguuucucacgaagauccugaggugaaauucaacugguaugucgacggaguggaaguccauaaugccaagaccaaaccgcgcgaggagcaguacaacagcacauauagagugguuuccgugcucaccguccugcaccaggauuggcugaauggcaaggaauacaaauguaaggugagcaacaaagcgcuccccgccccuaucgagaagacaaucucuaaggcuaaagggcaaccccgggaaccucagguuuauacccugcccccgucccgcgaggaaaugacgaagaaucaggugagccuuacaugccuggucaaaggauuuuacccuucugacauugccguggagugggaguccaacggccagcccgaaaauaacuacaagaccaccccucccgugcucgacagcgauggcuccuucuuucuguauucuaaacuuacaguugacaagagcagauggcaacaggggaacgucuucuccuguucugugaugcacgaggcucugcauaaucacuacacccaaaagagccucucccugagcccuggaaaa

SEQ ID NO: 38957 - RNA, 729 nt, Artificial Sequence
  derived and/or modified sequence opt5 from rhuMab_HER2_gamma1-Chain__rhuMab_HER2_LightChain_sc4D5
gaggugcagcuggucgaaagcggcgggggacucguucaacccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaacucccugcgcgcugaagauacagccguguauuacuguucuagauggggcggggacggauucuaugcuauggauuacuggggccaggggacccuuguuacagugagcuccggaggcgggggaagcggcggcgggggaucuggcgggggaggcuccgacauccaaaugacccagagccccucuucccugagcgccucugucggggaucgggugacgauuaccugccgcgcgucccaggacguuaauacagccguggcuugguaccagcaaaagccuggaaaagcccccaagcuccugaucuauagcgcuuccuuucuguacucuggcgucccuagcagauucuccggcagccggucugggaccgauuuuacacucaccaucuccagccugcagcccgaggacuucgccacguauuacugucagcagcauuauacaaccccuccgacauuuggacaaggcaccaagguggaaauuaaacgc

SEQ ID NO: 38958 - RNA, 1350 nt, Artificial Sequence; identical to SEQ ID NO: 38955
  derived and/or modified sequence opt5 from rhuMab_HER2_gamma1-Chain_variant1

SEQ ID NO: 38959 - RNA, 1350 nt, Artificial Sequence; identical to SEQ ID NO: 38956
  derived and/or modified sequence opt5 from rhuMab_HER2_gamma1-Chain_variant2

SEQ ID NO: 38960 - RNA, 1350 nt, Artificial Sequence
  derived and/or modified sequence opt5 from rhuMab_HER2_gamma1-Chain_variant3
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcugugaagauacagcuguguauuacugcucuagauggggcggggacggauucuaugccauggauuacuggggccaggggacccuuguuacagugagcuccgcuagcaccaagggacccucugucuuuccucuggcccccuccagcaaaucuacguccggcgggaccgcggcccucggaugucuggugaaggacuacuucccugagcccguuacagugagcuggaacucuggcgcucugaccuccggcguccauacauuuccugccgugcuccaaagcuccgggcuguauucucuuagcuccguggucaccguuccguccucuucccugggaacgcagacauacaucugcaaugugaaccacaagcccagcaauaccaaaguggauaagaaagucgaaccuaagucuugugacaaaacacauaccugucccccuugccccgcuccggagcuccugggcgggccuagcguguuccuuuuucccccuaagcccaaggauacccugaugauuucccggacacccgagguuacgugcguggucguggacguuucucacgaagauccugaggugaaauucaacugguaugucgacggaguggaaguccauaaugccaagaccaaaccgcgcgaggagcaguacaacagcacauauagagugguuuccgugcucaccguccugcaccaggauuggcugaauggcaaggaauacaaauguaaggugagcaacaaagcgcuccccgccccuaucgagaagacaaucucuaaggcuaaagggcaaccccgggaaccucagguuuauacccugcccccgucccgcgaggaaaugacgaagaaucaggugagccuuacaugccuggucaaaggauuuuacccuucugacauugccguggagugggaguccaacggccagcccgaaaauaacuacaagaccaccccucccgugcucgacagcgauggcuccuucuuucuguauucuaaacuuacaguugacaagagcagauggcaacaggggaacgucuucuccuguucugugaugcacgaggcucugcauaaucacuacacccaaaagagccucucccugagcccuggaaaa

SEQ ID NO: 38961 - RNA, 360 nt, Artificial Sequence
  derived and/or modified sequence opt5 from rhuMab_HER2_gamma1-Chain_V-Region
gaggugcagcuggucgaaagcggcgggggacucguucaacccggcgggucccugagacuuucuugcgccgcuagcggauucaauaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaacucccugcgcgcugaagauacagccguguauuacuguucuagauggggcggggacggauucuaugcuauggauuacuggggccaggggacccuuguuacagugagcucc

SEQ ID NO: 38962 - RNA, 1359 nt, Artificial Sequence; identical to SEQ ID NO: 38293
  derived and/or modified sequence opt5 from rhuMAb-VEGF_HeavyChain1

SEQ ID NO: 38963 - RNA, 642 nt, Artificial Sequence; identical to SEQ ID NO: 38294
  derived and/or modified sequence opt5 from rhuMAb-VEGF_LightChain1

SEQ ID NO: 38964 - RNA, 642 nt, Artificial Sequence; identical to SEQ ID NO: 38294
  derived and/or modified sequence opt5 from rhuMAb-VEGF_LightChain

SEQ ID NO: 38965 - RNA, 321 nt, Artificial Sequence; identical to SEQ ID NO: 38303
  derived and/or modified sequence opt5 from rhuMAb-VEGF_LightChain__VG-Region

SEQ ID NO: 38966 - RNA, 1359 nt, Artificial Sequence; identical to SEQ ID NO: 38293
  derived and/or modified sequence opt5 from rhuMAb-VEGF_gamma1-Chain

SEQ ID NO: 38967 - RNA, 369 nt, Artificial Sequence; identical to SEQ ID NO: 38298
  derived and/or modified sequence opt5 from rhuMAb-VEGF_gamma1-Chain_VDG-Region

SEQ ID NO: 38968 - RNA, 1338 nt, Artificial Sequence
  derived and/or modified sequence opt5 from Rilotumumab_HeavyChain1
caggugcagcugcaggagagcggccccgggcucgucaagccuuccgaaacccugucucuuacaugcacgguuagcggaggcuccaucucuauuuacuauuggagcuggaucagacagccgcccgggaaaggacuggaguggauuggcuacguguauuacuccgggucuaccaacuauaauccuagccucaagucccgggugacaaucagcgucgacaccucuaaaaaccaguucucccugaaacuuaauagcgugacagccgcugauaccgccguuuacuauugugcgcgcggaggcuacgacuuuuggucuggcuacuucgauuauugggggcaaggaacacuggugaccgucuccagcgcuucuacgaagggccccuccguguuuccucucgcccccugcagcagauccaccucugaaagcacagccgcucuggggugucugguuaaggacuacuucccugagccggugaccgucuccuggaacagcggagcccucacaucuggcgugcacaccuuucccgcugugcugcaguccagcgggcuuuauucucugagcuccgucguuacggugccuucuagcaauuucggaacacagaccuacacaugcaacguggaucauaagcccuccaauaccaaagucgacaagaccguggaacggaaauguugcguugaguguccucccugcccggccccucccguggcgggcccuagcgucuuucucuucccgcccaagccuaaagauacacugaugauuucucgcacgccggaggugaccuguguuguggucgacgugucccacgaagaucccgagguccaguuuaacugguauguggacggcguugaagugcauaaugccaagacaaagccuagagaggagcaauucaacagcaccuuucgggucgugucuguucuuacagugguccaccaggauuggcugaaugggaaagaauacaagugcaaaguguccaacaagggacuccccgcuccuaucgagaaaaccaucagcaagacgaaaggccagccccgcgaaccccagguguauacacugccucccuccagagaggaaaugaccaagaaucaaguuucucugaccugucucgucaagggguucuacccuagcgacauugccguggagugggaguccaacggacagcccgaaaauaacuacaaaacaaccccucccaugcuggauucugacggcagcuuuuuccuuuauuccaagcugacaguggacaaaagccgguggcagcaagggaacgucuucucuugcuccgugaugcaugaggcucuccacaaucacuacacgcaaaagagccugucucuuuccccgggaaaa

SEQ ID NO: 38969 - RNA, 645 nt, Artificial Sequence
  derived and/or modified sequence opt5 from Rilotumumab_LightChain1
gagaucgugaugacccagagccccgccacacuguccgucucuccuggcgaaagagcuacgcucagcugccgggccucccaaucuguugacagcaaccuggcgugguaccgccagaagccggggcaggcucccagacuucugauuuauggagccuccacccgggccacaggcaucccugcucgcuucucugggagcggauccggcaccgaguuuacacucaccauuagcucucugcaguccgaagauuucgccguguacuauugucaacaguacaucaauuggcccccuauuacauuugggcagggaaccagacuugagaucaaacggacgguggcugcccccagcgucuucaucuuuccuccgucugacgaacagcugaaguccggcaccgcgagcgugguuugccuccugaacaauuucuauccccgcgaggccaaagugcaauggaaggucgauaacgcucugcagucuggcaauucccaggagagcgugacagaacaggacuccaaagauucuaccuacagccucuccagcacacugacccuuucuaaggccgacuaugagaagcacaaaguuuacgcuugugaagugacgcaucaagggcuguccagcccugucacaaagucuuuuaacagaggagagugc

SEQ ID NO: 38970 - RNA, 1071 nt, Artificial Sequence; identical to SEQ ID NO: 38927
  derived and/or modified sequence opt5 from Rilotumumab_scFv-CH_chain

SEQ ID NO: 38971 - RNA, 1347 nt, Artificial Sequence
  derived and/or modified sequence opt5 from Rinucumab_HeavyChain1
cagcugcaacuccaggagagcggccccgggcuggugaagccuuccgaaacccuuucucugacaugcacggucagcggaggcuccaucaccucuagcuccuacuauuggggguggauuagacagccgcccggaaaaggccucgaguggaucgggucuauuuacuaucggggaagcacaaacuacaauccuucccugaagucucgcguuaccaucucuguggacuccagcaaaaaccaguucuaucuuaaggugucuuccgucacagccguggauaccgcuguuuacuauugugccagacaaaauggcgcggcucggcccagcugguuugacccuuggggccaggggacacuggugaccgucucuuccgccagcacgaaaggacccuccguguucccucucgccccgugcucucgcagcaccuccgaaagcacagcugcccugggcugucugguuaaggauuacuuucccgagccugugaccgucucuuggaacuccggggcucucacaagcggagugcacaccuuccccgccgugcugcagucuagcggccuuuacucccugucuagcgucguuacggugccuuccagcucucucgggacaaagaccuauacaugcaauguggaccauaaacccuccaacaccaaggucgauaaaagaguggaaagcaaguacggaccgccuugucccccuugccccgcgcccgaguuucugggcggcccuucuguuuuccuuuuuccgcccaaaccuaaggacacccugaugauuucccggacacccgaggugacgugugucgugguugaugugagccaggaagacccugagguccaauucaauugguauguggauggggucgaagugcacaacgccaagaccaaaccccgcgaggagcaguuuaauuccacauacagaguugugucuguccucaccgugcugcaucaggacuggcugaacggaaaggaauauaaaugcaagguuagcaauaaaggccucccguccucuaucgagaagacaaucagcaaagcuaaggggcagccucgggaaccccaaguguacacccugccucccucccaggaggaaaugacgaagaaccaggucagccuuacaugucuggugaaaggauucuauccuucugauauugccguggagugggaguccaauggccaacccgaaaacaauuacaagaccaccccgccuguucucgacagcgaugggagcuuuuuccuguacucccgccuuacagucgacaaaagcagauggcaggagggaaacguguuuucuugcagcgugaugcacgaagcucugcauaaccacuauacccagaagucccucagccugucucugggcaaa

SEQ ID NO: 38972 - RNA, 1344 nt, Artificial Sequence
  derived and/or modified sequence opt5 from Rinucumab_HeavyChain
cagcugcaacuccaggagagcggccccgggcuggugaagccuuccgaaacccuuucucugacaugcacggucagcggaggcuccaucaccucuagcuccuacuauuggggguggauuagacagccgcccggaaaaggccucgaguggaucgggucuauuuacuaucggggaagcacaaacuacaauccuucccugaagucucgcguuaccaucucuguggacuccagcaaaaaccaguucuaucuuaaggugucuuccgucacagccguggauaccgcuguuuacuauugugccagacaaaauggcgcggcucggcccagcugguuugacccuuggggccaggggacacuggugaccgucucuuccgccagcacgaaaggacccuccguguucccucucgccccgugcucucgcagcaccuccgaaagcacagcugcccugggcugucugguuaaggauuacuuucccgagccugugaccgucucuuggaacuccggggcucucacaagcggagugcacaccuuccccgccgugcugcagucuagcggccuuuacucccugucuagcgucguuacggugccuuccagcucucucgggacaaagaccuauacaugcaauguggaccauaaacccuccaacaccaaggucgauaaaagaguggaaagcaaguacggaccgccuugucccccuugccccgcgcccgaguuucugggcggcccuucuguuuuccuuuuuccgcccaaaccuaaggacacccugaugauuucccggacacccgaggugacgugugucgugguugaugugagccaggaagacccugagguccaauucaauugguauguggauggggucgaagugcacaacgccaagaccaaaccccgcgaggagcaguuuaauuccacauacagaguugugucuguccucaccgugcugcaucaggacuggcugaacggaaaggaauauaaaugcaagguuagcaauaaaggccucccguccucuaucgagaagacaaucagcaaagcuaaggggcagccucgggaaccccaaguguacacccugccucccucccaggaggaaaugacgaagaaccaggucagccuuacaugucuggugaaaggauucuauccuucugauauugccguggagugggaguccaauggccaacccgaaaacaauuacaagaccaccccgccuguucucgacagcgaugggagcuuuuuccuguacucccgccuuacagucgacaaaagcagauggcaggagggaaacguguuuucuugcagcgugaugcacgaagcucugcauaaccacuauacccagaagucccucagccugucucugggc

SEQ ID NO: 38973 - RNA, 645 nt, Artificial Sequence
  derived and/or modified sequence opt5 from Rinucumab_LightChain1
gagaucgugcugacgcagagccccgacacaauuucccucucuccuggcgaaagagccacgcugagcugccgggcuucccaaucuaucagcuccauuuaccuugccugguaucagcagaagccggggcaggcgccccgccugcucaucuacggagcuucuagcagagucaccggcauuccugaucgguucuccguuagcgggucuggaacagacuuuacccugacaaucucccgccuugagcccgaagauuucgccguguauuacugucaacacuauggcaucagcccuuuuaccuucgggcccggaacaaaaguggacauuagacggaccgucgccgcuccuucuguguuuaucuucccgcccuccgaugagcagcucaagagcggcacggccucuguugugugccugcugaacaauuuuuacccucgcgaagcuaaaguccaguggaagguggacaacgcccugcaguccggcaauagccaagaguccguuaccgagcaggauucuaaagacagcacauauucccucagcucuacccugacacuuuccaaggcggauuacgaaaagcauaaaguguacgccugugaggucacccaccaggggcugagcucucccgugaccaagagcuucaacagaggagaaugc

SEQ ID NO: 38974 - RNA, 1347 nt, Artificial Sequence
  derived and/or modified sequence opt5 from Risankizumab_HeavyChain1
caggugcaacugguccagagcggcgccgagguuaagaaacccggguccucugugaaggugagcugcaaggcuuccggauacaccuucacagaccagacgauccacuggaugagacaggccccuggccaagggcucgaauggauuggauauaucuacccgcgggaugacucucccaaauauaacgagaauuuuaaaggcaaggucaccauuacagcggauaagagcaccuccacagcuuacauggaacugucuagccuucgcuccgaggacaccgccguguauuacugugccaucccugauagaagcggguaugcuugguucauuuacuggggacagggcacacugguuaccgugucuuccgccagcacgaaaggccccucugucuuuccucucgcucccuccagcaagucuaccuccgggggaacagccgcgcugggcugccuugugaaagacuacuucccugaaccgguuaccgugagcuggaacuccggggcccugacaucuggaguccauaccuuucccgcugugcuccagagcuccggccuguauagccugucuuccguggucacgguuccuagcucuagccucgggacacagaccuacaucuguaaugugaaccacaagcccuccaauacaaaaguggauaagcgggucgagccuaagucuugcgacaaaacccauaccugucccccgugcccugcccccgaggcugccggaggcccuagcguguuccuguuuccucccaagcccaaagauacacuuaugaucucccgcacgccggaaguuaccuguguggucguggacguuagccacgaggaucccgaagugaaguucaacugguaugucgacggcguggagguccauaaugcgaaaacaaagccuagagaggaacaauacaacucuaccuaucgggugguuuccgugcugacaguccuccaccaggauuggcugaaugggaaagaguacaagugcaaggugagcaacaaagcccuucccgcuccuauugaaaagaccaucucuaaagccaagggacagccccgcgagccgcagguuuauacgcugccucccuccagagaagagaugaccaaaaaucaagugagccucacaugucuggucaagggcuuuuacccuuccgacauugcuguggagugggaaucuaacgggcagcccgagaauaacuacaagaccacaccucccgugcuggacagcgauggauccuucuuucucuauucuaaacugaccguugacaagagccgguggcagcaaggcaaugucuucuccugcagcgugaugcacgaagcccuucauaaccacuacacacagaaaucucugucccucagcccgggg

SEQ ID NO: 38975 - RNA, 642 nt, Artificial Sequence
  derived and/or modified sequence opt5 from Risankizumab_LightChain1
gacauccagaugacccaaagccccuccucucugagcgccuccgugggcgauagagucacaauuacgugcaaggcuucucgggacguugccaucgcgguggcuugguaccagcagaaaccugggaaggugccgaaacuccugauuuauugggccagcacccgccacacaggaguccccuccagauucucuggcagcgggucccggaccgauuuuacacuuaccaucagcucucugcagccugaggacguggccgauuacuucugucaucaauauuccagcuaccccuuuacauucggaucuggcaccaagcucgaaauuaaacgcacgguugcugccccuuccguguuuaucuuucccccuagcgacgagcagcugaagucugggaccgcuuccgucgugugccuucugaacaauuucuauccgagagaagccaagguucaguggaaaguggauaacgcgcuccagagcggaaauucccaagagucugucacagaacaggacagcaaggauuccaccuacagccugucuuccacacugacccucagcaaagccgacuaugagaagcacaaaguguacgcuugugaggugacgcaucagggccugucuagccccgucacaaaguccuucaaccggggcgaaugc

SEQ ID NO: 38976 - RNA, 1353 nt, Artificial Sequence
  derived and/or modified sequence opt5 from Rituximab_HeavyChain
caggugcaacugcagcagcccggcgccgagcucgucaagccuggggcuagcguuaaaauguccugcaaggccucuggauacaccuucacaagcuauaacaugcacugggugaaacagacgccgggcagagggcuggaauggaucggagcgauuuaccccggcaauggggacaccuccuauaaccaaaaguuuaaaggaaaggcuacacuuaccgccgauaagucuagcuccacagccuacaugcagcugucuagccucaccuccgaggacagcgcuguguauuacugugcccggucuacauauuacggcggcgauugguacuucaaugucuggggagcugggaccacggugaccguuuccgccgcgagcacaaaaggcccuucuguguuuccccuggccccuuccagcaagucuaccuccgggggaacagcugcccuuggcugccuggucaaagacuauuuccccgaaccugugaccguuagcuggaacuccggggcucucacgucuggagugcauacauuuccggccguccugcagagcuccggccuguacagccucucuuccguggugaccguccccagcucuagccugggcacacagaccuauaucuguaauguuaaccacaagccuuccaauaccaaaguggauaagaagguggagcccaaaucuugcgacaagacacauacguguccucccugcccggcgccugaacuucucgggggacccagcgucuuccuguuuccucccaaacccaaggauacccugaugauuucccgcacaccugaggugaccuguguuguggucgacgugagccacgaggauccggaaguuaaauucaacugguacguggacggcgucgaggugcauaaugccaagacaaaacccagagaagaacaauauaacucuaccuaccgggucguguccguucuuacggugcugcaccaggauuggcucaaugggaaggaguauaagugcaaagucagcaacaaggcucugccugcccccaucgagaaaacaauuucuaaggcuaaaggacagccucgcgagccccagguguacacccugccgccuuccagagacgaacucaccaagaaucaaguuagccugacaugucuugugaagggcuuuuaccccuccgauaucgccgucgagugggaaucuaacgggcagccugagaauaacuauaaaaccacacccccugugcuggacagcgacggauccuucuuucucuacucuaagcugacgguggauaaaagccgguggcagcaaggcaacguuuucuccugcagcgucaugcacgaggcccuucauaaucacuauacccagaagucucugucccucagccccggcaaa

SEQ ID NO: 38977 - RNA, 1353 nt, Artificial Sequence
  derived and/or modified sequence opt5 from Rituximab_HeavyChain_variant
caggugcaacugcagcagcccggcgccgagcucgucaagccuggggcuagcguuaaaauguccugcaaggccucuggauacaccuucacaagcuauaacaugcacugggugaaacagacgccgggcagagggcuggaauggaucggagcgauuuaccccggcaauggggacaccuccuauaaccaaaaguuuaaaggaaaggcuacacuuaccgccgauaagucuagcuccacagccuacaugcagcugucuagccucaccuccgaggacagcgcuguguauuacugugcccggucuacauauuacggcggcgauugguacuucaaugucuggggagcugggaccacggugaccguuuccgccgcgagcacaaaaggcccuucuguguuuccccuggccccuuccagcaagucuaccuccgggggaacagcugcccuuggcugccuggucaaagacuauuuccccgaaccugugaccguuagcuggaacuccggggcucucacgucuggagugcauacauuuccggccguccugcagagcuccggccuguacagccucucuuccguggugaccguccccagcucuagccugggcacacagaccuauaucuguaauguuaaccacaagccuuccaauaccaaaguggauaagaaggcggagcccaaaucuugcgacaagacacauacguguccucccugcccggccccugaacuucuugggggacccagcguguuccucuuuccucccaaacccaaggauacccugaugauuucccgcacaccugaggucaccugugugguuguggacgucagccacgaggauccggaagugaaauucaacugguacguugacggcguggagguccauaaugcuaagacaaaacccagagaagaacaauauaacucuaccuaccggguggucuccgugcuuacgguucugcaccaggauuggcucaaugggaaggaguauaagugcaaagugagcaacaaggcccugccugcucccaucgagaaaacaauuucuaaggccaaaggacagccucgcgagccccaggucuacacccugccgccuuccagagacgaacucaccaagaaucaagugagccugacaugucuuguuaagggcuuuuaccccuccgauaucgccguggagugggaaucuaacgggcagccugagaauaacuauaaaaccacacccccuguccuggacagcgacggauccuucuuucucuacucuaagcugacgguggauaaaagccgguggcagcaaggcaacguguucuccugcagcguuaugcacgaggcucugcauaaucacuauacccagaagucucugucccucagccccggcaaa

SEQ ID NO: 38978 - RNA, 639 nt, Artificial Sequence
  derived and/or modified sequence opt5 from Rituximab_LightChain
cagaucgugcugagccaaucccccgccauucucucugcuagcccuggcgagaaggucaccaugacaugcagagccuccucuagcguuuccuacauccacugguuccagcagaaaccggggucuagccccaagccuuggauuuaugcgacguccaaccuggcuagcggagugcccgugcgguuuucuggcuccgggagcggaaccucuuacucccuuacaaucagccgcgucgaagccgaggacgccgcuaccuauuacugucagcaauggacaucuaauccucccaccuucggcgggggaacaaaacuggaaauuaagagaaccguggccgcuccuuccguuuuuaucuucccgcccagcgaugagcagcucaaauccggcacggccucuguggucugccugcuuaacaauuuuuauccucgggaagcgaaggugcaguggaagguugacaacgcccugcagagcggcaauucccaagagagcgugaccgagcaggauucuaaagacuccacauacagccucucuagcacccugacacuguccaaggcugauuaugaaaaacauaaggucuacgccugugaggugacccaccaggggcucucuagccccgugacgaaauccuucaaccgcggagaaugc

SEQ ID NO: 38979 - RNA, 714 nt, Artificial Sequence
  derived and/or modified sequence opt5 from Rivabazumab_pegol_HeavyChain1
gaggugcagcuggucgaaagcggcgggggaguugugcaacccggcagaucccuccggcugucuugcgccgcuagcggguucaccuuuuccaacuacccuaugcacugggugcgccaggccccgggaaagggccuugagugggucgcggugaucucuuaugacgggagcgaaaaaugguacgcugauuccguuaagggaagauucacaauuucucgggacaauagcaaaaacacgcuguaucucgagaugaacucccugcgccccgaagauaccgccguguacuauugugccagaaaucggggcgacaucuacuaugauuuuacauacgcuauggacauuuggggccaggggaccacagucaccgugagcucugccuccacaaagggaccuagcguuuucccccuugcuccuucuuccaaaagcaccucuggcgggacggccgcgcugggaugccucgugaaggauuacuuucccgagccugucaccguguccuggaauagcggcgcccugacauccggggugcauaccuucccggcuguccugcagucuagcggacucuauucccugagcucuguugugacagugcccuccagcucucuuggcacccaaacguacaucuguaacgucaaucacaagccuagcaacacaaaaguggacaagaaaguugagcccaaguccucugauaaaacccauacaugcccucccuguccggcc

SEQ ID NO: 38980 - RNA, 642 nt, Artificial Sequence
  derived and/or modified sequence opt5 from Rivabazumab_pegol_LightChain1
gacauccagcugacccaaagccccuccacacucucugccagcgugggcgauuccgucacgauuaccugcagagcuucugaggggguugaccgguggcuggccugguaccagcagaagccuggacgcgcgccgaaacuucugaucuaugaugcuagcacacuccaguccggcgugcccucuagauucagcggguccggaagcggcaccgaauuuucucugacaauuuccagccuucaaccugacgauguggccaccuacuauugucagcacuucugggggacacccuacaccuuuggacagggcacgaagcuggagaucaaacggaccgucgccgcuccuucuguguucauuuuucccccuuccgacgaacagcucaagagcggcacagccucuguugugugccugcugaacaauuucuauccgcgcgaggcuaaaguccaauggaagguggauaacgcccuccaguccgggaauagccaggaauccguuaccgagcaggacucuaaggauagcacauacucccugagcucuacccuuacgcuguccaaagcggacuaugagaagcauaaaguguacgccugugaagucacacaccaaggacucagcucucccgugaccaagagcuuuaacagaggcgagucc

SEQ ID NO: 38981 - RNA, 1344 nt, Artificial Sequence
  derived and/or modified sequence opt5 from Robatumumab_HeavyChain1
gaggugcagcugguccagagcggcgggggacucguuaagcccggcgggucccugagacuuucuugcgccgcuagcggauucaccuuuuccucuuucgccaugcacugggugcggcaggcgccuggcaaagggcuggaauggaucagcgugauugacacacgcggagcuacguacuaugccgauuccgucaagggcagauuuaccaucucucgggacaacgccaaaaauagccucuaccugcagaugaacucccuucgcgcugaggauacagccguguauuacugugcuagacugggcaauuucuauuacgggauggacguuuggggacagggcaccacagugaccgucagcucugccuccacaaaggggccgagcguguuuccccucgcgccuucuuccaaaagcaccucuggaggcacggccgcucuggggugccugguuaaggauuauuuccccgaaccugugaccgucuccuggaacagcggagcccucacauccggcgugcauaccuuucccgcugugcugcaaucuagcggccuuuacucccugagcucugucguuacagugccuuccagcucucucgggacccagacguacauuuguaaugugaaccacaagccgagcaauacaaaagucgacaagaaaguggagcccaaguccugcgauaaaacccauacauguccucccugcccugcccccgaacugcuuggaggcccgucuguuuuccuguuuccucccaagccuaaggacacccucaugaucagccggacccccgaggugacaugugucgugguugaugugucccacgaggaccccgaagucaaauucaacugguauguggauggggucgaggugcauaaugcgaagacgaaaccucgcgaggaacaguacaacagcaccuauagaguugugucuguccugacagugcugcaccaggacuggcucaauggaaaggaguacaaaugcaagguuuccaacaaagcccugccggcucccauugaaaagaccaucagcaaggccaaaggccaaccucgggagccccagguguauacacuuccucccucucgcgaugaacugaccaagaaucaggucucccucacgugucuggugaaaggguuuuacccgagcgacaucgcuguggagugggaauccaacggacagccugagaauaacuauaagacaacacccccuguucuugacucugauggcagcuucuuucuguacuccaaacucaccgucgacaagucuagauggcaacagggcaacguguucagcugcuccgugaugcacgaggcccugcauaaucacuacacccaaaagagccugucucucucccccgggaaa

SEQ ID NO: 38982 - RNA, 642 nt, Artificial Sequence
  derived and/or modified sequence opt5 from Robatumumab_LightChain1
gagaucgugcugacccagagccccggcacacucuccgucucuccuggggaaagagccacgcugagcugccgggcuucccaaucuauuggaagcucccuucacugguaccagcagaagccgggccaggcgccccgccugcucaucaaauaugccucucaaagccuguccgggauuccugacagauucagcggaucuggcuccgggaccgauuuuacacuuaccaucagccggcuggagcccgaagacuucgcuguuuacuauugucaucagucuucccgccucccucacacauuuggacagggcaccaagguggagauuaaaagaacaguggccgcccccagcgucuucaucuuuccuccgucugaugaacagcugaaguccggcaccgcuagcgugguuugccugcucaacaauuucuacccccgggaggccaaagugcaauggaaggucgacaacgcucugcaguccggaaauucucaggagagcgugacggaacaggauuccaaggacagcaccuauucucuuuccagcacacugacccucucuaaagccgauuacgagaagcauaaaguuuaugcgugugaagugacacaccaagggcugagcuccccugucaccaagucuuuuaaccgcggcgagugc

SEQ ID NO: 38983 - RNA, 1368 nt, Artificial Sequence
  derived and/or modified sequence opt5 from Roledumab_HeavyChain1
caggugcaacuggucgagagcggcgggggaguugugcagcccggcagaucccuccggcugucuugcaccgccagcggguucacauuuaagaacuacgcuaugcacugggugcgccaggccccugcgaaaggacuugaaugggucgcuacgaucuccuaugacggcagaaauauucaguacgccgauucugugaaggggcgguucaccuuuagccgcgacaacucccaagauacacuguaucuccagcuuaauucucugagaccggaggacaccgccguuuacuauugugcucggcccgugcgcagcagauggcugcagcucggacuggaagaugccuuccauaucuggggccagggcacaauggucaccguguccagcgcuucuacaaaagggccuuccguuuuuccccuggccccuagcucuaaguccaccagcggaggcacggcggcccucgggugccuggugaaagacuacuuccccgagccugucaccgugucuuggaacuccggagcucuuacaagcggcgugcacaccuuuccggccguccugcaauccucugggcucuauagccuguccagcguugugacagugcccucuuccagccuuggaacccagacguacauuuguaaugucaaccauaagccuucuaauacaaagguggauaaaaagguugaacccaaaagcugcgacaagacccacacauguccucccugcccggcuccugagcugcucggcggccccuccguguuccuguuuccucccaaacccaaggauacccugaugaucucucggaccccugaggucacaugugugguuguggacgucagccaugaagauccggaggugaaguucaacugguacgucgacgggguggaaguucacaaugccaaaacgaagccccgcgaggagcaguauaacuccaccuacagaguggucagcgugcucacaguucugcaccaggauuggcuuaauggaaaagaauauaagugcaaagugucuaacaaggcgcugccugcccccauugagaaaaccaucuccaaggcuaagggccaaccucgggaaccccaggucuacacacucccgccuagccgcgacgagcugaccaaaaaucaggugucucuuacgugucuggugaagggguuuuaucccuccgacaucgccguugaaugggagagcaacggacaaccugagaauaacuacaaaacaacacccccuguccucgauuccgacggcucuuucuuucuguauagcaagcugaccguggauaaauccagauggcagcaggggaacguguucucuugcagcgucaugcaugaagcucuccacaaucauuacacccagaagucccugagccuuucucccggaaag

SEQ ID NO: 38984 - RNA, 642 nt, Artificial Sequence
  derived and/or modified sequence opt5 from Roledumab_LightChain1
gccaucagaaugacccagagccccuccucuuucagcgcuuccacaggcgaccgggugacgauuaccugccgcgccucucaagauaucagaaacuacgucgcgugguaucagcaaaagagcgggaaagcuccuaaguuucugauuuacgccgccuccacacuccagucuggaguuccgagccgguucuccggcagcgggucuggaaccgacuuuacacugaccaucaauucccuucagagcgaggauuucgcuacauauuacugucagcaguauuacaacucucccccuaccuuuggccaggggacgcgcguggaaauuaccagaacaguggccgcucccuccgucuucaucuuuccucccagcgacgagcaacugaaaucuggaaccgccuccgugguuugccuccugaauaacuucuauccucgggaagcgaaggugcaguggaaagucgauaaugcccuucagagcggcaacucccaggagucugugacagaacaagacagcaaggauuccaccuacagccugucuuccacgcucacacugagcaaggcugacuacgagaaacacaagguuuaugccugugaggugacccaucagggccugucuagcccggucacaaaauccuuuaaucgcggggaaugc

SEQ ID NO: 38985 - RNA, 639 nt, Artificial Sequence; identical to SEQ ID NO: 38939
  derived and/or modified sequence opt5 from Romosozumab_fab_fragment

SEQ ID NO: 38986 - RNA, 1347 nt, Artificial Sequence
  derived and/or modified sequence opt5 from Romosozumab_HeavyChain1
gaggugcagcugguccaaagcggcgccgaaguuaagaaacccggggcuuccgugaaggugucuugcaaagccagcggauacaccuucacagacuauaacaugcacugggucagacaggcgccuggccaggggcucgaguggaugggagaaaucaauccgaacuccggcggggcuggauacaaucagaaguuuaaaggccgggugacgaugaccacagauaccucuacaagcaccgccuauauggagcugcgcucccuuagaucugacgauacagccguuuacuauugugcucggcugggcuacgacgauauuuaugacgauugguacuucgacgugugggggcaaggaaccacggucaccgugagcuccgccagcacaaagggccccucuguuuuuccucucgcucccugcucccgcagcaccucugaauccacagccgcgcuggggugucuugugaaggauuacuucccugagcccgucaccgugagcuggaacucuggagcccugacguccggcgugcauacauuuccugcuguccuccagagcuccgggcuguauucucugagcuccguugugaccgugccgagcucuaauuucggaacacagaccuauaccugcaacgucgaccacaaacccuccaauacaaagguggauaaaacgguugagagaaaguguugcguggaauguccucccugcccugcucccccggucgccggcccuagcguguuucucuuucccccuaaacccaaggacacccugaugaucucucggacacccgagguuaccuguguggucguggaugucagccaugaagacccugaggugcaguucaacugguacguugacggcguggagguccacaaugccaagacaaaaccgcgcgaggaacaauucaacuccaccuuuagagugguuucugugcuuacggucgugcaucaggauuggcugaaugggaaggaauacaaaugcaaggugagcaacaaaggacuccccgcgccuauugagaagacaaucuccaaaaccaagggccagccccgggaaccucagguuuauacccugcccccgagccgcgaggagaugacaaagaaucaagucucucuuaccugucuggugaaaggguucuacccuuccgacauugccguggaaugggagagcaacggacagcccgaaaauaacuauaagacaacgccucccaugcucgauucugacggcuccuuuuuccuguacagcaaacugaccgucgauaaguccagauggcagcaagggaacguguucucuugcagcguuaugcacgaggcucuccacaaucauuacacacagaaaucccugucucuuagcccuggaaag

SEQ ID NO: 38987 - RNA, 642 nt, Artificial Sequence
  derived and/or modified sequence opt5 from Romosozumab_LightChain1
gacauccagaugacccaaagccccuccucucugagcgccuccgugggcgauagagucacaauuacgugccgggcuucucaggacaucagcaacuaccucaauugguaucagcagaaaccugggaaagccccgaagcugcuuauuuacuauaccucccgccugcucucuggaguucccagcagauucuccggcagcgggucuggaacagauuuuacccugacaaucuccagccuucaaccugaggacuucgcgaccuacuauugucagcagggcgauacacugcccuacaccuuugggggaggcacgaaaguggaaauuaagcggaccguggcugccccuucugucuucaucuuucccccuuccgacgagcagcucaaaagcggcacagccucugugguuugccugcugaacaauuucuauccgcgcgaagcuaaggugcaauggaaggucgauaacgcccuccaguccgggaauagccaggaguccgugaccgaacaggacucuaaagauagcacauacucccugagcucuacccuuacgcuguccaaggcugacuacgagaaacacaagguuuaugccugugaggugacacaucaaggacucagcucucccgucaccaagagcuuuaacagaggcgaaugc

SEQ ID NO: 38988 - RNA, 1326 nt, Artificial Sequence
  derived and/or modified sequence opt5 from Rontalizuab_HeavyChain1
gaggugcagcuggucgaaagcggcgggggacucguucaacccggcgggucccugagacuuucuugcgccaccagcggauacacauucacggaguauaucauucacugggugcggcaggcuccuggcaaggggcuggaauggguggccuccaucaacccggacuacgauauuaccaauuauaaccagcgcuuuaaaggaagauucacaaucucucucgacaagagcaaacggaccgcguaccugcaaaauucccuucgcgcugaggauacagccgucuauuacugugccucuuggauuagcgacuuuuucgauuauuggggccagggcacccuggugacaguuuccagcgcuucuaccaaggggcccuccguguuuccucucgcccccagcucuaaauccacgagcggaggcaccgcugcccuggggugccuggucaaggacuacuucccugaacccgugacaguuucuuggaacuccggagcgcucaccagcggcgugcauacauuuccugccguccugcaguccucugggcuuuacagccuguccagcguggugaccgucccgucuuccagccucggaacgcagacauauaucuguaauguuaaccacaagcccucuaauaccaaaguggauaagaaaguggagccuaagagcugcgacaaaacacauaccugucccccuugccccgcuccggagcugcuuggcggcccuuccgucuuccuguuucccccuaagcccaaggauacccucaucucuagaacacccgaagugacguguguuguggucgacgugagccacgaggauccugaaguuaaauucaacugguacguggacggggucgaggugcauaaugccaagaccaaaccgcgggaggaacaguauaacuccacauaccgcgucgugagcguucugaccgugcugcaccaagauuggcucaauggaaaggaguauaaaugcaaggucucuaacaaagcucugcccgccccuauugaaaagacaaucuccaaggcgaaaggccagcccagagagccucagguguacacccuucccccgagccgggaagagacgaagaaucagguuucucugacaugucucgugaaaggguuuuauccuuccgacauugccgucgagugggaaagcaacggacaacccgagaauaacuacaagaccaccccucccgugcuggacuccgauggcucuuucuuucuuuacagcaaacugacaguggacaagucccgcuggcagcaggggaacguuuucucuugcagcguccacgaagcucuccauaaucacuauacccaaaagucccugagccugucuccugga

SEQ ID NO: 38989 - RNA, 648 nt, Artificial Sequence
  derived and/or modified sequence opt5 from Rontalizuab_LightChain1
gacauccagacccaaagccccuccucucugagcgccuccgugggcgauagagucacaauuacgugccgggcuucucagagcguuuccaccucuagcuacuccuaucacugguaccagcagaagccugggaaagccccgaaggugcucaucagcuaugcgucuaaccuggaguccggagugcccagccgcuucucuggcuccgggagcggaacagacuuuacccuuacaauuucuucccugcaaccugaagauuucgcuaccuacuauugucagcauagcuggggcauccccagaacauuugggcagggaaccaaagucgagauuaagcggacgguggccgccccuuccguuuucaucuuucccccuucugacgaacagcucaaaagcggcaccgcuuccguggucugccugcuuaauaacuucuacccgcgcgaggccaaggugcaauggaagguugauaaugcucugcagagcggcaacucucaggaauccgugacagagcaggacagcaaagauucuaccuauagccucuccucuacacugacccugagcaaggccgacuacgagaaacacaaggucuacgcgugugaagugacgcaucaagggcucuccagccccgugacaaaaucuuuuaauagaggagagugc

SEQ ID NO: 38990 - RNA, 1341 nt, Artificial Sequence
  derived and/or modified sequence opt5 from Rontalizumab_HeavyChain1
gaggugcagcuggucgaaagcggcgggggacucguucaacccggcgggucccugagacuuucuugcgccaccagcggauacacauucacggaguauaucauucacugggugcggcaggcuccuggcaaggggcuggaauggguggccuccaucaacccggacuacgauauuaccaauuauaaccagcgcuuuaaaggaagauucacaaucucucucgacaagagcaaacggaccgcguaccugcagaugaacucccuucgcgcugaggauacagccgucuauuacugugccucuuggauuagcgacuuuuucgauuauuggggccaaggcacccuggugacaguuuccagcgcuucuaccaaggggcccuccguguuuccucucgcccccagcucuaaauccacgagcggaggcaccgcugcccuggggugccuggucaaggacuacuucccugaacccgugacaguuucuuggaacuccggagcgcucaccagcggcgugcauacauuuccugccguccugcaguccucugggcuuuacagccuguccagcguggugaccgucccgucuuccagccucggaacgcagacauauaucuguaauguuaaucacaagcccucuaauaccaaaguggauaagaaaguggagccuaagagcugcgacaaaacacauaccugucccccuugccccgcuccggagcugcuuggcggcccuuccgucuuccuguuucccccuaagcccaaggauacccucaugaucucuagaacacccgaagugacguguguuguggucgacgugagccacgaggauccugaaguuaaauucaacugguacguggacggggucgaggugcauaaugccaagaccaaaccgcgggaggaacaguauaacuccacauaccgcgucgugagcguucugaccgugcugcaccaagauuggcucaauggaaaggaguauaaaugcaaggucucuaacaaagcucugcccgccccuauugaaaagacaaucuccaaggcgaaaggccagcccagagagccucagguguacacccuucccccgagccgggaagagaugacgaagaaucagguuucucugacaugucucgugaaaggguuuuauccuuccgacauugccgucgagugggaaagcaacggacaacccgagaauaacuacaagaccaccccucccgugcuggacuccgauggcucuuucuuucuuuacagcaaacugacaguggacaagucccgcuggcagcaggggaacguuuucucuugcagcgucaugcacgaagcucuccauaaucacuauacccaaaagucccugagccugucuccuggaaaa

SEQ ID NO: 38991 - RNA, 654 nt, Artificial Sequence
  derived and/or modified sequence opt5 from Rontalizumab_LightChain1
gacauccagaugacccaaagccccuccucucugagcgccuccgugggcgauagagucacaauuacgugccgggcuucucagagcguuuccaccucuagcuacuccuauaugcacugguaccagcagaagccugggaaagccccgaaggugcucaucagcuaugcgucuaaccuggaguccggagugcccagccgcuucucuggcuccgggagcggaacagacuuuacccuuacaauuucuucccugcaaccugaagauuucgcuaccuacuauugucagcauagcuggggcauccccagaacauuugggcagggaaccaaagucgagauuaagcggacgguggccgccccuuccguuuucaucuuucccccuucugacgaacagcucaaaagcggcaccgcuuccguggucugccugcuuaauaacuucuacccgcgcgaggccaaggugcaauggaagguugauaaugcucugcagagcggcaacucucaggaauccgugacagagcaggacagcaaagauucuaccuauagccucuccucuacacugacccugagcaaggccgacuacgagaaacacaaggucuacgcgugugaagugacgcaucaagggcucuccagccccgugacaaaaucuuuuaauagaggagagugc

SEQ ID NO: 38992 - RNA, 1341 nt, Artificial Sequence
  derived and/or modified sequence opt5 from Rovalpituzumab_tesirine_HeavyChain1
caagugcaacugguccagagcggcgccgagguuaagaaacccggggcuuccgugaaggugucuugcaaagccagcggauacaccuucacaaacuauggcaugaauugggucagacaggcgccugggcagggacucgaauggaugggcuggaucaacacguacaccggggagccgacauaugcugacgauuuuaagggacgggugaccaugacaaccgacacauccaccucuacggccuacauggaacugcgcagccuuagauccgaugacaccgccguuuauuacugugcucggauuggcgauucuagccccuccgacuauuggggccaagggacacuggugaccgucagcucugccuccacaaaaggaccuagcguguucccccucgcuccuucuuccaagagcaccucuggcgggacggccgcgcugggaugccuuguuaaggauuacuuucccgagccugugacagucuccuggaauagcggcgcccugaccuccggggugcacacauucccggcugugcuccagucuagcggacuguacucccugagcucugucguuaccgugcccuccagcucucucggcacccagacauauaucuguaacgugaaucauaaaccuagcaacacgaaggucgacaaaaagguggaacccaaauccugcgauaagacccacacauguccucccugcccggccccugagcugcuuggcgggcccucuguuuuucuguucccucccaagcccaaagacacccucaugauuagccgcacaccugaggugaccugugucgugguugaugugucccaugaagacccggaggucaaguuuaauugguacguggauggagucgaagugcacaacgcuaaaacgaagcccagagaggagcaguauaauagcacauaccggguugugucuguccugaccgugcuucaucaagacuggcugaacggcaaagaauauaagugcaaaguuuccaauaaggcccucccugcgcccaucgagaagaccauuagcaaagccaaggggcagccucgcgaaccccagguguacacacugccgccuucuagagacgagcugaccaaaaaccaggucucccucacaugucuggugaagggauucuaucccagcgauaucgcuguggaaugggaguccaauggccaaccugagaacaauuacaaaacgacacccccuguucuugacucugaugggagcuuuuuccuguacuccaagcucaccgucgacaagucucgguggcagcagggaaacguguuuagcugcuccgugaugcacgaagcccugcacaaccauuauacccagaaaagccuuucucugucccccggc

SEQ ID NO: 38993 - RNA, 642 nt, Artificial Sequence
  derived and/or modified sequence opt5 from Rovalpituzumab_tesirine_LightChain1
gagaucgugaugacccagagccccgccacacuguccgucucuccuggcgaaagagcuacgcucagcugcaaggccucccaaucuguuagcaacgacguggugugguaccagcagaaaccggggcaggcgccccggcugcuuauuuauuacgcuuccaaucgcuauaccggaaucccugccagauucucuggcagcggguccggaacagaguuuacccugacaauuagcucucuccaauccgaagauuucgccgucuacuauugucagcaggacuacaccagccccuggacauuuggccaggggaccaagcuggagaucaaacggacgguggcugccccuucuguuuucauuuuucccccuuccgaugaacaacuuaagagcggaaccgcuucuguggucugccugcucaacaauuucuauccgcgcgaggccaaagugcaguggaagguugacaacgcgcugcaguccggcaauagccaggaguccgugacagaacaagauucuaaggacagcaccuacucccugagcucuacacucacccuguccaaagccgauuacgagaagcacaaagucuaugcuugugaagugacgcaucagggccuuagcucucccgugacaaagagcuuuaacagaggggagugc

SEQ ID NO: 38994 - RNA, 1341 nt, Artificial Sequence
  derived and/or modified sequence opt5 from Rovelizumab_HeavyChain1
caggugcaacugguccagagcggcgccgagguuaagaaacccggggcuuccgugaaggugucuugcaaagccagcggauacaccuucacaaacaauuggaugcagugggucagacaggcgccuggccaagggcucgaauggaugggagcuaucuuuccgggcgacgaugagacgcgguauacccagaaguuccgcgggaaagccacaauuaccgccgacacauccaccucuacagcuuacauggaacugagcucccuuagaucugaggauaccgccguguauuacuguggacggggcggcaagcugcgccccuuugcucucgacuauugggggcagggaacgcugguuaccgugagcuccgccagcacaaagggcccuucugucuucccccuugcgccuugcuccagaagcaccucugaauccacagccgcucuggggugucucgugaaagauuacuuucccgagccuguuaccgugagcuggaacucuggagcccugacguccggcguccacacauucccggcugugcugcagagcuccgggcucuauucucugagcuccguggucaccguucccucuagcucccuuggaacaaagaccuauaccugcaauguggaccauaaaccuagcaacacaaagguggauaaacgggucgagucuaaguacgggcccccuugucccagcugcccggccccugaauuucugggcggccccuccguguuccucuuuccucccaagcccaaagacacgcugaugaucucucgcaccccugagguuacauguguggucguggauguuagccaagaagacccggaggugcaguucaauugguacgucgauggaguggagguccacaacgcgaagaccaaacccagagaggaacaguuuaauuccacauaccgggugguuagcgugcuuaccguccugcaucaggacuggcucaacggcaaggaauauaaaugcaaggugucuaauaaagggcugccuuccagcauugagaagacgaucucuaaggccaaaggacaaccccgcgaaccucagguuuacacacugcccccgucccaggaggagaugaccaagaaccaagugagccucaccugucuggucaaaggcuucuauccuuccgauauugcuguggaaugggagucuaaugggcagcccgaaaacaauuacaagacaaccccucccgugcuugacagcgacggauccuuuuuccuguauucuagacucacaguugauaaaagccgguggcaggagggcaacgucuucuccugcagcgugaugcacgaagcccugcauaaucacuacacgcagaagucucuuucccugagccucggcaag

SEQ ID NO: 38995 - RNA, 654 nt, Artificial Sequence
  derived and/or modified sequence opt5 from Rovelizumab_LightChain1
gacauccagaugacccaaagccccuccucucugagcgccuccgugggcgauagagucacaauuacgugccgggcuucugagagcguugaauccuacgggaacaauuucauguauugguaccagcagaagccuggaaaagccccgaagcuccugaucuaucuugcgucuaaccuggagagcggcgugcccucccgcuuuagcgggucuggauccggcaccgacuucacacucaccauuagcucucugcagccugaagauuuugcuacauacuauugucaccaagacaaugaggaucccccuaccuucgggcagggaacaaaacuugaaaucaagagaaccguggccgcccccuccgucuuuauuuucccuccgagcgacgagcagcugaaaucuggcacggcuuccgugguuugccuccugaacaauuuuuacccccgggaggccaaggugcaguggaaggucgauaacgcucugcaaagcggcaauucccaggaaucugugaccgagcaggacagcaaagauuccacauauagccucucuuccacccugacacuuagcaaggccgacuacgaaaaacauaagguuuacgcgugugaggugacccaccaggggcugucuagcccugucacgaaauccuucaaccgcggagagugc

SEQ ID NO: 38996 - RNA, 1341 nt, Artificial Sequence
  derived and/or modified sequence opt5 from Ruplizumab_HeavyChain1
caggugcaacugguccagagcggcgccgagguugugaagcccggggcuuccgugaaacucucuugcaaggccagcggauacaucuucaccuccuauuacauguauugggucaaacaggcgccuggccaggggcuggaauggauuggagagaucaacccgucuaauggcgacacaaacuuuaaugaaaaguucaaaagcaaggcuacgcuuaccguggauaaguccgccucuacagccuacauggagcugagcucccucagaagcgaagacaccgcuguuuauuacuguacacggucugaugggcgcaacgacauggauuccuggggacaaggcacccuggugacagucagcucugccuccaccaaaggccccagcguguuuccucuugcucccucuuccaagagcacguccgggggaaccgccgcgcugggcugccucguuaaagacuauuucccugagcccgugacagucucuuggaauagcggggcccugaccuccggagugcacacauuuccugcugugcugcagagcucuggccucuacucccugagcucugucguuaccgugccgagcuccucucuugggacgcagacauacauuuguaacgugaaucauaagcccagcaacaccaaagucgauaagaagguggagccuaaauccugcgacaagacacacaccugucccccuugccccgccccggaacugcucggaggcccuagcguuuuccuguuucccccuaaacccaaggauacccuuaugaucucuagaacacccgaggugacgugugucgugguugacgugucccaugaagauccugaggucaaauucaauugguauguggacggcgucgaggugcacaacgcuaagaccaaaccgcgggaggaacaguacaauagcacauaucgcguugugucuguccugaccgugcuccaucaagauuggcugaacgggaaggaauacaagugcaaaguuuccaauaaggcccugcccgcgccuauugagaaaacaaucagcaaggccaaaggacagcccagagaaccucagguguauacccuucccccgucccgggacgagcugacgaagaaccaggucucucuuacaugucuggugaagggcuuuuacccuagcgacaucgcuguggagugggaauccaaugggcaacccgagaacaacuauaaaaccaccccucccguucucgauucugacggcagcuucuuucuguacuccaagcucacagucgauaaaagccgcuggcagcagggaaauguguucucuugcuccgugaugcacgaagcccugcacaaccauuacacccaaaagagccucucucuguccccuggg

SEQ ID NO: 38997 - RNA, 654 nt, Artificial Sequence
  derived and/or modified sequence opt5 from Ruplizumab_LightChain1
gacaucgugcugacccagagccccgccacacucuccgucucuccuggcgagagagcuacgauuagcugccgggccucccaacgcguuucuagcuccaccuacucuuauaugcacugguaccagcagaagccggggcagcccccuaaacugcuuaucaaguaugcgagcaaccuggaauccggagugcccgcuagauucagcggcucuggguccggaacagauuuuacccucacaauuagcucuguggagccugaagacuucgccaccuacuauugucaacauuccugggagauucccccuacauuuggcgggggaaccaaacuggaaaucaagcggacggucgccgcuccgagcguguucaucuuucccccuucugaugagcagcuuaaauccggcaccgccagcguugugugccugcucaauaacuucuacccccgcgaggcuaagguccaguggaagguggacaaugcccugcaguccggcaacucucaagaaagcguuacagagcaggauuccaaagacagcaccuauucucuguccagcacacucacccugucuaaggcggauuacgaaaaacacaagguguacgccugugaggucacgcaucaggggcuuagcuccccugugacaaaaucuuuuaauagaggagagugc

SEQ ID NO: 38998 - RNA, 1353 nt, Artificial Sequence
  derived and/or modified sequence opt5 from Sacituzumab_govitecan_HeavyChain1
caggugcaacugcagcagagcggcuccgagcucaagaaacccggggccucugucaagguuagcugcaaggcuuccggauacaccuucacaaacuauggcaugaauugggugaaacaggccccugggcaaggacugaaauggaugggcuggaucaacacguacaccggggaaccgacauauaccgacgauuuuaagggaagauucgcguuuucucuugacacaagcguguccaccgcuuaccugcagauuucuagccucaaggccgaugacacagccgucuauuucugugcucggggcggcuuuggguccagcuacugguauuucgauguguggggacagggcucucugguuaccguguccagcgccucuacgaaagggcccuccgucuuuccucuugcucccagcucuaaguccaccagcggaggcacagccgcgcuggggugccucgugaaagacuacuucccugagcccguuaccguguccuggaacucuggagcccugacaagcggcguccacaccuuuccugcugugcugcaguccagcggccucuacucucuguccagcguggucacgguuccgucuagcucccuugggacacaaaccuauaucuguaaugugaaucauaagcccucuaacacaaaaguggauaagcgcgucgaaccuaagagcugcgacaaaacccacaccugucccccuugccccgccccggagcugcucggaggcccuuccguguuccuguuucccccuaagcccaaagauacacuuaugauuagcagaacgcccgaaguuaccuguguggucguggacguuucucaugaggauccugaggugaaguucaauugguacgucgacgggguggaaguccacaacgcuaaaacaaagccgcgggaggaacaguauaauuccaccuaccgcgugguuagcgugcugacaguccuccaucaggauuggcugaacggaaaagaguauaagugcaaggugucuaauaaagcccugcccgcgccuaucgagaagaccauuuccaaagccaagggccagcccagagaaccucaaguuuacacgcugcccccgagccgggaggaaaugaccaaaaaccaggugucccucacaugucuugucaagggguuuuauccuucugacaucgcuguggagugggaaagcaauggacagcccgagaacaauuacaagaccacaccucccgugcuggacuccgauggcucuuucuuccucuacagcaaacugaccguugacaagucccgcuggcaacagggcaacgucuuuagcugcucugugaugcacgaggcccuucacaaccauuauacacagaaaucccugagccucucuccugggaag

SEQ ID NO: 38999 - RNA, 642 nt, Artificial Sequence
  derived and/or modified sequence opt5 from Sacituzumab_govitecan_LightChain1
gacauccagcugacgcaaagccccuccucucucagcgccuccgugggcgauagagucucuauuacaugcaaggcuagccaggacguuuccaucgccguggcgugguaccagcagaaaccugggaaggcuccgaaacugcuuauuuauucugccagcuaccgguauacgggagugcccgaucgcuucuccggcagcgggucuggaaccgacuuuacacugaccaucuccagccuccaaccugaggauuucgccgucuacuauugucagcagcacuacauuacaccccugaccuuuggcgcugggacaaagguggaaaucaaaagaaccguugccgcuccuucuguguucaucuuucccccuuccgacgagcagcuuaagagcggaacggccucugucgugugccugcucaacaauuucuauccgcgggaagcgaagguucaauggaaaguggauaacgcccugcaguccggcaauagccaggaguccgucaccgaacaggacucuaaggauagcacauacucccugagcucuacccucacacuguccaaagcugacuacgagaagcauaaaguguaugccugugaggugacccaccaaggccuuagcucucccgucaccaagagcuuuaaccgcggggaaugc

SEQ ID NO: 39000 - RNA, 1326 nt, Artificial Sequence
  derived and/or modified sequence opt5 from Samalizumab_HeavyChain1
caggugcaacugcagcagagcggcuccgagcucaagaaacccggggccucugucaagaucagcugcaaggcuuccggauacucuuucaccgacuauauuauccuguggguuagacagaacccuggcaaagggcuugaauggauuggacacaucgauccguacuauggcagcuccaauuacaaccugaaauuuaaggggcgggugacaauuacggccgaccaaucuaccacaaccgcguauauggagcucagcucccugcgcagcgaagauacagcuguguacuauuguggaagaucuaagcgggacuacuucgauuacuggggccagggcaccacacuuaccgucuccagcgccucuacgaaagggcccuccguguuuccucuggcccccugcagccgcucuaccuccgagagcacagcugcccucggaugucugguuaaggacuauuucccugaacccgugaccgucuccuggaacucuggcgcucugacaagcggggugcauaccuuuccugccguucuccaguccagcggacuguacucucuuuccagcguggucacggugccgucuagcaauuucggcacacagaccuauacaugcaauguggaucacaaacccuccaacaccaaggucgacaaaaccguugagagaaaguguugcguggaguguccucccugcccugcgcccccgguggccgggccuucugucuuucuguuucccccuaagcccaaagauacacucaugaucagccggacgcccgaagugaccuguguuguggucgacgugucccaagaggauccugaaguucaguucaauugguacguggacggagucgaggugcauaacgcuaagacaaaaccgcgcgaggaacaguucaauagcaccuauagagucgugucuguucugacagugcuucaccaggauuggcugaacggcaaggaguacaaaugcaaggucuccaauaaaggccuccccagcucuaucgaaaagaccauuuccaaggccaaagggcaaccucgggagccccagguguauacgcugccucccagccaggaagagaugacaaagaaccaaguuucccugaccugucucgugaaaggauuuuacccgucugacaucgcugucgagugggaaagcaauggccagccugagaacaauuacaagaccacacccccugugcuggacuccgaugggucuuucuuucuuuauagccgccugaccguggacaaauccagauggcaggaaggaaacguuuucagcugcucugucaugcaugaggcccuccacaaccacuacacacagaagucccugagccuuucucugggc

SEQ ID NO: 39001 - RNA, 642 nt, Artificial Sequence
  derived and/or modified sequence opt5 from Samalizumab_LightChain1
gacauccagaugacccaaagccccuccucucugagcgccuccauuggcgauagagugacaaucacgugcaaggcuucucaggacauuaacagcuaccucuccugguuccagcagaaaccugggaaggccccgaaacugcuuaucuaucgggcgaaucgccuggucgauggaguucccucuagauuuagcggcuccgggagcggaaccgacuacacacucaccauuucuucccugcaaccugaggauuucgcuguguauuacugucuucaguaugacgaauuucccuacacauucggcgggggaaccaagcuggagaucaaacggacaguggccgccccuagcgucuuuaucuuucccccuucugaugaacagcucaaguccggcaccgcuagcgugguuugccugcugaacaauuucuauccgcgcgaggccaaggugcaguggaaagucgacaacgcucuccaaucuggcaauucccaggaaagcgugacggagcaggauuccaaggacucuaccuacagccuguccagcacacuuacccugucuaaagccgauuacgagaagcacaaaguuuaugcgugugaagugacacaucaggggcucuccagccccgucaccaagucuuucaacagaggagagugc

SEQ ID NO: 39002 - RNA, 1338 nt, Artificial Sequence
  derived and/or modified sequence opt5 from Sarilumab_HeavyChain1
gaggugcagcuggucgaaagcggcgggggacucguucaacccggcagaucccugcggcuuucuugcgccgcuagccgcuucaccuuugacgauuacgccaugcacugggugagacaggcgccugggaagggacuggaguggguguccggcaucucuuggaacagcgggcggauuggauaugcugacuccgucaaaggccgcuucacaaucucuagagauaaugccgaaaacagccucuuucugcagaugaauggccuucgggccgaggacacggcucuguacuauugugccaaggggcgcgauuccuucgacauuuggggacagggcaccauggugacaguuagcucugcuuccaccaaagggccgagcguguuuccccucgccccuucuuccaagagcacaucuggaggcaccgcggcccuggggugccuggucaaagauuacuuccccgaaccugugacaguuuccuggaacagcggagcucucaccuccggcgugcauacguuucccgccguccugcaaucuagcggccuuuauucccugagcucuguggugaccgucccuuccagcucucucgggacacagaccuacaucuguaauguuaaccacaagccgagcaauacaaagguggacaaaaagguggagcccaaauccugcgauaagacccauacguguccucccugcccugcucccgagcugcuuggaggcccgucugucuuccuguuuccucccaaaccuaaggacacacucaugauuagcagaacccccgaagugacauguguuguggucgaugugucccacgaggaccccgaaguuaaguucaacugguauguggauggggucgaggugcauaaugccaaaaccaagccucgggaggaacaguacaacagcaccuaccgcgucgugucuguucugacagugcugcaccaggacuggcucaauggaaaagaguauaagugcaaagucuccaacaaggcgcugccggcccccaucgaaaagacgaucagcaaggcuaagggccaaccuagagagccccagguguacacccuuccucccucucgggacgaacugaccaaaaaucagguuucccucaccugucuggugaagggguuuuauccgagcgauauugccgucgagugggaguccaacggacagccugaaaauaacuacaaaacaacacccccugugcuugacucugauggcagcuucuuucuguauuccaagcucacgguggacaaaucucgcuggcaacagggcaacguuuucagcugcuccgucaugcacgaggcucugcauaaucacuacacacagaaaagccugucucucucccccgggaag

SEQ ID NO: 39003 - RNA, 642 nt, Artificial Sequence
  derived and/or modified sequence opt5 from Sarilumab_LightChain1
gacauccagaugacccaaagccccuccucugugagcgccuccgucggcgauagaguuacaauuacgugccgggcuucucaggggaucagcuccuggcuggccugguaccagcagaagccuggaaaagcgccgaagcuccugauuuauggcgcuucuagccuugaguccggggugcccagccgcuucucuggauccggcagcgggaccgacuuuacacugaccaucucuucccuccaaccugaagauuucgccagcuacuauugucagcaggccaacucuuuucccuacacauucggacagggcaccaaacuggagauuaagagaacaguggcugccccuuccgucuuuaucuuucccccuagcgacgaacaacuuaaauccggcaccgcuucugugguuugccugcucaauaacuucuauccgcgggaggccaaggugcaguggaaggucgauaaugcgcugcagagcgggaacucccaggaaagcgugacggagcaagacucuaaagauuccaccuacagccugucuagcacacucacccuguccaaggccgacuaugagaaacacaagguuuacgcuugugaagugacacaucagggacuuucuagccccgucaccaaauccuucaaucgcggcgagugc

SEQ ID NO: 39004 - RNA, 1296 nt, Artificial Sequence
  derived and/or modified sequence opt5 from Satumomab_pendetide_HeavyChain
caggugcaacugcagcagagcgacgccgagcucgucaagcccggcgcuuccguuaaaaucucuugcaaggccagcggguacaccuucacagaucacgcgauucauugggcuaaacagaagccugaacaaggacuggaguggaucggcuauauuuccccggggaacgacgauaucaaauacaaugaaaaguuuaagggaaaagccacgcuuaccgccgacaagucuagcuccacagcuuauaugcagcugaacucucucaccagcgaggauuccgccguguacuucuguaaaagaagcuauuacggccacugggggcagggaacaacccugacagugucuuccgcuagcaccaagggccccucugucuuuccucuugcccccugcucccggagcacgucugaauccaccgcggcccugggcugucucgugaaagacuauuucccugagcccguuacagugagcuggaacuccggggcucugaccucuggaguccauacauuuccugccgugcugcagagcuccggccucuacagccugucuuccguugugaccgucccgagcucuagccuugggacgaagacauauaccugcaauguggaucacaagcccuccaauacaaaaguggacaagcgcgucuguccucccugcaaauguccugcucccaaccugcucggaggcccgucuguuuucauuuuuccucccaagaucaaagaugugcugaugaucagccuuuccccuauugugaccugcgucgugguugacgugagcgaggaugaccccgauguccaaaucucuugguucgugaauaacguugaagugcauaccgcccagacacagacgcacagagaggacuacaauuccacccugcgggucgugagcgcgcuccccauucagcaccaagacuggaugucugggaaggaauuuaaauguaaggucaacaauaaggaucugccugccccgaucgagcgcacaauuuccaaacccaagggaagcgugagagcuccucagguuuacgugcugcccccucccgaggaagagaugaccaaaaagcaggucacacugaccugcauggugacggacuucaugccggaagauaucuauguugaguggacaaacaauggcaaaaccgaacucaacuacaagaauaccgagccugugcuugacuccgauggcucuuauuuuauguacagcaagcugcgggucgagaaaaagaacuggguggaacgcaacuccuauucuuguagcgugguucaugaggggcuccacaaucaucacacaaccaaauccuucagcaga

SEQ ID NO: 39005 - RNA, 630 nt, Artificial Sequence
  derived and/or modified sequence opt5 from Satumomab_pendetide_LightChain
gacauccagaugacccaaagccccgccucccugucugugagcgucggcgagacaguuacgauuaccugcagagcuuccgaaaacaucuacucuaaucucgccugguaucagcagaagcaggggaaaagcccucaacugcuuguguacgcggcuacaaaccuggccgauggagugccgucccgguucucuggcagcggguccggaacccaguauagccucaagauuaauucucugcaguccgaggacuuuggcagcuacuauugucagcacuucugggggacacccuacaccuuuggaggcggcacacgccuugaaaucaaaagagccgaugcugccccuaccgucuucauuuuucccccuucugacgagcaacugaaguccgggacggcuagcgugguuugccuccugaacaauuucuauccccgggaagccaaagugcaguggaaggucgauaacgcgcugcagucuggaaauucccaggagagcgugaccgagcaagacuccaaggauucuacauacagccucuccagcacccugacacuuucuaaagccgacuacgaaaagcauaaaguuuaugcuugugaggugacccaccagggccuguccagcccugucacgaagucuuuuaac

SEQ ID NO: 39006 - RNA, 1371 nt, Artificial Sequence
  derived and/or modified sequence opt5 from Secukinumab_HeavyChain1
gaggugcagcuggucgaaagcggcgggggacucguucaacccggcgggucccugagacuuucuugcgccgcuagcggauucaccuuuuccaacuacuggaugaauugggugcggcaggccccuggcaaggggcuggaguggguggcggcuaucaaccaggacggaucugaaaaauauuacgucggcagcgugaagggccgcuucacaauuuccagagauaaugccaaaaacucucucuaucugcagaugaauagccuucggguugaggacacggccguguacuauuguguccgcgauuacuaugacauccugaccgauuacuacauucacuauugguacuuugaccucugggggagaggaacacuggugaccguuuccagcgcuucuacaaagggcccguccguguucccccuggccccuagcucuaaauccaccagcgggggaacagcugcccucggcugccuggucaaggauuauuuucccgaaccugugaccgugucuuggaacuccggggcgcuuacgagcggaguccauaccuuccccgccguucugcaauccucuggccucuacagccuguccagcguggugacagucccuucuuccagccuuggcacccagacauauaucuguaaugugaaccacaagccgucuaauaccaaaguugacaagcggguggagcccaaaagcugcgauaagacgcauacauguccucccugcccugcucccgagcugcucgggggaccguccgucuuucuguucccucccaaaccuaaggacacccugaugauuucucgcacacccgaagugaccuguguuguggucgaugugagccacgaggaccccgaagucaaguuuaacugguacguggauggcguugaggugcauaaugccaaaaccaagccuagagaggaacaguauaacuccacauaccgggucgugagcguucucacggugcugcaccaggacuggcuuaaugggaaagaguacaagugcaaagucucuaacaaggcucugccggcccccaucgagaaaaccaucuccaaggcgaagggacaaccucgcgaaccccagguguauacacucccucccagcagagaagagaugaccaaaaaucaggugucucugacaugucuuguuaagggcuucuacccguccgacauugccgucgagugggaaagcaacgggcagccugagaacaauuauaaaaccacgcccccugugcuggauuccgacggaucuuucuuucucuacagcaagcugacaguggauaaaucccgguggcaacagggcaacgucuuuucuugcagcgugaugcacgaagcucugcauaaucacuauacccagaagucccucagccugucucccggcaag

SEQ ID NO: 39007 - RNA, 645 nt, Artificial Sequence
  derived and/or modified sequence opt5 from Secukinumab_LightChain1
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccuugcaccuuuggccagggcacaagacucgagaucaaacggaccguggcugcccccagcguguucauuuuuccuccgucugaugaacagcugaaguccgggacggcuagcgucgugugucugcucaacaauuucuacccccgcgaggccaaaguucaauggaagguggacaacgcgcugcaguccggaaauucucaggagagcgucaccgaacaggauuccaaagacagcacauauucucuuuccagcacccugacacucucuaaggccgauuacgagaagcacaaaguguacgcuugcgaaguuacccaucaaggccugagcuccccugugacgaagucuuuuaacagaggggagugu

SEQ ID NO: 39008 - RNA, 1335 nt, Artificial Sequence
  derived and/or modified sequence opt5 from Seribantumab_HeavyChain1
gaggugcagcugcucgaaagcggcgggggacugguccaacccggcgggucccuuagacugucuugcgccgcuagcggauucaccuuuucccacuacguuauggccugggugcggcaggcgccuggcaaggggcucgagugggugucuagcaucuccucuagcggaggcuggacacuguaugcugacuccgucaaaggccgcuucacgauuagcagagauaacucuaagaauacccuuuaccugcagaugaacucccuccgggccgaagacacagccguguauuacuguacccgcgggcugaaaauggcuacaaucuuugauuauuggggacagggcacccugguuacagugagcucugccuccaccaaggggccgagcgucuucccccucgcuccuugcucuagauccacgagcgaguccaccgccgcgcugggaugucuugugaaagacuacuuucccgaaccuguuacagugucuuggaauagcggcgcccugaccuccgggguccauacauuccccgcugugcuccaaagcucuggacuguauucccuuagcucuguggucaccguuccuagcuccaacuuuggcacgcagacauacacaugcaauguggaucacaagccgucuaacacaaagguggacaaaaccgucgagcggaaguguugcguggagugucccccuugccccgccccucccguugcuggcccgagcguguuccuguuuccucccaaaccuaaggauacccucaugauuucccgcacacccgaagucacgugugugguuguggacgucagccaugaggaucccgaagugcaguucaauugguacgucgacgggguggagguucacaacgccaaaaccaagccuagagaggaacaguuuaauucuacauuccggguggucuccgugcugaccguugugcaucaagauuggcugaacggaaaggaguauaaaugcaaggucagcaauaaaggccucccggcgcccaucgaaaagacaauuucuaaaaccaaggggcagccucgcgagccccagguguacacgcugccucccuccagagaagagaugaccaaaaaccaggugagccuuaccugucugguuaagggauuuuauccguccgacaucgccgucgagugggaaucuaauggccaaccugagaacaauuacaagaccacacccccuaugcucgauagcgacggguccuucuuccuguauucuaaacuuaccguggacaagagccgguggcagcagggaaacguguuuuccugcagcgucaugcacgaagcucugcacaaccauuacacacaaaaaucucucucccugagccccggcaag

SEQ ID NO: 39009 - RNA, 651 nt, Artificial Sequence
  derived and/or modified sequence opt5 from Seribantumab_LightChain1
cagagcgcccugacccaacccgcuuccgugucuggcagcccugggcaguccaucacaauuucuugcacgggaaccagcuccgacgucggcucuuacaacguugugagcugguaucagcagcacccggggaaggcccccaaacucaucauuuacgaggugucccaaagaccuagcggagucucuaaucgguucuccggcagcaagucugggaacacagcgucccugaccaucagcggacuucagacagaagaugaggcugacuauuacuguugcucuuaugccggcuccagcauuuuugugaucuucggcgggggaaccaaaguuacagugcugggccagcccaaggccgcuccuuccgucacccucuuucccccuucuagcgaagaacugcaggccaauaaagcuacgcuugugugucugguuuccgauuucuacccgggggccgugaccgucgcguggaaggccgacggaagccccgugaaggugggcgucgaaacaaccaaaccuucuaagcaauccaacaauaaauaugcugccagcucuuaccucagccugacacccgagcaguggaagucccaucgcucuuacagcugcagaguuacccacgagggguccacgguggagaaaacaguggcuccugccgaguguagc

SEQ ID NO: 39010 - RNA, 1353 nt, Artificial Sequence
  derived and/or modified sequence opt5 from Setoxaximab_HeavyChain1
gaggugcagcugcaacagcccggcccugaacucgagaagccgggggccagcgucaaacuguccugcaaggcuucuggauacagcuucaccgacuauaacaugaauuggguuaaacagaacaauggcgaaucccuugaguggaucgggaagauugaucccuacuauggaggcccuucuuacaaccagaaauuuaaggacaaggccacacugacgguggauaaaagcuccucuaccgcguauaugcaacucaagagccugacauccgaagacagcgcuguguacuauuguaccagagggggaaaucgggauugguacuucgacgucuggggcgccggcacaacccuuacagugucugccgaguuugcuuccaccaaagggcccagcguuuucccucuggcccccucuuccaagagcacgucuggaggcaccgcugcccucgggugccuggugaaagauuacuuuccugagccggucacaguguccuggaacagcggagcgcugaccuccggcguucacacauuccccgccgugcuccagucuagcgggcuguauucccuuagcucugucgugaccgugccuuccagcucucugggaacgcagacauacaucuguaaugucaaccauaagcccagcaauaccaagguugacaaaaagguggaaccuaaauccugcgauaagacacacaccugucccccgugcccugcucccgagcuccugggcggcccuucuguguuucuuuucccucccaaacccaaggacacccugaugauuagccgcacaccggaagucacgugugugguuguggaugucucccaugaggaccccgaggugaaauuuaacugguauguugaugggguggaaguccacaaugccaagaccaagccuagagaggaacaguacaacagcacauaucggguggucucugugcucaccguucugcaucaagacuggcugaauggaaaagaguacaagugcaaaguguccaacaaggcucuccccgccccuaucgagaaaacaauuagcaaggcgaagggccagccccgcgaaccgcaggucuauacccugccucccucuagagacgagcuuacgaaaaaucaggugucccugacaugucucguuaagggguucuacccuagcgauaucgccguggaaugggaguccaacggacaacccgaaaacaauuacaaaaccaccccucccguccuggacucugauggcagcuuuuuccuuuauuccaagcugacaguggacaaaucucgguggcagcaggggaacguguuuagcugcuccguuaugcacgaggcucuccacaaucauuacacccaaaagagccugucucuguccccgggaaag

SEQ ID NO: 39011 - RNA, 660 nt, Artificial Sequence
  derived and/or modified sequence opt5 from Setoxaximab_LightChain1
gacaucgugcugagccagucccccucuagccucgucguuuccgugggcgagaaagugaccaugucuugcaaaagcucccaaucucugcuuuacagcagaaaccagaagaauuaucuggccugguaccagcagaaaccugggcaauccccgaagguccucauuuauugggcuagcacacgggaaucuggagugcccgaucgccugacgggcuccgggagcggaaccgacuucacacuuaccaucucuuccguuaaagccgaggaucuggcgguguacuauugucagcaguacuauagcuacccucucacauuuggcgcugggaccaagcuggaacugaagagaacagucgccgcccccucuguguucauuuuuccucccuccgacgagcagcucaaaagcggaaccgcuuccguugugugccugcuuaacaauuucuacccucgggaagccaagguccaauggaaaguggauaacgcucugcagucuggcaauagccaggaguccgugacggagcaggacagcaaggauucuaccuauucccucagcucuacacugacccuuagcaaagccgacuacgaaaagcacaaggucuaugcgugugagguuacacaucaaggccuguccucuccggugaccaagagcuuuaaccgcggggaaugc

SEQ ID NO: 39012 - RNA, 1338 nt, Artificial Sequence
  derived and/or modified sequence opt5 from Sifalimumab_HeavyChain1
caggugcaacugguccagagcggcgccgagguuaagaaacccggggcuuccgugaaggugucuugcaaagccagcggauacaccuucacauccuauucuaucagcugggucagacaggcgccuggccaggggcucgaauggaugggauggauuuccguguacaacggcaauacgaacuaugcucaaaaguuucaggggcggguuaccaugacaaccgacacaucuaccagcacagccuaccuggagcuucgcucccugagaagcgaugacaccgccguguauuacugugcucgggauccgaucgccgcuggauauuggggccagggcacgcucgucaccgugucuuccgccagcacaaaagggcccucuguuuucccucuggcgcccuccagcaagucuaccuccggaggcacagccgcucuugggugccuggugaaggacuacuuuccugaacccgucaccgugagcuggaacuccggagcccucacgucuggcgugcacacauucccugcuguccugcagagcuccgggcuguacagccucucuuccguugugaccgugccgagcucuagccugggaacacaaaccuauauuuguaaugucaaucauaaacccuccaacaccaagguggauaaaaagguugagccuaaaucuugcgacaagacacacacgugucccccuugccccgccccggaacuucugggcggcccuagcguguuucucuuucccccuaagcccaaagauacccugaugaucucccgcacacccgaggucaccugugugguuguggacgucagccaugaggauccugaagugaaguucaauugguacgucgacgggguggagguucacaacgcgaaaacaaagccgagagaggaacaguauaauucuaccuaccggguggucuccgugcuuacgguucugcaucaggauuggcucaacggaaaagaguauaagugcaaagugagcaauaaggcccugcccgcuccuauugaaaagacaaucucuaaagccaagggccagccccgcgagccucaagucuacacccugcccccguccagagaagagaugaccaaaaaccaggugagccucacaugucuggugaagggguucuauccuuccgacaucgcuguugaaugggagucuaauggacagcccgagaacaauuacaaaaccacaccucccguccuugauagcgacggcuccuuuuuccuguacucuaagcucacgguggacaagagccgguggcaacaggggaacguguuuuccugcagcgucaugcacgaagcccugcacaaccauuauacccagaaaucucuuucccugagcccuggaaag

SEQ ID NO: 39013 - RNA, 645 nt, Artificial Sequence
  derived and/or modified sequence opt5 from Sifalimumab_LightChain1
gagaucgugcugacccagagccccggcacacucucccugucuccuggggaaagagccacgcuuagcugccgggcuucccaaucugucagcuccaccuaccuggccugguaucagcagaagccgggacaggcgccccgccuccugauuuacggcgcuucuagcagagccacagggaucccugaccgguucuccggaagcggcucugggaccgauuuuacacuuaccauuucccgccuggagcccgaagacuucgccguuuauuacugucaacaguauggaagcucuccuagaacauuuggccagggcaccaaaguggagaucaagcggacgguggcugcccccuccgucuucauuuuuccuccgagcgaugaacagcucaaaucugggaccgcuuccgugguuugccugcugaacaauuucuacccccgcgaggccaaggugcaauggaaagucgacaacgcgcuccagagcggaaauucccaggagucugugacagaacaggauagcaaggacuccaccuauagccugucuuccacacuuacccugagcaaggccgauuacgagaaacacaagguuuacgcuugugaagugacgcaucaaggccucucuagcccugucacaaaauccuuuaacagaggggagugc

SEQ ID NO: 39014 - RNA, 1347 nt, Artificial Sequence
  derived and/or modified sequence opt5 from Siltuximab_HeavyChain1
gaggugcagcuggucgaaagcggcgggaagcuccugaaacccggaggcucccuuaagcugucuugcgccgcuagcggguucaccuuuuccucuuucgccaugagcugguuuagacaauccccugagaaacggcucgaauggguugcggagaucucuagcggaggcuccuacacauauuacccggacacggugaccgggcgcuucacaauuagcagagauaacgcuaagaauacccuguaucuugaaaugucuucccugcggagcgaggacacagccauguacuauugugcccgcggacucuggggcuacuaugcucuggauuacuggggccaggggaccucugugacagucuccagcgccucuaccaaaggacccuccguguuuccucuggcucccagcuccaagucuacgagcggcgggaccgccgcgcucggaugccugguuaaggacuacuucccugagcccgugacagucuccuggaacagcggcgcccuuaccucuggggugcacacauuuccugcuguucugcaguccagcggacucuauucucugagcuccguggucaccgugccgucuagcucccuuggcacgcagacauacaucuguaaugugaaccauaaacccagcaauaccaaggucgauaaaaagguugaaccuaaaucuugcgacaagacacacaccugucccccuugccccgccccggagcugcucggcgggccuuccguguuccuguuucccccuaagcccaaagauacccugaugauuagcagaacacccgaagugacgugugucgugguugacgugucucaugaggauccugaggucaaguucaacugguauguggacggaguugaagugcacaaugcuaaaaccaagccgcgggaggaacaauacaacuccacauaucgcgucgugagcguccucaccgugcugcaucaggauuggcuuaauggcaaagaguacaagugcaaaguuuccaacaaggcccugcccgcgccuaucgaaaagacaauuucuaaagccaaggggcagcccagagagccucagguguauacccugcccccgagccgggacgagcucacgaaaaaucaagucucccuuacaugucuggugaagggauuuuacccuucugauaucgcuguugaaugggagagcaacggccagcccgaaaauaacuacaaaaccaccccucccgugcucgacuccgacgggagcuucuuucuguauucuaagcugacagucgauaagucccgcuggcagcagggaaauguguucagcugcucugugaugcacgaggcccuccacaaccauuacacccaaaaaucccugagccuuucuccuggcaag

SEQ ID NO: 39015 - RNA, 639 nt, Artificial Sequence
  derived and/or modified sequence opt5 from Siltuximab_LightChain1
cagaucgugcugauucaaagccccgccaucauguccgcuucuccuggcgagaaggucaccaugacaugcagcgccuccucuagcguuuccuacauguauugguaccagcagaaaccggggucuagccccagacuccugauuuaugacacguccaaccuugcgagcggagugccugugcgguucucuggcuccgggagcggaaccucuuacucccugacaaucagccgcauggaagcugaggaugccgccaccuauuacugucagcaauggucuggcuaucccuacacauuugggggaggcaccaagcucgaaauuaaaagaacagucgcugccccuuccguguucaucuuucccccuagcgacgagcagcugaaguccggcaccgcuucuguugugugccuucugaauaacuucuacccgcgggaagccaaaguccaguggaagguggauaaugcgcuccagagcgggaacucccaagagagcguuacggagcaggacucuaaggauuccaccuauagccugucuagcacacugacccucuccaaagccgacuacgaaaagcacaaaguguaugcuugugaggucacacaucagggacugucuagccccgugaccaaguccuuuaaucgcggcgaaugc

SEQ ID NO: 39016 - RNA, 1329 nt, Artificial Sequence
  derived and/or modified sequence opt5 from Simtuzumab_HeavyChain1
caggugcaacugguccagagcggcgccgagguuaagaaacccggggcuuccgugaaggugucuugcaaagccagcggauacgcguucaccuauuaccucaucgaaugggucagacaggcuccuggccaggggcuggaguggauuggagugaucaacccgggcuccgggggaacaaauuauaacgaaaaguuuaaaggccgggccacgauuaccgccgacaagucuacaagcaccgcuuacauggagcuuuccucucugcgcagcgaagauacagccguuuauuucugugcuagaaauuggaugaacuuugacuacuggggccaagggaccacagugaccgucuccagcgccucuacgaagggacccuccguguucccucucgcgcccugcagccggucuaccuccgagagcacagccgcucugggcugucuuguuaaagauuauuuuccugagcccgugaccgucucuuggaacuccggggcccugacaagcggagugcacaccuucccugcugugcuccaguccucuggccuguacagccuguccagcgucguuacggugccgucuuccagccucgggacaaagaccuacacaugcaauguggaccauaaacccucuaauaccaaggucgauaaacgcguggaaagcaaguauggaccucccuguccucccugcccggccccugaguuucugggcggccccuccguuuuccuuuuuccucccaagcccaaagacacccugaugaucucuagaacaccugaagugacgugugucgugguugaugugagccaggaggacccggagguccaguucaacugguacguggauggggucgaagugcacaaugcgaagaccaaaccccgggaggaacaauuuaacuccacauaucgcguugugagcguccucaccgugcugcaucaggacuggcuuaauggaaaggaguacaaaugcaagguuucuaacaaaggccugccuuccagcauugaaaagacaaucucuaaggccaaagggcagcccagagagccucagguguauacccugcccccgucccaagaggaaaugacgaagaaucaggucagccucacaugucuggugaaaggauucuacccuuccgauaucgcuguggagugggaaucuaacggccagcccgagaauaacuauaagaccaccccucccguucucgacagcgauggguccuuuuuccuguacucucggcuuacagucgacaaaagccgcuggcaagaaggaaacguguucuccugcagcgugaugcacgaggcccugcauaaucacuacacccagaagucucucucccugagccuuggcaag

SEQ ID NO: 39017 - RNA, 657 nt, Artificial Sequence
  derived and/or modified sequence opt5 from Simtuzumab_LightChain1
gacaucgugaugacccagacaccccugagccucuccgucacgccuggccaaccggccucuauuagcugcagauccucuaaaagccugcuucacuccaacgggaauaccuaccuguauugguuccuccagaaacccggacagucuccucaguuucugaucuaccggaugagcaaccuugcuuccggcguucccgaucgcuucagcgggucuggauccggcacagacuuuacccugaagauuagcagaguggaggccgaagaugugggggucuauuacuguaugcaacaucucgaguauccuuacacauucggaggcggcaccaaaguggaaaucaagcggacaguugcggcucccucuguguuuauuuucccuccguccgacgagcagcugaaaagcgggaccgccucugucgugugccugcucaauaacuuuuauccccgcgaagccaagguucaguggaagguggauaaugcucugcaguccggaaacagccaagaguccgucacggagcaggacucuaaagauagcaccuacucccuuagcucuacacugacccucuccaaggccgacuacgaaaaacacaagguguaugcuugugaggugacacaucagggccugagcucuccugucaccaagagcuucaauagaggggaaugc

SEQ ID NO: 39018 - RNA, 1347 nt, Artificial Sequence
  derived and/or modified sequence opt5 from Sirukumab_HeavyChain1
gaggugcagcuggucgaaagcggcgggggacucguucaacccggcgggucccugagacuuucuugcgccgcuagcggauucaccuuuuccccuuucgccaugucuugggugcggcaggcgccgggcaaggggcuggaguggguggcuaaaaucagccccggaggcuccuggacauacuauucugacacggucaccggccgcuuuacaauuagcagagauaacgccaaaaauucccucuaccugcagaugaacagccuucgggccgaagacaccgcuguguauuacugugcccgccagcuguggggguauuacgcucucgauaucuggggacaaggcacaaccguuacagugucuuccgccagcaccaaggggccuucugucuucccccuggcgccuuccagcaagucuacguccggaggcaccgccgcucuggggugccucgugaaagacuauuuucccgagccuguuacagugagcuggaacuccggagcccugaccucuggcguccacacauucccggcugugcuucagagcuccggccuguacagccucucuuccguggucaccguucccagcucuagccuggggacgcagacauacauuuguaaugugaaucauaagccuuccaacaccaagguggauaaaaaggucgaacccaaaucuugcgacaagacacacaccuguccucccugcccggccccugagcuucugggaggccccagcguguuucucuucccucccaaacccaaggauacccugaugaucuccagaacaccugagguuacguguguggucguggacguuagccaugaagauccggaggugaaguuuaauugguaugucgacgggguggaaguccacaacgcgaaaaccaagccccgggaggagcaguacaauucuacauaucgcgugguuuccgugcugaccguccuccaucaagauuggcugaacggaaaagaauacaagugcaaagugagcaauaaggcccuuccugcucccauugagaaaacaaucucuaaggccaagggccagccuagagaaccccagguuuauacccugccgccuucccgggacgagcucacgaaaaaccaggugagccugacaugucuugucaagggguucuaccccuccgauaucgcuguggaaugggagucuaauggacaaccugagaacaauuauaaaaccacacccccugugcuggacagcgacggcuccuuuuuccucuacucuaagcugaccguugauaaaagccgcuggcagcagggcaacgucuuuuccugcagcgugaugcacgaagcccugcacaaccauuacacccaaaagucucucucccugagccccgggaag

SEQ ID NO: 39019 - RNA, 639 nt, Artificial Sequence
  derived and/or modified sequence opt5 from Sirukumab_LightChain1
gagaucgugcugacccagagccccgccacacucucccugucuccuggcgaaagagcuacgcuuagcugcuccgccucuauuagcgucuccuacauguauugguaccaacagaagccggggcaggcgccccggcugcucaucuaugacaugucuaaccuggcuagcggcauuccugcccgcuucuccggaagcgggucuggaaccgauuuuacacuuaccaucuccagccuggagcccgaagacuucgccguuuacuauuguaugcaguggucuggcuacccuuauacauuugggggaggcaccaaaguggagauuaagagaacaguggcugcccccuccgucuucaucuuuccuccgagcgaugaacaacucaaaucuggcaccgcuuccgugguuugccugcugaauaacuucuacccccgggaggccaaggugcaguggaaagucgacaaugcgcuccagagcgggaacucccaggagucugugacggaacaagauagcaaggacuccaccuacagccugucuuccacacuuacccugagcaaggccgauuaugagaaacacaagguuuacgcuugugaagugacacaucagggacucucuagcccugucaccaaauccuuuaaucgcggcgagugc

SEQ ID NO: 39020 - RNA, 1338 nt, Artificial Sequence
  derived and/or modified sequence opt5 from Sofituzumab_vedotin_HeavyChain1
gaggugcagcuggucgaaagcggcgggggacucguucaacccggcgggucccugagacuuucuugcgccgcuagcggauacuccaucaccaacgacuaugccuggaauugggugcggcaggcgccuggcaaggggcuggagugggugggauacauuucuuauagcggcuacacaacguauaacccgucccucaaaucucgcuucaccaucagcagagauacauccaagaauacccuguaccuucagaugaacagccugcgggcugaagacacagccgucuauuacugugcccgcuggaccucuggccucgauuacugggggcagggaacacuggugaccguuuccagcgcuucuacgaaaggccccuccguguuuccucuggcccccagcucuaaguccaccagcgggggaacagcugcccucggcugccuggucaaagacuauuucccugagcccgugaccguuuccuggaacucuggggcgcuuacaagcggagugcacaccuuuccugccguccugcaauccagcggccucuacucucuguccagcguggugacggucccgucuagcucccuuggcacacagaccuauauuuguaauguuaaucauaagcccucuaacacaaagguggauaaaaagguggaaccuaaaagcugcgacaagacccacaccugucccccuugccccgcuccggagcugcucgggggaccuuccgucuuccuguuucccccuaaacccaaggauacacugaugaucagcagaacgcccgaggugaccuguguuguggucgacgugucucaugaagauccugagguuaaguucaauugguacguggacggcgucgaagugcacaacgccaaaacaaagccgcgggaggagcaguauaauuccaccuaccgcgucgugagcguucucacagugcugcaucaggauuggcuuaacgggaaagaauauaagugcaaagucucuaauaaggcucugcccgccccuauugagaaaaccaucuccaaggcgaagggacaacccagagaaccucagguguacacgcugcccccgagccgggaggaaaugaccaaaaaccagguuucccucacaugucuugugaagggcuuuuacccuucugacaucgccgucgagugggagagcaaugggcagcccgaaaacaacuauaaaaccacaccucccgugcuggauuccgacggaucuuucuuucucuacagcaagcugaccguggacaaaucccgcuggcaacagggcaauguuuucagcugcucugucaugcacgaggcucugcacaaccauuauacacagaagucccucagccugucuccuggcaag

SEQ ID NO: 39021 - RNA, 642 nt, Artificial Sequence
  derived and/or modified sequence opt5 from Sofituzumab_vedotin_LightChain1
gacauccagaugacccaaagccccuccucucugagcgccuccgugggcgauagagucacaauuacgugcaaggcuucugaccucauccacaacuggcuggccugguaccagcagaaaccugggaaggcgccgaaacuucugauuuauggagcuaccagccucgagacaggcguucccucccgguucucugggagcggauccggcaccgauuuuacacugaccaucagcucucuucagccugaagacuucgccacauacuauugucaacaguacuggaccacgcccuuuaccuucgggcagggaacaaagguggagauuaaacgcaccguggccgcuccuuccgucuuuaucuuucccccuagcgaugaacagcugaagucuggcacagccuccgugguuugccuccugaauaacuucuauccgagagaggcuaaggugcaauggaaagucgacaaugcccugcagagcggcaacucucaggaauccgugaccgagcaggauagcaaggacuccacguacucucucagcuccacacugacccuuagcaaagcggauuaugagaagcauaaaguuuacgccugugaagugacacaccaagggcugucuucccccgucaccaagagcuucaaucggggagagugc

SEQ ID NO: 39022 - RNA, 1323 nt, Artificial Sequence
  derived and/or modified sequence opt5 from Solanezumab_HeavyChain1
gaggugcagcuggucgaaagcggcgggggacucguucaacccggcgggucccugagacuuucuugcgccgcuagcggauucaccuuuucccgguacucuaugagcugggugcgccaggccccuggcaaggggcuggagcucguggcgcagaucaacuccgucggaaauucuacauauuacccggacacggugaaaggcagauucaccauuagccgggauaacgcuaagaauacacuguaucuucagaugaacucccugcgcgccgaagacaccgccguuuacuauugugcuagcggcgauuacugggggcaaggaacacucgugaccgucucuuccgccagcacaaaaggccccucuguguuuccucuggcucccuccagcaagucuaccuccgggggaacggccgcgcugggcugccucguuaaagacuauuucccugagcccgugaccgucagcuggaacuccggggcccugacaucuggagugcacaccuuuccugcugugcuucagagcuccggccuguacagccucucuuccgucguuacagugccgagcucuagccugggcacccagacguacaucuguaaugugaaucauaagcccuccaacacaaaggucgauaaaaagguggaaccuaaaucuugcgacaagacccacacaugucccccuugccccgccccggagcuucucgggggaccuagcguuuuccuguuucccccuaaacccaaggauacccugaugauuuccagaacccccgaggugacaugugucgugguugacgugagccaugaagauccugaggucaaguucaauugguauguggacggcgucgaagugcacaacgcuaaaacgaagccgcgggaggagcaguacaauucuaccuaucgcguuguguccguccugacagugcuccaucaagauuggcugaacgggaaagaauacaagugcaaaguuagcaauaaggcccuucccgcgccuaucgagaaaaccauuucuaaggccaagggacagcccagagaaccucagguguauacacugcccccgucccgggacgagcucaccaaaaaccaggucagccugacgugucuugugaagggcuuuuacccuuccgauaucgcuguggaaugggagucuaaugggcaacccgagaacaacuauaaaacaaccccucccguucuggacagcgacggauccuucuuucucuacucuaagcugaccgucgauaaaagccgcuggcagcagggcaauguguucuccugcagcgugaugcacgaagcccugcacaaccauuacacacaaaagucucucucccugagcccuggc

SEQ ID NO: 39023 - RNA, 1326 nt, Artificial Sequence
  derived and/or modified sequence opt5 from Solanezumab_HeavyChain
gaggugcagcuggucgaaagcggcgggggacucguucaacccggcgggucccugagacuuucuugcgccgcuagcggauucaccuuuucccgguacucuaugagcugggugcgccaggccccuggcaaggggcuggagcucguggcgcagaucaacuccgucggaaauucuacauauuacccggacacggugaaaggcagauucaccauuagccgggauaacgcuaagaauacacuguaucuucagaugaacucccugcgcgccgaagacaccgccguuuacuauugugcuagcggcgauuacugggggcaaggaacacucgugaccgucucuuccgccagcacaaaaggccccucuguguuuccucuggcucccuccagcaagucuaccuccgggggaacggccgcgcugggcugccucguuaaagacuauuucccugagcccgugaccgucagcuggaacuccggggcccugacaucuggagugcacaccuuuccugcugugcuucagagcuccggccuguacagccucucuuccgucguuacagugccgagcucuagccugggcacccagacguacaucuguaaugugaaucauaagcccuccaacacaaaggucgauaaaaagguggaaccuaaaucuugcgacaagacccacacaugucccccuugccccgccccggagcuucucgggggaccuagcguuuuccuguuucccccuaaacccaaggauacccugaugauuuccagaacccccgaggugacaugugucgugguugacgugagccaugaagauccugaggucaaguucaauugguauguggacggcgucgaagugcacaacgcuaaaacgaagccgcgggaggagcaguacaauucuaccuaucgcguuguguccguccugacagugcuccaucaagauuggcugaacgggaaagaauacaagugcaaaguuagcaauaaggcccuucccgcgccuaucgagaaaaccauuucuaaggccaagggacagcccagagaaccucagguguauacacugcccccgucccgggacgagcucaccaaaaaccaggucagccugacgugucuugugaagggcuuuuacccuuccgauaucgcuguggaaugggagucuaaugggcaacccgagaacaacuauaaaacaaccccucccguucuggacagcgacggauccuucuuucucuacucuaagcugaccgucgauaaaagccgcuggcagcagggcaauguguucuccugcagcgugaugcacgaagcccugcacaaccauuacacacaaaagucucucucccugagcccuggcaag

SEQ ID NO: 39024 - RNA, 657 nt, Artificial Sequence
  derived and/or modified sequence opt5 from Solanezumab_LightChain1
gacguggucaugacccagagcccccugucccucccuguuacacugggccaaccggccucuaucagcugcagauccucucagagccuuauuuacuccgaugggaacgcuuaucugcacugguuccuccagaagcccggacagucuccucggcugcuuaucuacaaagugagcaaucgcuuuuccggcgugcccgacagauucagcgggucuggauccggcacggauuuuacccugaagauuagccgggucgaggccgaagacguggggguuuauuacuguucucaauccacacaugugccuuggaccuucggacagggcacaaaagucgagaucaagcgcaccguggcggcucccagcguuuuuauuuucccuccgucugaugaacagcucaaauccggcacagccagcguggucugccugcugaacaauuuuuaucccagagaggccaaggugcaguggaagguggacaacgcucuccaauccggaaauucucaggaaagcgucaccgagcaggauuccaaagacagcacguacucucuguccagcacccuuacacugucuaaggccgauuaugagaaacacaagguuuacgcuugugaagugacccaucaggggcucagcuccccugugacaaaaucuuucaaccggggcgagugc

SEQ ID NO: 39025 - RNA, 1506 nt, Artificial Sequence
  derived and/or modified sequence opt5 from Solitomab_HeavyChain1
gagcuggugaugacccagagccccuccucucucacagucacggccggcgaaaagguuaccaugagcugcaaauccucucaaagccugcuuaacuccgggaaucagaagaacuaccugacaugguaucagcagaaaccuggacaaccgcccaagcuccugaucuacugggcuucuaccagagagagcggcgugccugaccgguucacaggguccggaagcggcaccgauuuuacacuuaccauuucuuccgugcaggccgaagaccuggcggucuauuacugucagaaugauuauagcuacccccucacguucggggcuggaaccaaacuggagaucaagggcggcgggggaucuggcgggggaggcuccgggggaggcggcagcgaagugcagcugcucgagcaaucuggggccgagcugguucgcccuggaacauccgugaagauuagcugcaaagccuccggcuaugcuuuuaccaacuacuggcuugggugggucaagcagagacccggacacggccuggaauggaucggggacauuuucccuggaucuggcaauauccauuacaacgagaaauuuaagggcaaagccacacucaccgcugauaagagcuccagcacggccuauaugcagcugucuucccuuacauucgaagacagcgcgguguacuuuugugcccggcugcgcaauugggaugagccgauggacuauugggggcagggaaccacaguuaccgugucuagcggcgggggaggcuccgauguccaacucgugcagucuggggcugaggugaagaaacccggcgccagcgucaagguuuccugcaaagcuagcggauacaccuucacaagauauacgaugcacugggugcggcaggccccuggccaagggcuggaauggaucggauacauuaaccccucucgcggcuauaccaauuacgcggacuccgugaaggggagauuuacaaucaccacagauaaaagcaccucuacggccuacauggagcuguccagccuccgguccgaagacacagcuaccuauuacugugcccgcuauuacgaugaccauuauugccuggacuacuggggacagggcaccacagucaccgugucuagcggggagggcacauccacgggaucuggcgggagcggaggcuccgggggagcugaugacauuguucuuacccagagcccugccacacugucucucucccccggcgaaagagccacccugagcugucgggcuucucaguccgugagcuauaugaacugguaccaacagaagccggggaaagcgccuaagcgcuggaucuacgauacaucuaaggucgccagcggcgugcccgcuagauucuccggaagcggcucugggaccgacuauucccuuacgauuaauagccuggaggccgaggaugccgcuaccuacuauugccagcagugguccucuaacccucucacauuuggaggcgggaccaaaguugaaaucaagcaccaucaccaccaucac

SEQ ID NO: 39026 - RNA, 1506 nt, Artificial Sequence; identical to SEQ ID NO: 39025
  derived and/or modified sequence opt5 from Solitomab_SingleChain

SEQ ID NO: 39027 - RNA, 702 nt, Artificial Sequence
  derived and/or modified sequence opt5 from Sonepcizumab_LightChain_Precursor
augagcgugcccacccagguccugggccuccugcuucuguggcucacagacgccagaugcgagacgaccguuacacaauccccuucuuuccugagcgcuuccgugggggaucgggugaccaucacauguauuaccacaaccgacaucgaugacgauaugaacugguuucagcaggaaccgggaaaggcccccaaacuucugauuucugagggcaauauccuccgcccugggguccccagcagauucuccucuagcggauacggcacggacuuuacccugacaauuuccaagcugcagccugaagauuucgcgaccuauuacugccuccaaagcgacaaccugcccuuuacauucgggcagggaaccaaacuugagaucaagcggacgguggcugccccuucuguuuuuaucuucccgcccuccgaugaacagcugaaaagcggcacagccucuguggucugucuccugaauaacuuuuauccucgcgaggcuaaggugcaguggaagguugacaaugcccuucaauccggcaacagccaggagucugugaccgaacaggauuccaaagacagcacauacucccugucuagcacccucacccuguccaaggcugauuaugagaaacacaaggucuacgccugcgaagugacacaucaggggcugagcucucccgugacgaaauccuucaauagaggagagugu

SEQ ID NO: 39028 - RNA, 1365 nt, Artificial Sequence
  derived and/or modified sequence opt5 from Sonepcizumab_gamma1-Chain_Precursor
auggaguggagcuggguguuccuguuuuuccucuccgucaccacaggcguucacucugaagugcagcuggugcaaagcggggccgaggucaagaaacccggagaaucccuuaagaucucuugccagagcuuuggcuacauuuucaucgaccauacgauucacuggaugagacagaugccugggcagggacuggaguggaugggcgcuaucuccccgcggcaugauauuaccaaauauaacgaaauguuucgcgggcaagugacaaucucugccgacaagagcuccagcaccgcguaccuccaguggucuucccugaaagcuagcgauacagccauguauuucugugccagaggaggcuuuuacggcucuaccaucugguucgacuuuugggggcagggaacaaugguuaccguguccagcgcuucuacgaagggccccuccgucuucccucuugcccccagcuccaagucuaccagcgggggaacagcugcccugggcugccucgugaaagauuauuuuccugagcccguuaccguguccuggaauagcggggcgcugacaucuggaguccacaccuucccugccgugcugcaguccagcggccucuacucucugagcuccguggucacgguuccgucuagcucccuuggcacacaaaccuauauuuguaacgugaaucauaagcccagcaacacaaaaguggacaagcgggucgcuccugagcugcucgggggacccucuguguuucuguucccucccaaaccgaaggauacccuuaugaucucccgcaccccugaaguuacaugcguggucguggacguuagccacgaggaucccgaagugaaguucaauugguacgucgacggcguggagguccacaacgccaaaacgaagccuagagaggaacaguacaauucuaccuaucgggugguuuccgugcugacaguccuccaucaggauuggcugaacgggaaagaguacaaguguaaagugagcaauaaggcucugcccgcccccauugagaaaaccaucuccaaggcgaagggacagccucgcgaaccgcaaguuuauacacuucccccuucuagagaagagaugaccaaaaaccaggugagccugacgugccuugucaagggcuuuuaccccuccgacauugccguggagugggaaucuaaugggcagccugagaacaauuauaaaacaacacccccggugcuggauagcgacggauccuucuuucucuacagcaagcugaccguugacaaaucucgguggcaacagggcaacgucuucuccuguagcgugaugcacgaagcucuccauaaucacuauacccagaagucucugucccucagcccuggcaag

SEQ ID NO: 39029 - RNA, 1338 nt, Artificial Sequence
  derived and/or modified sequence opt5 from Stamulumab_HeavyChain1
gugcagcugguccaaagcggcgccgagguuaagaaacccggggcuuccgugaaggugucuugcaaagccagcggauacaccuucacauccuauuacaugcacugggucagacaggcgccuggccaggggcucgaauggaugggaaucauuaacccgucuggcgggagcacguccuaugcucagaaguuucaaggacgggugaccaugacacgcgacaccucuacaagcaccguuuacauggagcuguccagccuuagaucugaagauacagccguguauuacugugcccgggacgagaauuggggcuucgaucccuggggccaggggacccuggucacgguguccagcgcuucuaccaaaggaccuuccguuuuuccccucgccccuagcucuaaguccacaagcggcgggaccgcugcccugggaugccuugugaaggacuauuuccccgaaccugucacaguguccuggaacucuggcgcgcugaccagcggggugcauacguuuccggccguccuccaguccagcggacuguacucucuguccagcguugugacagugcccucuagcucccucggcacccagacauacaucuguaaugucaaccacaaaccuucuaauaccaagguggauaaaaagguugagcccaaaagcugcgacaagacccauacauguccucccugcccggcuccugagcugcuuggcgggcccuccguguuccuguuuccucccaagcccaaagauacgcucaugauuagccgcaccccugaagucacaugugugguuguggacgucucucacgaggauccggaagugaaguucaacugguaugucgacggaguggagguucauaaugccaaaaccaagcccagagaggaacaauacaacuccacauaucggguggucagcgugcugaccguucuucaccaggauuggcugaauggcaaagaguacaagugcaaagugucuaacaaggcucucccugcccccaucgaaaagacgauuuccaaagcgaaggggcagccucgcgagccccaggucuauacacugccgccuagcagagaagagaugaccaaaaaucaagugucccugaccugucucgugaagggauuuuaccccucugacaucgccguugagugggaaagcaacggccagccugagaauaacuauaaaacaacacccccuguccuggauuccgacgggucuuucuuucuuuacagcaagcugaccguggacaagucccgguggcagcaaggaaauguguucagcugcucugucaugcacgaagcucuccauaaccacuacacgcagaaaucccugagccuuucucccggcaag

SEQ ID NO: 39030 - RNA, 633 nt, Artificial Sequence
  derived and/or modified sequence opt5 from Stamulumab_LightChain1
agcuacgagcugacccagcccccuuccgugucugucagcccgggccaaacagccuccaucacgugcucugggcacgcucucggagacaaguucguuagcugguaucagcagaaacccggccaguccccugugcuggugauuuacgaugacacccaaagacccucugggaucccugaacgguuuagcggauccaacagcggcaauacagccacccuuacaauuucugggacccaggcgauggaugaggcugacuauuacugucaggccugggauuccagcuucgucuuuggaggcggcacaaaggugaccguucuggggcagcccaaagccgcuccuucugugacccucuucccgcccuccagcgaagaacugcaagccaacaaggcuacgcuugucugccugaucucugacuuuuauccuggagccgugacaguugcguggaaagccgauuccagccccgugaaggcuggcgucgaaaccacaaccccuuccaagcagucuaauaacaaauacgccgcuagcuccuaucucagccugacgcccgagcaguggaagucucaucgcuccuacagcugucaggugacacacgaggggucuaccguggagaaaacagucgccccgaccgagugcagc

SEQ ID NO: 39031 - RNA, 1356 nt, Artificial Sequence
  derived and/or modified sequence opt5 from Suptavumab_HeavyChain1
gaggugcagcuggucgaaagcggcggggaccucguucaacccggaagaucccugcggcuuucuugcguggccagcggcuucaccuuugaugacuacgcuaugcacugggugcgccaggccccugggaagggacuggagugggucuccggcgugucuuggagcggguccacaguuggauaugcggauucugugaaaggcagauucacggucagccgggacaacgcucagaagucccucuaccugcagaugaauagccuucgcgccgaagauaccgcccuguauuacugugugaaagacgcuuauaaguuuaacuacuauuacuacggccucgauguuugggggcaaggaacaaccgugacagucucuuccgccagcaccaaaggcccgucuguguucccccuggcuccuuccagcaagucuacauccgggggaaccgccgcgcugggcugccucgugaaggacuauuuucccgagccugucacgguuagcuggaacuccggggcccugaccucuggagugcauacauuccccgcugugcuucagagcuccggccuguacagccucucuuccgucgugaccguuccuagcucuagccugggcacacagaccuauaucuguaaugugaaucacaaaccguccaacacgaaggucgauaaaaagguggaacccaaaucuugcgacaagacacauaccuguccucccugcccugcccccgagcuucucgggggaccgagcguuuuucuguucccucccaagccuaaagauacacugaugauuuccagaacccccgaggugaccugugucguggucgacgugagccacgaagaucccgagguuaaguuuaauugguacguggacggcgucgaagugcauaacgcuaaaacaaagccucgggaggagcaguauaauucuacguaccgcguuguguccguccugaccgugcuccaccaagacuggcugaacgggaaagaauauaagugcaaagugagcaauaaggcccuuccggcgcccaucgagaagacaauuucuaaagccaagggacagccuagagaaccccagguuuacacccugccucccucccgggaugagcucaccaaaaaccaggucagccugacaugucuugugaagggcuucuacccguccgacaucgcuguggaaugggagucuaaugggcaaccugagaacaauuauaaaacgacacccccuguccuggauagcgacggauccuuuuuccucuacucuaagcugaccguggauaagagccgcuggcagcagggcaacguguuuuccugcagcguuaugcacgaagcccugcauaaccacuauacccaaaaaucucucucccugagccccggc

SEQ ID NO: 39032 - RNA, 642 nt, Artificial Sequence
  derived and/or modified sequence opt5 from Suptavumab_LightChain1
gagaucgugaugacccagagccccgccacacuguccgucucuccuggcgaaagagcuacgcucagcugccgggccucccaaaccauucugucuaaccuugcgugguaccugcagaaaccggggcaggcuccccgccuccugaucuauggagccagcacaagagccaccggccuuccugcucgguucuccgggucuggaagcggcacagaguuuacccugacaauuuccagccuccagucugaagacuucgccguuuacuauugucaacaguacaauaacuggccccugaccuuugggggaggcacgaaaguggagaucaagcgcaccguggcugccccuuccgucuucauuuuucccccuagcgaugaacagcugaaaucuggcacagcguccgugguuugccuccugaauaacuucuauccgagagaggccaaggugcaguggaaagucgacaaugcccuucaaagcgggaacucucaggaguccgugaccgaacaggauagcaaggacuccacauacucucugagcuccacccucacgcugagcaaggcugauuaugagaaacacaagguuuacgcuugugaagugacacaucagggacuuucuucccccgucaccaagagcuuuaaucggggcgagugc

SEQ ID NO: 39033 - RNA, 1344 nt, Artificial Sequence
  derived and/or modified sequence opt5 from Suvizumab_HeavyChain1
caggugcaacugguccagagcggcgccgagguuaagaaacccggggcuuccgugaaggugucuugcaaagccagcggauacaccuucacaaacuccuggaucggcugguuuagacaggcgccugggcagggacucgaauggauuggcgacaucuaucccgggggaggcuacacgaauuauaacgagauuuucaagggcaaagcuaccaugacagccgauaccucuacaaauaccgccuacauggaacugagcucccuucggucugaggacacagcugucuauuacuguagccgcgggauccccggauaugccauggauuacuggggccaagggacccuggugacgguuuccagcgcuucuaccaagggaccuuccguguuuccccucgccccuagcucuaaguccacaagcggcgggaccgcggcccugggaugccuugucaaagacuacuuccccgaaccugugacaguuucuuggaacuccggcgcucugaccagcggcgugcacacguuuccggccguccuccaguccucugggcuguauagccuguccagcguggugacaguccccucuuccagccucggaacccagacauacauuuguaauguuaaccauaagccuucuaauaccaaaguggauaagaaaguggagcccaagagcugcgacaagacccacacauguccucccugcccggcuccugagcugcuuggcgggcccuccgucuuccuguuuccucccaaacccaaggauacgcucaugaucucuagaaccccugaagugacauguguuguggucgacgugagccaugaggauccggaaguuaaauucaacugguauguggacggagucgaggugcacaaugccaagaccaaaccccgggaggaacaguacaacuccacauaucgcgucgugagcguucugaccgugcuucaucaagauuggcugaauggcaaggaguacaaaugcaaggucucuaacaaggcgcucccugcccccaucgagaaaacgauuuccaaggcuaaagggcagccuagagaaccccagguguauacacugccgccuagccgggacgaacugaccaagaaucagguuucucucaccugucuggugaaaggauuuuaccccuccgauaucgccgucgagugggagagcaacggccaaccugaaaauaacuacaagacaaccccgccugugcuugacuccgacggcucuuucuuucuguauagcaagcucacaguggauaaaucccgcuggcagcaggggaacguuuucucuugcagcgucaugcacgaggcucugcacaaucauuacacgcaaaagucccuuagccugucucccggaaaa

SEQ ID NO: 39034 - RNA, 660 nt, Artificial Sequence
  derived and/or modified sequence opt5 from Suvizumab_LightChain1
gacauccagaugacccaaagacccgauagccuguccgccucugugggcgaccgggucacaaugagcugcaaguccucucagagccuccugaacuccggggaucagaaaaauuaccuuacgugguaucagcaaaagccuggacagccgcccaaacugcucauuuacugggcuucuaccggcgagagcgggguuccugaccgcuucuccggaagcggcucugggacagauuuuaccuucacaaucuccagccugcagcccgaagacauugccaccuauuacugucagaacgauuauucuuacccuuggacauuuggacaaggcaccaagguggagaucaaaagaacgguggcggcucccuccgucuucauuuuuccuccgagcgacgaacagcuuaagucuggcaccgccuccgugguuugccugcucaauaacuucuauccccgggaggccaaggugcaguggaaagucgauaaugcucugcagagcgggaacucccaagaaucugugacagagcaggacagcaaggauuccaccuacagccugucuuccacacucacccugagcaaagccgacuacgagaagcacaaaguuuaugcuugugaagugacgcaucagggacuuucuagcccugucacaaaguccuuuaaucgcggcgagugc

SEQ ID NO: 39035 - RNA, 1350 nt, Artificial Sequence
  derived and/or modified sequence opt5 from Tabalumab_HeavyChain1
caggugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagaucaaccacucuggaagcacgaauuauaaccccucccugaagucucggguuaccauuagcguggacacauccaaaaaucaauuuagccuuaagcugucuuccgugaccgccgcggauacagcugucuacuauugugcccgcggcuacuaugacauccucaccggcuacuacuauuacuucgauuauugggggcagggaacacuggugaccguuagcucugccuccacgaaaggcccuagcguguuuccccuggcuccuugcucuagauccaccagcgaauccacagccgcucucgggugucuggucaaggacuacuuccccgagccugugaccguuucuuggaacagcggagcccuuacauccggcgugcauaccuuuccggcgguccugcagagcucugggcucuauucccugagcucuguggugacgguccccagcuccucucuuggaacaaagaccuacacaugcaauguugaucacaaaccuagcaacaccaagguggacaaacggguggaauccaaguauggacccccuugucccccgugcccugcccccgaguuccugggcgggccuagcgucuuucucuucccucccaaacccaaggauacccugaugauuucucgcacaccggaggugacguguguuguggucgacgugucccaggaagaucccgagguucaauuuaauugguacguggacggagucgaagugcauaacgcuaagaccaaaccuagagaggagcaguucaauagcacauaccgggucgugucuguucugaccgugcuccaccaggauuggcugaacggcaaggaauauaaaugcaaggucuccaauaaagggcuucccagcuccaucgagaagacaaucucuaaagccaagggacagccucgcgaaccccaaguguacacccugccgccuagccaggaggaaaugacgaagaaccagguuucccucacaugucuggugaaaggcuuuuaucccucugacauugcugucgagugggagagcaaugggcaaccugaaaacaauuacaagaccacacccccugugcuugauuccgacggcagcuucuuucuguauucuagacucaccguggacaaaucccgguggcaggagggcaacguuuucagcugcucugucaugcaugaagcccugcacaaccacuacacccagaagucccugagccucucucugggcaaa

SEQ ID NO: 39036 - RNA, 642 nt, Artificial Sequence
  derived and/or modified sequence opt5 from Tabalumab_LightChain1
gagaucgugcugacccagagccccgccacacucucccugucuccuggcgaacgggcuacgcuuagcugccgggccucccaaucugucagccgcuaccuggcgugguaucagcagaagccggggcaggcucccagacuccugauuuacgacgccuccaaccgggccaccggaaucccugcucgcuucucuggcagcggguccggaacagauagcacccuuacaauuucuucccuggagcccgaagacuuugccguuuauuacugucaacagagaagcaauuggccucggaccuucggccaggggacaaaaguggagaucaagcgcaccguggcugcccccucugucuuuauuuucccuccguccgaugaacagcucaaaagcggaacggcgucugugguuugccugcugaacaauuuuuaucccagagaggccaaggugcaauggaaagucgacaacgcucuccaguccggcaauagccaggaguccgugaccgaacaggauucuaaggacagcacauacucccugagcaacacccuuacacugucuaaggccgauuaugagaaacacaagguuuacgcuugugaagugacccaucaaggccucuccagcccugucacgaaaucuuucaauagaggggagugc

SEQ ID NO: 39037 - RNA, 1332 nt, Artificial Sequence
  derived and/or modified sequence opt5 from Tacatuzuab_HeavyChain1
caggugcaacugcagcagagcggcgccgaggucaagaaacccggguccucuguuaaggugagcugcaaggcuuccggauacgccuucaccucuuaugugauccacugggucagacaggcgccuggccaagggcucuacuggauuggauauauccauccguacaacggcgggacaaaauauaaugaaaaauuuaagggaaaggcuacgauuaccgccgacgagagcacaaacaccgccuacgaacuguccucucuucggagcgaggauacagcuuucuauuuuugugcccgcuccggcggcggggaccccuucgcuuacuggggacagggcagccuggugaccguuucuuccgccagcacaaaagggccuucuguguuuccccucgcgccuuccagcaagucuaccuccggaggcacggccgcucuggggugccuugucaaagauuacuuccccgaaccugugaccguuagcuggaacuccggagcccugacaucuggcgugcacaccuuuccggcuguccuccagagcuccggccuguauagccugucuuccguggugacaguccccagcucuagccucgggacccagacguacaucuguaauguuaaucauaagccuuccaacacaaaaguggacaagagaguggagcccaagucuugcgauaaaacccacacauguccucccugcccggccccugagcugcuuggaggccccagcgucuuccuguuuccucccaagcccaaagacacccucauuucccggaccccugaagugacauguguuguggucgaugugagccaugaggacccggaaguuaaguucaauugguauguggauggggucgaggugcacaacgcgaaaacgaagccccgcgaggaacaauacaauucuaccuauagagucguguccguucugacagugcuucaccaggacuggcugaacggaaaagaguacaagugcaaggucagcaauaaagcccucccugcucccaucgaaaagaccaucucuaaagccaagggccagccucgggagccccagguguauacacugccgccuucccgcgaagagaccaaaaaccaaguuagccugacgugucucgugaagggguuuuaccccuccgauauugcugucgagugggaaucuaauggacagccugagaacaauuacaagacaacacccccugugcuggacagcgauggcuccuucuuucuuuauucuaaacugaccguggacaagagcagauggcagcaaggcaacguuuucuccugcagcguccaugaagcccuccacaaccauuacacccagaaaucucugucccuuagccccgggaag

SEQ ID NO: 39038 - RNA, 636 nt, Artificial Sequence
  derived and/or modified sequence opt5 from Tacatuzuab_LightChain1
gacauccagcugacgcaaagccccuccucucucagcgccuccgugggcgauagagucacaauuacgugcaaggcuucucaggacaucaacaaauacauugggugguaucagcagaagccuggaaaagccccgaagcugcuucacuacaccagcgcgcugcuccccggcaucccuucccgguucucugggagcggauccggccgcgauuauacauuuaccauuagcucucugcaacccgaggacaucgcuacauacuauugucuucaguacgaugaccuguggaccuucgggggaggcacaaaacuccagaucaagagaaccguugccgccccuuccguguuuauuuuucccccuagcgaugaacagcugaagucuggcacggcuuccguggucugccugcucaauaacuucuauccgcgggaggccaaagugcaauggaagguugacaaugcucugcagagcgggaacucucaggaauccgugaccgagcaggauagcaaagacuccacauacucucuuagcuccacccugacacucagcaaggccgauuacgaaaaacauaaggucuaugcgugugaggugacccaccaaggacugucuucccccguuaccaagagcuucaaucgcggcgagugc

SEQ ID NO: 39039 - RNA, 678 nt, Artificial Sequence
  derived and/or modified sequence opt5 from Tadocizumab_fab_fragment_HeavyChain
caggugcaacugguccagagcggcgccgagguuaagaaacccggguccucugugaaggugagcugcaaggcuuccggauacgccuucaccaacuaucucaucgaaugggucagacaggcgccuggccaggggcuggaguggauuggagugaucuacccgggcucugggggaacaaauuauaacgaaaaauuuaaaggccggguuacgcuuaccguggacgagagcacaaauaccgcuuacauggaacuguccucucuccgcagcgaggauacagccgucuauuucugugccagacgggacggcaacuacgggugguuugcuuauuggggacaaggcacccuggugacaguuuccagcgccucuaccaaggggcccuccguguucccucuugcucccagcucuaaguccacgagcggaggcaccgccgcgcuggggugccucgucaaagauuacuuuccugagcccgugacagugucuuggaacuccggagcccugaccagcggcguccacacauucccugcuguucugcaguccucuggccucuacagccuguccagcguggugaccgucccgucuuccagccuugggacgcagacauauauuuguaaugugaaucauaagcccucuaacaccaaaguugacaagaaaguggaaccuaagagcugcgauaagacacac

SEQ ID NO: 39040 - RNA, 582 nt, Artificial Sequence
  derived and/or modified sequence opt5 from Tadocizumab_fab_fragment_LightChain
gacauccagaugacccaaacacccagcacgcuguccgccucugugggcgaucgggucaccauuagcugccgggcuucccaggacaucaacaauuaccucaacugguaucagcagaagccugggaaagccccgaagcugcuuauuuacuauacaucuacccugcacagcggaguucccucccgcuucucuggcagcggguccggaacagauuacacccucacaaucagcucucugcaaccugacgauuuugcgaccuauuucugucagcagggcaauacgcuucccuggaccuuugggcagggaacaaaaguggaggugaagagaaccgucgcugccccuuccguguucauuuuucccccuagcgacgaacaacugaaaucuggcacagccuccguugugugccuccugaacaauuucuacgagagcgucaccgaacaggauucuaaggacuccacguauagccuguccucuacacucacccugagcaaggcugauuacgagaaacauaagguguacgccugugaaguuacacaccagggccuuuccagcccggugaccaaaucuuuuaacagaggggagugc

SEQ ID NO: 39041 - RNA, 1359 nt, Artificial Sequence
  derived and/or modified sequence opt5 from Talizumab_HeavyChain1
caggugcaacugguccagagcggcgccgagguuaagaaacccggggcuuccgugaaggugucuugcaaagccagcggauacaccuucuccauguauuggcucgaaugggucagacaggcgccuggccacgggcuggagugggugggagaaaucucuccgggcacauuuacgaccaacuacaaugagaaguucaaagcucgggccacauuuaccgccgacacaagcaccaacacagcuuauauggaacuuuccucucugcgcagcgaggauaccgccguuuacuauugugcuagauucucccauuuuagcgggucuaauuacgacuauuucgauuacuggggacagggcacgcucgugaccgucuccagcgccucuacaaagggccccuccguguuuccucuggcgcccagcucuaaguccaccagcgggggaacagccgcucuuggcugccugguuaaagacuacuucccugagcccgugaccgucuccuggaacucuggggcccucacgagcggagugcacacauuuccugcugugcugcaauccagcggccuguauucucucuccagcgucguuaccgugccgucuagcucccuggggacacagaccuacauuuguaaugugaaccauaagcccucuaauaccaaagucgauaagaaaguggaaccuaagagcugcgacaagacacacacgugucccccuugccccgccccggagcuucugggaggcccuuccguuuuccucuuucccccuaaacccaaggauacccugaugaucagccggacacccgaagugaccugugucgugguugacgugucucaugaggauccugaggucaaauucaacugguauguggacggcgucgaagugcacaaugcgaagacaaaaccgcgcgaggaacaguacaacuccaccuauagaguugugagcguccuuacggugcugcaccaggauuggcucaaugggaaggaguacaaaugcaagguuucuaacaaggcccugcccgcuccuauugagaaaacaaucuccaaggccaaaggacaaccccgggaaccucagguguauacccugcccccgagccgcgacgagcucaccaagaaucaggucucccugacaugucuugugaaaggcuuuuacccuucugauauugcuguggaaugggagagcaacgggcagcccgaaaauaacuacaagaccacaccucccguucuggacuccgacggaucuuucuuccucuauagcaagcugacggucgauaaauccagauggcaacagggcaacguguuuagcugcucugugaugcaugaggcccuucacaaucauuacacccagaagucccugagccucucuccugggaaa

SEQ ID NO: 39042 - RNA, 642 nt, Artificial Sequence
  derived and/or modified sequence opt5 from Talizumab_LightChain1
gacauccugcucacccagagccccggcacacugucccuuucuccuggggagagagccacgcugagcugccgggcuucccaaucuauuggaaccaacauccacugguaccagcagaagccgggccaggcgccccgccuccugauuaaauaugccagcgaauccaucucugggauuccuagcagauucuccggaagcggcucugggacagauuuuacccuuacaaucucccggcuggagcccgaagacuucgcuauguacuauugucaacagagcgauucuuggccuaccacauuuggacagggcaccaagguggagaucaaacgcacggucgccgcccccuccguuuucauuuuuccuccgagcgacgaacagcucaagucuggcaccgcuuccguggugugccugcugaauaacuucuaccccagagaggccaaaguccaauggaagguggauaaugcucuccagagcgggaacucccaggagucuguuacagaacaggacagcaaggauuccaccuauagccugucuuccacacuuacccugagcaaagccgacuacgagaagcauaaaguguaugcgugugaagucacgcaccaaggacucucuagcccugugacaaaguccuuuaaucggggcgagugc

SEQ ID NO: 39043 - RNA, 1368 nt, Artificial Sequence
  derived and/or modified sequence opt5 from Tamtuvetmab_HeavyChain1
gaggugaagcugcucgaaagcggcgggggacugguccagcccggcggguccaugagacuuucuugcgccggaagcggcuucaccuuuacagacuucuacaugaacuggauccggcaaccugcugggaaagccccggaguggcugggauuuauucgcgauaaggcgaaaggcuauacgaccgaauacaaucccuccguuaagggcagauucacaaucucucgggacaacacccagaauaugcucuaucugcagaugaacacacuucgcgcugaggauaccgccacauacuauugugccagagaagggcacaccgcugccccuuuugacuacuggggacagggcacgcuggugaccgugagcuccgcuucuacaaccgcccccagcgucuucccucucgcgcccuccugcgggagcacaucuggauccaccguggcccuggcuugucugguuagcggcuauuuuccugagccggugacggucucuuggaauagcgggagccucacaucuggagugcauaccuuccccuccguucugcaaagcuccggccuuuacucucugagcuccauggugacagucccuagcucucgguggcccuccgagaccuuuaccugcaacguggcccacccugcuagcaaaacaaagguggauaagcccgucccgaaacgcgaaaauggcagaguuccucggcccccugacugucccaagugccccgccccugagaugcucgggggaccgucuguguucauuuuucccccuaaacccaaggauacgcugcuuaucgcgcgcaccccugaagugacaugugucgugguugaccuggaucccgaggacccggaggugcagauuagcugguucgucgauggcaaacagaugcagaccgccaagacacaaccuagagaggaacaguuuaacgggaccuaccgggugguuuccgugcuccccaucggacaucaggacuggcugaagggcaaacaguucacgugcaaggucaauaacaaagcucugccuucucccaucgaacgcacaauuagcaaggccagagggcaagcucaccagccuuccguguauguccuucccccgagccgggaggaacugucuaaaaauaccgugucccuuaccugucugaucaaggauuucuuuccucccgacauugacguugaguggcagagcaacggacaacaggagcccgaaucuaaauaccgcacaaccccuccgcagcucgaugaggacggcuccuauuuccuguacagcaagcucuccguggauaagucuagauggcagcggggcgacacauuuaucugcgccgucaugcaugaagcccugcacaaucacuauacgcaaaaaucccucucccauucucccgggaag

SEQ ID NO: 39044 - RNA, 639 nt, Artificial Sequence
  derived and/or modified sequence opt5 from Tamtuvetmab_LightChain1
gacaucaagaugacccagagccccuccuuccugucugccagcgugggcgauagagucacacucaacugcaaggcuucccaaaauauugacaaauaccugaacugguaucagcagaaacuuggggagucuccuaagcugcucaucuacaauacgaacaaucugcagaccggcauuccgagccgguuuuccggaucugggagcggaacagauuucacccuuacaaucuccagccugcaacccgaagacguugccaccuauuuuugucuccagcacauuucucgcccuagaacauucggcgggggaacccaucugacggugcugggccagcccaaagcguccccuagcgugacccucuuucccccuucuuccgaggaacugggcgcuaacaaggccacacuugucugccugaucagcgauuucuacccgucuggggugaccguugccuggaaggcugacggaucccccaucacacagggcguggagaccacgaaaccuagcaagcaauccaauaacaaauaugccgcuucuagcuaccucucccugacacccgauaaguggaaaagccacucuuccuuuagcugucuugucacccaugaagggucuacaguggagaagaagguugccccugcggagugcagc

SEQ ID NO: 39045 - RNA, 360 nt, Artificial Sequence
  derived and/or modified sequence opt5 from Tanezumab_HeavyChain
caggugcaacugcaggagagcggccccgggcucgucaagccuuccgaaacccugucucuuacaugcacgguuagcggauucucccugaucggcuacgaccucaacuggauuagacagccgcccgggaaaggacuggaguggaucggcauuaucuggggagaugggaccacagacuauaauucugccgucaagagccgggugaccauuuccaaagauacaucuaagaaccaguuuagccuuaaacuguccagcgugaccgcugccgacacagcgguguacuauugugcucgcggcggcuacugguaugccaccucuuacuauuucgauuacugggggcaaggaacgcucguuaccgugucc

SEQ ID NO: 39046 - RNA, 327 nt, Artificial Sequence
  derived and/or modified sequence opt5 from Tanezumab_LightChain
gacauccagaugacccaaagccccuccucucugagcgccuccgugggcgauagagucacaauuacgugccgggcuucucagagcaucuccaacaaucucaacugguaccagcagaagccugggaaagccccgaagcugcuuauuuauuacaccucucgcuuccacagcggaguucccuccagauuuagcggcucuggguccggaacagacuucaccuuuacaaucagcucucugcaaccugaggauauugcgaccuauuacugucagcaggaacauacacuccccuauaccuucggccaggggacgaaacuggagaucaagcggacc

SEQ ID NO: 39047 - RNA, 1323 nt, Artificial Sequence
  derived and/or modified sequence opt5 from Tarextumab_HeavyChain1
gaggugcagcuggucgaaagcggcgggggacucguucaacccggcgggucccugagacuuucuugcgccgcuagcggauucaccuuuuccucuagcggcauguccugggugcggcaggccccugggaagggacuggagugggugucugucaucgcgagcuccggcagcaacacauacuaugcugacucugugaaaggccgcuucacgauuuccagagauaauagcaagaacacccucuaccugcagaugaacucucuucgggccgaagacacagccguuuauuacugugcucgcuccaucuuuuauaccacaugggggcagggaacccuggugacagucagcucugccuccaccaaaggcccgagcguguucccccucgcuccuugcuccagaucuacgagcgaguccaccgccgcgcuggggugucugguuaaggauuacuuucccgaaccugugacagucagcuggaacucuggagcccucaccuccggcgugcacacauuccccgcugugcugcaaagcucugggcuuuauagccuguccucugucguuaccgugccuagcuccaauuuuggaacgcagacauauaccugcaauguggaccauaaaccgagcaauacaaaggucgauaagaccguggagcggaaauguugcguugagugucccccuugccccgccccucccguggcuggcccgucugucuuccucuuuccucccaagccuaaagacacccugaugauuucccgcacacccgaagugacguguguuguggucgaugugagccacgaggaccccgaaguccaguucaacugguacguggauggcguugaggugcauaaugccaagaccaaaccuagagaggaacaguuuaacucuacauuccgggucguguccguucuuaccgugguccaccaagacuggcugaaugggaaggaguacaagugcaaagugagcaacaagggacucccggcgcccaucgagaaaacaauuuccaagaccaaaggccagccucgcgaaccccagguguacacgcugccucccucuagagaagagaugacaaagaaucagguuagccugaccugucucgucaaaggguuuuauccguccgauaucgccguggagugggaaucuaacggacaaccugagaauaacuacaagaccacacccccuaugcuggacagcgauggcuccuucuuccuuuauagcaagcugaccguggacaaaucucgguggcagcaggggaacgucuuuuccugcagcgugaugcaugaagcucuccacaaucacuacacacaaaagucucugucccuuagccccggaaaa

SEQ ID NO: 39048 - RNA, 645 nt, Artificial Sequence
  derived and/or modified sequence opt5 from Tarextumab_LightChain1
gacaucgugcugacccagagccccgccacacucagccugucuccuggcgagagagcuacgcuuagcugccgggccucccaaucuguccgcagcaacuaccuggcgugguaucagcagaagccggggcaggcucccagacuccugauuuacggagccuccucucgggccaccggcguuccugcucgcuucagcggguccggaagcggcacagauuuuacccuuacaaucucuucccuggaacccgaggacuucgccguguauuacugucaacaguauagcaauuuuccuauuaccuucgggcagggaacaaaaguggaaaucaagagaaccgucgcugcccccucuguguuuauuuucccuccguccgaugagcagcucaaaagcggcacggcgucuguugugugccugcugaacaauuuuuacccccgggaagccaagguccaauggaaaguggacaacgcucuccaguccggcaauagccaggaguccguuaccgagcaggauucuaaggacagcacauauucccugagcucuacccuuacacuguccaaggccgauuacgaaaaacacaagguguacgcuugugaggucacccaucaagggcucagcucuccugugacgaaauccuucaaccgcggagaaugc

SEQ ID NO: 39049 - RNA, 363 nt, Artificial Sequence
  derived and/or modified sequence opt5 from Tefibazumab_HeavyChain1
caggugcaacugaaggagagcggccccgggcucgucaaaccuucccagacccugucuaucacaugcacgauuagcggauucucccuuucuagauacagcguucacugggugcggcagccgcccggcaaggggcuggaauggcucggaaugaucuggggcgggggaaacaccgacuauaauuccgcccugaaaucucgccuuagcauuuccaaggauaacagcaaaaaucagguguuucugaagaugaacucucucacagcugccgacaccgcggucuacuauugugcuagaaagggcgaguucuacuauggcuacgauggguuuguguauuggggacaaggcacacugguuaccguguccagc

SEQ ID NO: 39050 - RNA, 336 nt, Artificial Sequence
  derived and/or modified sequence opt5 from Tefibazumab_LightChain1
gacaucgugaugacccagagccccgauucccuggccgucucucucggcgagagaguuacaaugaacugcaagagcucccaaucugugcuguacagcuccaaucagaaaaacuaucuugcuugguaccagcagaagccugggcaaucuccgaaacugcucauuuauugggccagcacgcgggaauccggagugcccgaccgcuucagcggcucuggguccggaaccgauuuuacacugaccaucagcucuguccaggcggaggaccuugcuguguacuauugucaccaguaccuguccagcuauacauucggcgggggaaccaagcucgaaauuaaa

SEQ ID NO: 39051 - RNA, 1368 nt, Artificial Sequence
  derived and/or modified sequence opt5 from Tenatumomab_HeavyChain1
gagauccagcugcaacagagcggccccgaacucgugaagccuggggccuccgucaaaguuucuugcaaggcuagcggauacgccuucaccuccuauaacauguacugggugaaacagucucacggcaagagccuggaguggauuggguauaucgacccguacaauggagugacauccuauaaccagaaauuuaagggcaaggcgacgcuuaccgucgauaaaucuagcuccacagcuuacaugcaucugaauagccucaccucugaagacuccgccguguauuacugugccagagggggaggcagcauuuacuaugcuauggauuacuggggccaagggacaucuguuaccguguccagcgccaagacaacgcccccuucugucuauccccuggcuccuggaugcggcgacaccaccggguccagcgugacacuuggaugucugguuaaaggcuacuuccccgaguccgugaccgucacauggaacucugggagccucuccagcucugugcacaccuuuccugcccugcugcaguccggacucuauacgaugagcucuagcgugacagucccguccucuaccuggcccagccagacaguuaccugcuccguggcgcauccugccagcucuaccacaguggauaagaaacuggaacccuccggcccuaucagcacgauuaaucccuguccgccuugcaaggagugucacaagugccccgcuccuaaccuugagggcgggcccucugucuucaucuuucccccuaauaucaaagacgugcugaugauuucccucaccccgaagguuacauguguggucguggauguuagcgaagacgaucccgacgugcagaucuccugguucgucaacaauguggagguccauaccgcccaaacacagacccaccgggaagauuacaacucuacgauucgcgugguuagcacacugccuauccagcaccaggacuggauguccggaaaagaguuuaagugcaaagugaauaacaaggaucuucccucuccuauugagagaaccaucagcaaaauuaagggccugguccgggcuccccaaguguauauccucccgccucccgccgaacagcugucccgcaaggacguuagccugaccugucucguggucggguucaauccuggagacaucucuguggaguggacauccaacggccauaccgaagagaauuacaaagauacagcgcccgugcuggacagcgaugggucuuacuuuauuuauuccaaacuuaacaugaaaacgagcaagugggaaaagaccgacucuuucagcugcaacguuagacacgagggacugaagaauuacuaucucaagaaaacaaucucccggagcccuggcaag

SEQ ID NO: 39052 - RNA, 657 nt, Artificial Sequence
  derived and/or modified sequence opt5 from Tenatumomab_LightChain1
gacaucgugaugacccaggccgcucccagcgucccuguuacaccgggcgaguccgugucuauuagcugcagauccucuaagagccugcuccacuccaacgggaauacguaccuguauugguuccuucaacggcccggacagucuccucagcugcucaucuaccgcaugagcaaccuggccuccggcgugcccgauagauuuagcgggucuggauccggcaccgcguucacacuucggauuagccgcgucgaagcugaggacguggggguuuauuacuguaugcagcaucuggaauauccucucaccuuuggagccggcacaaaacuggagcugaagagagccgaugcugcccccaccgugucuaucuucccuccguccagcgaacaacucacaucuggcggggcuuccgucgugugcuuucugaauaacuucuaccccaaagacauuaauguuaaguggaaaaucgauggaagcgagcggcagaacggcgugcuuaauuccuggaccgaccaggauucuaaggacagcacguauuccaugagcucuacccugacacucaccaaggaugaguacgaacgccacaacuccuacacaugugaggccacccauaaaacgagcacaucuccuaucgucaagagcuuuaauagaaacgaaugc

SEQ ID NO: 39053 - RNA, 1356 nt, Artificial Sequence
  derived and/or modified sequence opt5 from Teneliximab_HeavyChain1
cagauccaacuggugcagagcggccccgagcucaagaaaccuggggaaaccgucagaauuuccugcaaggccucuggauacgcuuucacaacgaccggcaugcaguggguucaggagaugccggggaaaggacugaaguggaucggcuggauuaacacacacagcggggugcccaaauauguggaagacuuuaagggacgguucgccuuuucccuugagaccucugcgaauacagcuuaccugcaaaucagcaaccucaagaaugaagauaccgccacauauuucuguguccgcuccggcaacggcaauuacgaccuggccuauuuugcuuacugggggcagggaacccuugugacgguuucugccgcuagcaccaaaggcccuuccguguucccccuggccccuagcucuaaguccacaagcgggggaaccgcggcccucggcugccuggucaaagauuauuuucccgagccugugacaguuucuuggaacuccggggcucugaccagcggagugcauacguucccggccguccuccagucuuccggccuguacagccuuuccucuguggugacaguccccagcuccagccugggcacccagacauacauuuguaauguuaaccacaagccuucuaauaccaaaguggacaagaagguggagcccaaauccugcgauaagacccauacauguccucccugcccggcuccugaacuccuugggggacccagcgucuuucuguucccucccaaacccaaggacacgcugaugaucucuagaaccccugaggugacauguguuguggucgaugugagccacgaagacccggagguuaaauuuaacugguauguggauggcgucgaggugcauaaugccaagaccaaaccccgggaggaacaauacaacuccacauaucgcgucgugucuguucucaccgugcugcaccaggacuggcugaaugggaaggaauacaagugcaaagucagcaacaaggcgcucccugcccccaucgagaaaacgauuuccaaggcuaaaggacagccuagagaaccccagguguauacacugccgccuagccgggaugagcuuaccaagaaucaaguuucucugaccugucucgugaagggcuucuaccccuccgacaucgccgucgagugggaaagcaacgggcagccugagaacaauuauaaaacaacacccccugugcuggauucugacggauccuuuuuccuuuacagcaagcugaccguggacaaaucccgcuggcagcaaggcaacguuuucucuugcagcgucaugcacgaagcucuccauaaucacuacacgcagaagucccugucucugagccccggcaaa

SEQ ID NO: 39054 - RNA, 642 nt, Artificial Sequence
  derived and/or modified sequence opt5 from Teneliximab_LightChain1
gacaucgugcugacccagagccccgccacacucuccgucacgccuggcgauagaguuucucugagcugccgggcuucccaaucuauuagcgacuaccuucacugguaucagcagaagucccaugagucuccgcgccugcucaucaaauacgccagccacuccauuagcgggauccccucuagauucuccggaagcggcucuggguccgauuuuacccugagcauuaacucuguggaaccugaggacgugggaaucuauuacugucagcauggccacuccuuccccuggacauuugggggaggcaccaaacuugaaaucaagcggacagucgcggcuccuagcguguucauuuuucccccuuccgaugagcaacugaagucuggcaccgccagcguugugugccuccugaauaacuucuauccgcgcgaagccaaaguccaguggaagguggacaaugcucugcaguccgggaacagccaggagucuguuacagagcaagauuccaaggacagcaccuacucucucagcuccacgcugacccuuucuaaagccgauuaugaaaagcauaaaguguacgcuugugaggucacacaccagggacugagcucccccgugaccaagagcuuuaauagaggcgaaugc

SEQ ID NO: 39055 - RNA, 1347 nt, Artificial Sequence
  derived and/or modified sequence opt5 from Teplizumab_HeavyChain1
caggugcaacugguccagagcggcgggggaguugugcagcccggcagaucccuccggcugucuugcaaggccagcggguacaccuucacacgcuauacgaugcacugggugagacaggcuccuggaaaaggccuugaguggaucggguacauuaacccgucccggggauauaccaauuacaaccaaaaggucaaagaccgcuuuacaaucucuagagauaauagcaagaacaccgccuuccugcagauggacucccuccggcccgaagauacaggcguguauuuuugugcgcgcuacuaugacgaucauuacugccuggacuacuggggccaggggaccccuguuacagugucuagcgcuuccaccaaaggacccagcgucuucccucuugcccccucuuccaagagcacgucuggcgggaccgccgcucugggaugucucgugaaggauuauuuuccugagccgguuacaguguccuggaauagcggcgcccugaccucugggguccacacauuccccgcugugcugcaguccagcggacucuacucccugucuagcguggucaccguuccuuccagcucucuuggcacgcaaacauauauuugcaacgugaaucauaaacccuccaacaccaagguggacaaaaaggucgaaccuaaaagcugugauaagacacacaccugucccccgugcccugcccccgaggcggccggcgggccuucuguguuucuguucccucccaagcccaaagacacccucaugaucagcagaacaccggaaguuacgugcguggucguggauguuucccaugaggaccccgaggugaaguuuaauugguacgucgauggaguggaaguccacaacgcuaaaaccaagccucgggaggaacaguauaauucuacauaccgcgugguuagcgugcugaccguccuucaccaggacuggcugaacggcaaagaguauaaguguaaaguguccaauaaggcccuccccgcuccuauugagaagacaaucagcaaagccaaggggcagcccagagaaccgcaaguuuacacccugccucccucucgggacgagcugacgaaaaaccaggugucccucacaugccuggucaagggauucuacccuagcgauaucgcgguggaaugggagucuaauggccagcccgaaaacaacuauaaaaccaccccucccgugcuugacuccgaugggagcuuuuuccuguacuccaagcucacaguugacaagucucgcuggcaacagggaaaugucuuuagcuguuccgugaugcaugaggcccugcacaaccauuauacccagaaaucucuuagccuguccccgggcaag

SEQ ID NO: 39056 - RNA, 639 nt, Artificial Sequence
  derived and/or modified sequence opt5 from Teplizumab_LightChain1
gacauccagaugacccaaagccccuccucucugagcgccuccgugggcgauagagucacaauuacgugcucugcuagcuccucuguuagcuacaugaacugguaucagcagaccccugggaaggccccgaaacgguggaucuacgacacauccaagcucgcgagcggagugcccucucgcuucuccggcagcgggucuggaaccgauuauacauuuaccauuuccagccugcagccugaggacaucgcuacauacuauugucaacaguggucuuccaaucccuucaccuuuggccaggggacgaaacuucagauuaccagaacaguggccgccccuagcgucuucaucuuucccccuuccgaugaacaacugaagucuggaaccgcuagcgugguuugccuccugaacaauuucuacccgcgggaggccaaagugcaguggaaggucgacaacgcccuucaguccggcaauagccaggaaucugugacagagcaagauuccaaggacagcaccuauucucugagcuccacgcucacacugucuaaagcugauuacgaaaagcacaaaguuuacgcgugugaggugacccaucagggccugagcucccccgucacaaagagcuuuaaccgcggggagugc

SEQ ID NO: 39057 - RNA, 1344 nt, Artificial Sequence
  derived and/or modified sequence opt5 from Teprotumumab_HeavyChain1
cagguggagcuggucgaaagcggcgggggaguugugcaacccggcagaucccagcggcucucuugcgccgcuagcggguucaccuuuuccucuuacggaaugcacugggugcgccaggccccuggcaaggggcuggagugggucgcgaucauuugguucgacggaagcuccacauauuacgcugauucugugagaggccgguuuacgaucagccgcgacaacuccaaaaauacccuuuaucugcagaugaacagccucagagccgaagauacagccguuuacuucugugcucgggagcugggccgcagauauuuugaccuuugggggcggggaacccuggugucugucuccagcgccucuacaaagggcccguccguguucccccucgcuccuagcucuaaauccaccagcgggggaacagccgcgcugggcugccugguuaaggauuacuuucccgaaccugugaccgucuccuggaacucuggggcccucacgagcggagugcauaccuuccccgcugugcugcaauccagcggccuuuauucucuguccagcgucguuacagugccuucuagcucccucggcacccagacauacauuuguaaugugaaucacaaaccgucuaacaccaaggucgacaagaaaguggagcccaagagcugcgauaaaacgcauacauguccucccugcccugcccccgagcugcuugggggaccguccguuuuucuguucccucccaagccuaaagacacccucaugaucagccgcacacccgaagugaccugugucgugguugaugugucucacgaggaccccgaagucaaguuuaauugguacguggauggcgucgaggugcauaacgcuaagaccaaaccuagagaggaacaguauaauuccacauaccggguugugagcguccugacggugcugcaccaggacuggcucaacgggaaggaguauaaaugcaagguuucuaauaaagcccugccggcgcccauugaaaagaccaucuccaaagccaagggacaaccucgcgagccccagguguacacacuuccucccagcagagaugaacugaccaagaaccaggucucccucacaugucuggugaaaggcuucuauccgucugacaucgcuguggagugggagagcaaugggcagccugaaaacaauuacaagaccacgcccccuguucuugacuccgauggaucuuucuuucuguauagcaaacucacagucgacaagucccgguggcaacagggcaacguguucagcugcucugugaugcacgaggcccugcauaaccacuacacccagaaaucccugagccucucucccggcaag

SEQ ID NO: 39058 - RNA, 645 nt, Artificial Sequence
  derived and/or modified sequence opt5 from Teprotumumab_LightChain1
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaaaagagccaccggaaucccugcucgguucagcggcuccgggagcggaacagauuuuacccuuacaauuucuucccuggagcccgaagacuucgccguuuauuacugucaacagcgcagcaaguggccucccuggaccuuuggccaggggacaaaaguggagucuaagagaaccguggcugccccuuccgucuucaucuuuccgcccagcgaugaacagcucaaaucuggaacggcguccgugguuugccugcugaacaauuucuauccucgggaggccaaggugcaauggaaggucgacaacgcucuccagagcggcaauucccaggagucugugaccgaacaggauagcaaagacuccacauacagccugucuuccacccuuacacugagcaaggccgauuaugagaaacacaagguuuacgcuugugaagugacccaucaaggccucucuagccccgucacgaaauccuuuaaccgcggggagugc

SEQ ID NO: 39059 - RNA, 1338 nt, Artificial Sequence
  derived and/or modified sequence opt5 from Tesidolumab_HeavyChain1
gaggugcagcugguccaaagcggcgcugaaguuaagaaacccggguccucugugaaggugagcugcaaggcuuccggaggcaccuucucuagcuacgccaucuccugggucagacaggcgccugggcagggacucgaguggaugggcgggauuggaccguuuuucggcacagcuaacuaugcccagaaauuucaaggccgggugacgaucaccgccgacgaaucuacaagcaccgcuuacauggagcuguccagccuucgcucugaagauacagccguuuauuacugugcuagagacacccccuauuucgauuacugggggcagggaacacuggugaccgucuccagcgccucuacgaaaggcccuuccguguuuccccucgcgccuagcucuaaguccaccagcgggggaacagccgcucugggcugccuuguuaaggacuauuuccccgagccugugaccgucuccuggaacucuggggcccugacaagcggagugcacaccuuuccggcugugcuccaguccagcggccuguacucucuguccagcgucguuacggugcccucuagcucccucggcacacagaccuacauuuguaaugugaaucauaaaccuucuaacacaaaggucgauaaacggguggagcccaagagcugcgacaaaacccacaccuguccucccugcccggccccugaagcggccgggggacccuccguuuuccuguuuccucccaagcccaaggauacacuuaugaucagccgcacgccugaggugaccugugucgugguugacgugucucaugaagauccggaggucaaauucaauugguauguggacggcgucgaggugcacaacgcuaagacaaaacccagagaggaacaauacaauuccaccuaucggguugugagcguccugacagugcuccaucaggauuggcugaacgggaaggaauacaaaugcaagguuucuaauaaagcccuuccugcucccauugagaagaccaucuccaaggccaaaggacagccucgcgaaccccagguguauacgcugccgccuagcagagaggagaugacaaagaaccaagucucccucaccugucuggugaaaggcuuuuaccccucugacaucgccguggaaugggagagcaaugggcagccugaaaacaauuauaagaccacacccccuguucuggauuccgacggaucuuucuuucucuacagcaaacugaccgucgacaagucccgguggcagcaaggcaacguguucagcugcucugugaugcacgaggcccuucacaaucauuacacacagaagucccugagccucucucccggcaaa

SEQ ID NO: 39060 - RNA, 642 nt, Artificial Sequence
  derived and/or modified sequence opt5 from Tesidolumab_LightChain1
agcuacgagcugacccagccccucuccgugucugucgcccugggccaaacagcuagaaucacgugcagcggggacuccauuccuaacuauuacguuuauugguaccagcagaagccgggacaggcccccgugcuugugaucuaugaugacucuaaucggccuagcggcauucccgaacgcuucuccgggucuaacagcggaaauaccgcgacacugaccaucuccagagcucaagccggcgaugaggccgacuacuauugucagagcuuugauucuucccucaacgcugaagucuucgggggaggcacaaaacugaccgugcuuggccagccuaaggccgcucccagcguuacacuguuuccuccgucuuccgaggaacuccaggccaauaaagcgacccuggugugccugauuagcgacuucuaccccggggccgucacgguggcuuggaaggccgauucuuccccuguuaaagcuggaguggagaccacaacccccagcaagcaauccaacaauaaguacgccgcgucuagcuaucucucccugacaccugagcaguggaaaagccaccggucuuacuccugucaggucacccaugaaggcagcacgguggagaagacaguggcccccaccgaaugcucu

SEQ ID NO: 39061 - RNA, 1344 nt, Artificial Sequence
  derived and/or modified sequence opt5 from Tezepelumab_HeavyChain1
cagaugcaacugguggagagcggcgggggagucguucagcccggcagaucccuccggcugucuugcgccgcuagcggguucaccuuucgcacauacggaaugcacugggugagacaggccccuggcaaggggcuugaauggguggcggucaucugguaugacggauccaacaaacauuacgcugauucugugaagggccgguucacgauuacccgcgacaauagcaaaaacacacugaaucuccagaugaacucccugagagccgaggauaccgccguuuauuacugugcucgggccccgcaaugggaacuugugcacgaggcuuuugacaucuggggccaggggacaauggucaccgugucuagcgccuccacaaagggacccagcguuuucccucuggcgcccugcucucgcuccaccagcgaaucuacggccgcucucggcugucuggugaaagauuauuuuccugagcccgucaccguguccuggaauagcggggcccugacaucuggagugcauaccuucccugcuguccuccaguccagcggccuguacucccuuucuagcguugugacagugccguccagcaacuuugggacccagacguauacaugcaaugucgaccacaagcccucuaacaccaagguggauaaaacaguugagagaaaguguugcguggaauguccucccugcccugcgcccccggucgccggaccuuccguguuccuguuucccccuaaacccaaggacacccucaugauuagccggacccccgagguuacauguguggucguggaugucucucaugaagacccugaggugcaauucaauugguacguugauggcguggagguccacaacgccaaaacgaagccgcgcgaggaacaguuuaauagcaccuucagagugguuuccgugcugacagucgugcaccaggacuggcuuaacggcaaggaauacaaaugcaaggugucuaauaaagggcugcccgcuccuaucgagaagaccauuagcaaaacaaagggacagccccgggaaccucaaguuuauacccugcccccgucccgcgaggagaugacgaaaaaccaggucagccucacaugucuggugaagggcuuuuacccuucugauaucgccguggaaugggaguccaaugggcagcccgaaaacaacuauaagaccaccccucccaugcucgacagcgacggaucuuucuuccuguacuccaaacuuacagucgauaagagcagauggcaacagggcaauguguuuuccugcucuguuaugcaugaggcucugcacaaccauuauacccagaaaagccucucccugucuccugggaag

SEQ ID NO: 39062 - RNA, 642 nt, Artificial Sequence
  derived and/or modified sequence opt5 from Tezepelumab_LightChain1
agcuacgugcugacccagcccccuuccgucucuguugccccgggccaaacagcuagaaucacgugcgggggaaacaaucucggcagcaaguccgugcacugguaucagcagaaacccgggcaggccccugugcuggucguguacgacgauucugaccggcccagcuggauuccugagcgcuucuccggaucuaacagcggcaauaccgcgacacuuaccaucuccagaggggaagcuggagaugaggccgacuauuacugucaaguuugggauagcagcuccgaccauguggucuuuggcggcgggacaaagcugaccgugcucggacagcccaaagccgcuccuagcguuacacuguucccgcccucuuccgaagaacuucaggccaacaaggcuacccuggugugccucauuagcgauuuuuauccuggcgccgucacgguggcguggaaagccgacucuucccccgugaaggcuggggucgaaaccacaaccccuagcaagcaguccaauaacaaauacgccgcuucuagcuaucugucccugacacccgagcaauggaagucucaccggucuuacuccugucagguuacccaugagggaagcacgguggagaaaacaguggccccgaccgagugcucu

SEQ ID NO: 39063 - RNA, 1338 nt, Artificial Sequence
  derived and/or modified sequence opt5 from ThioMAb-chMA79b-HC(A118C)_HeavyChain
gaggugcagcugcaacagagcggcgccgaacucaugaagcccggggcuuccgucaaaaucucuugcaaggccaccggauacacauucagcuccuauuggauugaguggguuaaacagagaccuggccacgggcuggaauggaucggagagauucuuccgggcgggggagacacgaacuacaaugaaaucuuuaagggcaaagcgaccuucacagcugauaccucuagcaacacagccuauaugcagcuguccucucucaccagcgaggacuccgccguguacuauuguacacggcgcgugcccgucuacuuugauuauuggggccaagggaccagcgugacgguuucuuccugcagcaccaagggaccuucuguguucccccuggcuccuuccagcaagucuacauccggcgggaccgccgcucuuggaugucuggucaaagacuacuuucccgagccugugacaguuagcuggaacuccggcgcccucaccucuggggugcauacguucccggcgguccugcagagcuccggacuguacagccucucuuccguggugacaguccccagcucuagccugggcacccagacauauauuugcaauguuaaucacaagccuuccaacaccaaaguggauaagaaaguggaacccaagucuugugacaagacccauacaugcccucccuguccggccccugagcuucugggcgggcccagcgucuuucucuucccucccaaacccaaggauacgcugaugaucuccagaaccccugaagugacaugcguuguggucgacgugagccacgaggauccggagguuaaauuuaauugguacguggacggagucgaagugcauaacgcuaagaccaaaccccgggaggaacaguauaauucuacauaccgcgucguguccguucuuaccgugcugcaccaagauuggcucaacggcaaggaguauaaauguaaggucagcaauaaggcccugccugcucccaucgagaaaacgauuucuaaggccaaagggcagccuagagaaccccagguguacacacugccgccuucccgggaggaaaugaccaagaaccagguuagccugaccugccucgugaaaggauucuaucccuccgacaucgcggucgagugggaaucuaauggccaaccugagaacaauuacaagacaacacccccugugcuugauagcgacggguccuuuuuccuguacucuaagcucaccguggacaaaagccgcuggcagcagggaaacgucuuuuccuguagcguuaugcacgaagcccugcauaaccacuauacgcaaaagucucuuucccugagccccggc

SEQ ID NO: 39064 - RNA, 1347 nt, Artificial Sequence
  derived and/or modified sequence opt5 from ThioMab-hu10A8.v1-HC(A118C)_HeavyChain
gaggugcagcuggucgaaagcggcgggggacucguucaacccggcgggucccugagacuuucuugcgccgcuagcggauucaccuuuuccucuuacgccgugagcugggugcggcaggcgccuggcaaggggcuggagugggucgcuacaaucuccucuggaggcagccucacguucuaucuggacuccgugcgcggcagauuuaccauuagccgggauaacucuaaaaauacacuuuaccugcagaugaacucccuccgcgccgaagacaccgccguuuauuacugugcuagaccgauccccgauuauuacgcccuggacuauugggggcagggaacacuggugaccgucagcucuugcuccacaaagggcccuagcguguucccccucgcuccuucuuccaaaagcaccuccgggggaacggccgcgcugggcugucuuguuaaggauuacuuucccgagccugugaccgucucuuggaauagcggggcccugacauccggagugcacaccuucccggcugugcuccaaagcucuggccuguacucccuuagcucugucguuacagugcccagcuccucucugggcacccagacguauauuugcaacgugaaucauaaaccuagcaacacaaaggucgacaagaaaguggaacccaaguccugugauaaaacccacacaugcccucccuguccggccccugagcuccugggaggacccagcguuuuucuguucccucccaagcccaaagacacccucaugaucucucggaccccugaggugacaugcgucgugguugaugugucccaugaagacccggaggucaaguuuaauugguacguggauggcgucgaagugcacaacgcuaagacgaaaccccgcgaggagcaguauaauagcaccuacagaguugugucuguccugacagugcuucaucaggacuggcugaacgggaaggaauauaaauguaagguuuccaauaaagcccucccugcgcccauugagaagaccaucagcaaagccaagggacaaccucgggaaccccagguguacacacugccgccuucccgcgaggaaaugaccaagaaccaggucucucuuacgugccuggugaaaggcuucuaucccagcgauaucgcuguggagugggaguccaaugggcagccugaaaacaauuacaagacaacacccccuguucucgacucugacgggagcuuuuuccuguacuccaaacugaccgucgauaagagcagauggcaacagggcaacguguuuucuuguuccgugaugcacgaggcccuccacaaccauuauacccagaaaagccugucucuuucccccggcaag

SEQ ID NO: 39065 - RNA, 1347 nt, Artificial Sequence
  derived and/or modified sequence opt5 from ThioMab-hu10A8.v1-HC(V205C)_HeavyChain
gaggugcagcuggucgaaagcggcgggggacucguucaacccggcgggucccugagacuuucuugcgccgcuagcggauucaccuuuuccucuuacgccgugagcugggugcggcaggcgccuggcaaggggcuggagugggucgcuacaaucuccucuggaggcagccucacguucuaucuggacuccgugcgcggcagauuuaccauuagccgggauaacucuaaaaauacacuuuaccugcagaugaacucccuccgcgccgaagacaccgccguuuauuacugugcuagaccgauccccgauuauuacgcccuggacuauugggggcagggaacacuggugaccgucagcucugcuuccacaaagggcccuagcguguucccccucgccccuucuuccaaaagcaccuccgggggaacggcggcccugggcugccuuguuaaggauuacuuucccgagccugugaccgucucuuggaauagcggggcucugacauccggagugcacaccuucccggccgugcuccaaagcucuggccuguacucccuuagcucugucguuacagugcccagcuccucucugggcacccagacguauauuuguaacgugaaucauaaaccuagcaacacaaaggucgacaagaaaguggaacccaaguccugcgauaaaacccacacauguccucccugcccggcuccugagcuccugggaggacccagcguuuuucuguucccucccaagcccaaagacacccucaugaucucucggaccccugaggugacaugugucgugguugaugugucccaugaagacccggaggucaaguuuaauugguacguggauggcgucgaagugcacaacgccaagacgaaaccccgcgaggagcaguauaauagcaccuacagaguugugucuguccugacagugcuucaucaggacuggcugaacgggaaggaauauaaaugcaagguuuccaauaaagcgcucccugcccccauugagaagaccaucagcaaagcuaagggacaaccucgggaaccccagguguacacacugccgccuucccgcgaggaaaugaccaagaaccaggucucucuuacgugucuggugaaaggcuucuaucccagcgauaucgccguggagugggaguccaaugggcagccugaaaacaauuacaagacaacacccccuguucucgacucugacgggagcuuuuuccuguacuccaaacugaccgucgauaagagcagauggcaacagggcaacguguuuucuugcuccgugaugcacgaggcucuccacaaccauuauacccagaaaagccugucucuuucccccggcaag

SEQ ID NO: 39066 - RNA, 642 nt, Artificial Sequence
  derived and/or modified sequence opt5 from ThioMab-hu10A8.v1-LC(A118C)_LightChain
gacauccagaugacccaaagccccuccucucugagcgccuccgugggcgauagagucacaauuacgugcaaggcuucucaggacguuagcaccgccguggcgugguaccagcagaaaccugggaaggcuccgaaacuccugaucuauuccgccucuuaccgguauacaggagugcccagccgcuucuccggcagcgggucuggaaccgauuuuacacuuaccauuuccagccugcaaccugaggacuucgccacauacuauugucagcagcacuuuucuucccccagaaccuucggccaggggacgaaggucgaaaucaaacggaccguggcugccccuagcguuuuuauuuuucccccuucugaugagcaacucaaguccggaacagcuagcguggucugccugcuuaacaauuucuacccgcgcgaagccaaggugcaguggaaaguugacaacgcgcugcaguccggcaauucucaggagagcgugaccgaacaagauuccaaggacagcacauauucucucuccagcacccugacgcugucuaaagccgauuacgagaagcauaaagucuacgcuugugaggugacacaccagggccucagcucccccgugaccaagucuuucaacagaggggaaugc

SEQ ID NO: 39067 - RNA, 642 nt, Artificial Sequence
  derived and/or modified sequence opt5 from ThioMab-hu10A8.v1-LC(V205C)_LightChain
gacauccagaugacccaaagccccuccucucugagcgccuccgugggcgauagagucacaauuacgugcaaggcuucucaggacguuagcaccgccguggcgugguaccagcagaaaccugggaaggcuccgaaacuccugaucuauuccgccucuuaccgguauacaggagugcccagccgcuucuccggcagcgggucuggaaccgauuuuacacuuaccauuuccagccugcaaccugaggacuucgccacauacuauugucagcagcacuuuucuucccccagaaccuucggccaggggacgaaggucgaaaucaaacggaccguggcugccccuagcguuuuuauuuuucccccuucugaugagcaacucaaguccggaacagcuagcguggucugccugcuuaacaauuucuacccgcgcgaagccaaggugcaguggaaaguugacaacgcgcugcaguccggcaauucucaggagagcgugaccgaacaagauuccaaggacagcacauauucucucuccagcacccugacgcugucuaaagccgauuacgagaagcauaaagucuacgcuugugaggugacacaccagggccucagcucccccugcaccaagucuuucaacagaggggaaugu

SEQ ID NO: 39068 - RNA, 1338 nt, Artificial Sequence
  derived and/or modified sequence opt5 from ThioMAb-huMA79b.v17-HC(A118C)_HeavyChain
gaggugcagcuggucgaaagcggcgggggacucguucaacccggcgggucccugagacuuucuugcgccgcuagcggauacaccuucuccucuuauuggaucgagugggugcggcaggccccuggcaaggggcuggaauggauuggagagauccucccgggcggcggggacacaaacuacaaugaaauuuuuaaaggacgcgcgacguucagcgcugauaccuccaagaacacagccuaucugcagaugaauagccuuagagccgaggacaccgcuguguacuauuguacacggcgcguccccguguacuuugauuauuggggccaggggacccugguuacagugagcuccugcagcaccaaaggaccuucugucuucccccucgccccuuccagcaagucuacguccggcgggaccgcugcccugggaugucuggugaaagacuacuuucccgagccuguuacagugagcuggaacucuggcgcgcucaccuccggcguccacacauucccggccgugcugcaaagcuccgggcuuuacucucugagcuccguggucaccguucccucuucuucccucggaacgcagacauauaucugcaaugugaaccauaagccuagcaauaccaagguggauaaaaaggucgaacccaaaucuugugacaagacacauaccugcccucccuguccggcuccugagcugcuuggcgggcccagcguguuucuguucccucccaaacccaaggauacccucaugauuuccagaacaccugaaguuacgugcguggucguggacguuucucacgaggauccggaggugaaguuuaacugguacgucgacggaguggaaguccacaaugccaaaaccaagccccgggaggaacaguauaacagcacauaccgcgugguuuccgugcugaccguccugcaucaggauuggcucaauggcaaagaguauaaguguaaagugagcaacaaggcucugccugcccccaucgaaaagacaaucucuaaggcgaaggggcaaccuagagagccccagguuuacacccuuccgccuucccgggaggaaaugacgaaaaaucaggugagccugacaugccucgucaagggauucuaucccucugacauugccguggagugggaauccaacggccagccugagaauaacuacaaaaccacacccccugugcuggauagcgacggcuccuuuuuccuuuacucuaagcugaccguugacaaaagccgcuggcaacaggggaacgucuuuuccuguucugugaugcacgaagcucuccacaaucauuauacccagaaaagccugucccugagccccgga

SEQ ID NO: 39069 - RNA, 654 nt, Artificial Sequence
  derived and/or modified sequence opt5 from ThioMAb-huMA79b.v17-HC(A118C)_LightChain
gacauccagcugacccaaagccccuccucucucagcgccuccgugggcgauagagucacaauuacgugcaaggcuucucagagcguugacuacgauggggacuccuuccugaacugguaucagcagaaaccuggaaaggccccgaaacuucugaucuacgcggcuucuaaucucgagagcggcgugcccucccgguuuagcgggucuggauccggcaccgauuucacacugaccauuagcucucuucaaccugaagacuuugccacauauuacugucagcaguccaacgaggauccccugaccuucgggcagggaacaaagguggaaaucaaacgcaccgucgccgcuccuagcguguuuauuuuucccccuucugacgagcaacucaaguccggcacggccagcguugugugccugcugaauaacuucuauccgagagaagcuaagguccaguggaaaguggauaaugcccuccaguccggcaacucucaggagagcguuaccgagcaagacuccaaggauagcacauacucucuguccagcacccuuacacugucuaaagcggacuaugaaaagcacaaaguguacgccugugaggucacccaucaggggcucagcucccccgugacgaagucuuucaaucggggagaaugc

SEQ ID NO: 39070 - RNA, 1338 nt, Artificial Sequence
  derived and/or modified sequence opt5 from ThioMAb-huMA79b.v18-HC(A118C)_HeavyChain
gaggugcagcuggucgaaagcggcgggggacucguucaacccggcgggucccugagacuuucuugcgccgcuagcggauacaccuucuccucuuauuggaucgagugggugcggcaggccccuggcaaggggcuggaauggauuggagagauccucccgggcggcggggacacaaacuacaaugaaauuuuuaaaggacgcgcgacguucagcgcugauaccuccaagaacacagccuaucugcagaugaauagccuuagagccgaggacaccgcuguguacuauuguacacggcgcguccccaucagacuggauuacuggggccaggggacccucgugacaguuagcuccugcagcaccaaaggaccuucuguguuuccccuggccccuuccagcaagucuacguccggcgggaccgcugcccugggaugucucgucaaagacuauuuccccgagccugugacaguuagcuggaacucuggcgcgcugaccuccggcgugcacacauuuccggccguccuucaaagcuccgggcuguacucucucagcuccguggugaccguccccucuucuucccugggaacgcagacauacauuugcaauguuaaccauaagccuagcaauaccaagguggauaaaaagguggaacccaaaucuugugacaagacacauaccugcccucccuguccggcuccugagcuucugggcgggcccagcgucuuccucuuuccucccaaacccaaggauacccugaugaucucccggacaccugaagugacgugcguuguggucgacgugucucacgaggauccggagguuaaguucaacugguauguggacggagucgaagugcacaaugccaaaaccaagccccgcgaggaacaguacaacagcacauauagagucguguccguucugaccgugcuccaucaggauuggcugaauggcaaagaguacaaguguaaagucagcaacaaggcccuuccugcucccaucgaaaagacaauuucuaaggcgaaggggcaaccucgggagccccagguguauacccugccgccuucccgcgaggaaaugacgaaaaaucagguuagccucacaugccuggugaagggauuuuaccccucugacaucgccgucgagugggaauccaacggccagccugagaauaacuauaaaaccacacccccugugcuugauagcgacggcuccuucuuucuguacucuaagcucaccguggacaaaagcagauggcaacaggggaacguuuucuccuguucugucaugcacgaagcucugcacaaucauuacacccagaaaagccugucccucagccccgga

SEQ ID NO: 39071 - RNA, 654 nt, Artificial Sequence; identical to SEQ ID NO: 38915
  derived and/or modified sequence opt5 from ThioMAb-huMA79b.v28-HC(A118C)_LightChain

SEQ ID NO: 39072 - RNA, 654 nt, Artificial Sequence
  derived and/or modified sequence opt5 from ThioMAb-huMA79b.v28-LC(V205C)_LightChain
gacaucgugcugacccagagccccgccucccucgcugucucucugggccaaagagccacaauuagcugcaaggcgucccagucuguugauuacgacggggauagcuuccuuaacugguaucagcagaaaccuggacaaccgcccaagcuguuuaucuacgcugccuccaaucucgagucuggcauuccugcccgguucagcggguccggaagcggcacggacuuuacccugaacauccaccccguggaagaggaagaugcugccacauauuacugucagcagucuaaugaggacccucuuaccuucggggcuggaacagaacuggagcucaaacgcaccguggccgcgcccuccgucuuuauuuucccuccgagcgaugagcagcugaagucuggcacagccuccgugguuugccugcucaacaauuuuuaucccagagaagcuaaagugcaauggaaggucgacaacgcccugcagagcggcaauucucaggaguccgugaccgaacaggauagcaaggacuccacguacucucuuagcuccacccugacacucagcaaagcugauuaugagaagcauaaaguuuacgccugugaggugacccaccaagggcugucuuccccuugcacaaagagcuucaaccggggagaaugu

SEQ ID NO: 39073 - RNA, 1332 nt, Artificial Sequence
  derived and/or modified sequence opt5 from Ticiliuab_HeavyChain1
caggugcaacuggucgagagcggcgggggaguugugcagcccggcagaucccuccggcugucuugcgccgcuagcggguucaccuuuuccucuuacggacacugggugcgccaggccccuggcaaggggcuugaaugggucgcggugaucugguaugacggaagcaacaaauacuaugcugauuccguuaagggcagauucacaauuucucgggacaauagcaaaaacacgcuguaccuccaaaauucccugcgcgccgaggauaccgccguguauuacugugcuagagacccgcggggcgccacacuuuauuacuacuauuacggggaugucuggggacagggcaccacagugaccguuagcucugcuuccacaaaggggcccagcguguuuccucuggcccccugcucucgcuccaccagcgaaucuacggcggcccucggaugucuggucaaagacuauuucccugagcccgugaccguguccuggaacagcggcgcucugacauccgggguccauaccuuuccugccguucuccagucuagcggacuguacucccuuagcucuguggugacagucccguccagcaauuucggcacccagacguauacaugcaacguggaucacaagcccucuaauaccaagguugacaaaacaguggaaagaaaguguugcgucgaguguccucccugcccugcucccccgguggccggcccuagcguuuuucuguuucccccuaaacccaaggauacccucaucucccggacccccgaggugacaugugucguggucgacgugucucaugaagauccugagguucaguucaacugguacguggacggggucgaagugcacaaugcgaaaacgaagccgcgcgaggagcaauucaacagcaccuuuagaguuguguccguccugacaguggugcaucaggauuggcuuaauggaaaggaauauaaaugcaagguuagcaacaaaggccugcccgccccuauugagaagaccaucucuaaaacaaaggggcagccccgggaaccucaggucuacacccugcccccgucccgcgaggaaacgaaaaaucaagugagccucacaugucuggugaagggauucuacccuucugacauugcugucgagugggaguccaacggccagcccgaaaauaacuauaagaccaccccuccccucgacagcgauggguccuuuuuccuguacucuaaacuuacaguggacaagagcagauggcagcaaggaaacguuuucuccugcucugugcacgaggcccugcacaaucauuauacccagaaaagccucucccugagcccuggcaag

SEQ ID NO: 39074 - RNA, 639 nt, Artificial Sequence
  derived and/or modified sequence opt5 from Ticiliuab_LightChain1
gacauccagacccaaagccccuccucucugagcgccuccgugggcgauagagucacaauuacgugccgggcuucucagagcaucaacuccuaccucgacugguaucagcagaaaccugggaaagccccgaagcugcuuauuuacgcggcuucuagccugcaauccggaguucccagccgcuucucuggcuccgggagcggaaccgauuuuacacucaccaucucuucccugcagccugaggacuucgccacauauuacugucagcaguauuacagcacccccuuuacauucggcccugggaccaaaguggaaauuaagagaacgguggccgcucccucugucuuuaucuucccuccguccgaugagcaacuuaaaagcggaaccgccuccgugguuugccugcucaauaacuuuuauccccgggaagcuaaggugcaguggaaggucgacaaugcccugcagucuggcaacagccaggaguccgugacagaacaagauagcaaagacucuaccuacucccugagcucuacacucacccugagcaaggcggauuacgagaaacacaagguuuaugccugugaggugacgcaucagggccuuuccucuccugucacaaagagcuucaaucgcggggaaugc

SEQ ID NO: 39075 - RNA, 1347 nt, Artificial Sequence
  derived and/or modified sequence opt5 from Tigatuzumab_HeavyChain1
gaggugcagcuggucgaaagcggcgggggacucguucaacccggcgggucccugagacuuucuugcgccgcuagcggauucaccuuuuccucuuacgugaugagcugggugcggcaggccccuggcaaggggcuggagugggucgcgacaaucuccucuggaggcagcuauacguacuauccggacuccgugaaaggccgcuucaccauuagcagagauaacgcuaagaauacacucuaccugcagaugaacucucuucgggccgaagacaccgccguuuauuacugugcucgcagaggggauuccaugaucacaaccgacuauuggggacagggcacacuggugaccgucagcucugccuccacgaaagggcccagcguguuuccucucgcucccucuuccaagagcaccuccggaggcacagccgcgcuggggugccugguuaaagauuacuucccugagcccgugaccgucucuuggaauagcggagcccucacauccggcgugcacaccuuuccugcugugcugcaaagcucuggccuuuacucccugagcucugucguuacggugccgagcuccucucucgggacacagaccuauauuuguaacgugaaucauaagcccagcaacacaaaggucgacaaacggguggaaccuaaguccugcgauaaaacccacaccugucccccuugccccgccccggagcugcuuggaggcccuagcguuuuccuguuucccccuaagcccaaagacacacucaugaucucucgcacgcccgaggugaccugugucgugguugaugugucccaugaagacccugaggucaaguucaauugguacguggauggggucgaagugcacaacgcuaagacaaaaccgagagaggagcaguauaauagcaccuaccggguugugucuguccugacagugcugcaucaggacuggcucaacggaaaggaauauaaaugcaagguuuccaauaaagcccugcccgcgccuauugagaagaccaucagcaaagccaagggccaaccccgcgaaccucagguguacacgcuucccccguccagagaggaaaugacaaagaaccaggucucucugaccugucucgugaaaggguuuuauccuagcgauaucgcuguggagugggaguccaauggacagcccgaaaacaauuacaagaccacaccucccguucuggacucugacggcagcuucuuucuuuacuccaaacugaccgucgauaagagccgguggcaacagggcaacguguucucuugcuccgugaugcacgaggcccuccacaaccauuauacacagaaaagccugucucuguccccugggaag

SEQ ID NO: 39076 - RNA, 1347 nt, Artificial Sequence; identical to SEQ ID NO: 39075
  derived and/or modified sequence opt5 from Tigatuzumab_HeavyChain

SEQ ID NO: 39077 - RNA, 639 nt, Artificial Sequence
  derived and/or modified sequence opt5 from Tigatuzumab_LightChain1
gacauccagaugacccaaagccccuccucucugagcgccuccgugggcgauagagucacaauuacgugcaaggcuucucaggacguugggaccgccguggcgugguaccagcagaaaccuggaaaggcuccgaaacuccugaucuauugggccagcacacggcacaccggcgugcccucccgcuucucugggagcggauccggcacagauuuuacccuuacaauuagcucucugcaaccugaggacuucgccaccuacuauugucagcaguacuccagcuauagaacguuugggcagggaaccaaggucgaaaucaaacggacaguggcugcccccucuguuuucauuuuuccucccuccgaugagcaacucaagagcggcaccgcuucuguggucugccugcuuaacaauuucuacccucgcgaagccaaggugcaguggaaaguugacaacgcgcugcaguccggcaauagccaggaguccgugacagaacaagauucuaaggacagcaccuauucccucagcucuacgcugacacuguccaaagccgauuacgagaagcauaaagucuacgcuugugaggugacccaccaggggcucagcucuccggugacaaagagcuuuaacagaggagaaugc

SEQ ID NO: 39078 - RNA, 639 nt, Artificial Sequence; identical to SEQ ID NO: 39077
  derived and/or modified sequence opt5 from Tigatuzumab_LightChain

SEQ ID NO: 39079 - RNA, 1338 nt, Artificial Sequence
  derived and/or modified sequence opt5 from Tildrakizumab_HeavyChain1
caggugcaacugguccagagcggcgccgagguuaagaaacccggggcuuccgugaaggugucuugcaaagccagcggauacaucuucauuaccuauuggaugacaugggucagacaggcgccuggccaggggcucgaauggaugggacaaaucuuuccggcuuccggcucugccgacuacaacgagaaguucgaagggcgggugacgaugaccacagauaccagcacauccaccgccuauauggagcugcgcucucuuagaagcgacgauacagcuguuuacuauugugcccggggaggcggcggguuugcuuacuggggacagggcacccuggugacggucuccagcgccucuaccaaagggcccuccguguucccucucgcgcccagcucuaaguccacaagcggaggcaccgccgcucuggggugccuuguuaaggacuauuuuccugaacccgugacagucucuuggaacuccggagcccugaccagcggcgugcacacguucccugcugugcuccaguccucuggccuguacagccuguccagcgucguuacagugccgucuuccagccucgggacccagacauacauuuguaaugugaaucauaaacccucuaacaccaaggucgauaaaaagguggagccuaaaagcugcgacaagacccacacaugucccccuugccccgccccggagcugcuuggaggcccuuccguuuuucuguuucccccuaagcccaaagauacgcucaugaucucucgcacccccgaagugacaugugucgugguugacgugagccaugaggauccugaagucaaguuuaauugguauguggacggggucgaggugcacaacgcgaaaaccaagccgagagaggaacaauacaauuccacauaucggguugugagcguccugaccgugcuucaucaggauuggcugaacggaaaagaguacaagugcaaaguuucuaauaaggcccuccccgcuccuauugaaaagacgaucuccaaagccaagggccagccccgcgagccucagguguauacacugcccccgagcagagacgaacugaccaaaaaccaagucucucucaccugucuggugaagggguucuacccuuccgauaucgcuguggagugggagagcaauggacagcccgaaaacaauuauaaaacaaccccucccguucuugacuccgacggcucuuucuuccuguacagcaagcucacagucgauaagucccgguggcagcaaggcaacguguuuucuugcagcgugaugcacgaggcccugcacaaucauuacacgcagaaaucccuuagccugucuccugggaag

SEQ ID NO: 39080 - RNA, 642 nt, Artificial Sequence
  derived and/or modified sequence opt5 from Tildrakizumab_LightChain1
gacauccagaugacccaaagccccuccucucugagcgccuccgugggcgauagagucacaauuacgugccggaccucugagaacaucuacagcuaucucgcuugguaccagcagaagccugggaaagccccgaagcugcuuauuuauaaugcgaaaacacuggcugaaggaguucccucccgcuucucuggcagcggguccggaaccgacuuuacacucaccaucagcucucugcagccugaggauuucgccacauacuauugucaacaccauuacggcauucccuuuaccuucgggcagggaacgaagguggaaaucaaaagaaccguggccgcuccuuccgucuuuaucuuucccccuagcgacgagcagcuuaagucuggcacagccuccgugguuugccugcucaacaauuucuauccgcgggaagcuaaggugcaguggaaagucgauaacgcccugcaaagcggcaauucucaggaguccgugaccgagcaggacagcaaggauuccacauacucucugagcuccacccucacgcugagcaaagcggacuacgaaaagcacaaaguuuaugccugugaggugacacaucaggggcuuucuucccccgucaccaagagcuucaaccgcggagaaugc

SEQ ID NO: 39081 - RNA, 1344 nt, Artificial Sequence
  derived and/or modified sequence opt5 from Tisotumab_vedotin_HeavyChain1
gaggugcagcugcucgaaagcggcgggggacugguccaacccggcgggucccuuagacugucuugcgccgcuagcggauucaccuuuuccaacuacgccaugucuuggguucggcaggcgccuggcaaggggcucgagugggugagcuccaucucuggaagcggcgacuauacauacuauacggauuccgugaaaggccgcuucaccauuagcagagacaauucuaagaacacacuguaccuucagaugaacucccugcgggcugaagauaccgccgucuauuacugugcccgcagcccguggggguauuaccucgacucuuggggacagggcacacuggugaccguuuccagcgcuucuacaaaagggcccuccguguuuccucuggcccccagcuccaagucuaccagcggaggcacggcugcccucgggugccuggucaaagauuacuucccugagcccgugaccguuuccuggaauagcggagcgcuuacaucuggcgugcacaccuuuccugccguccugcaauccagcggccucuauucucugagcuccguggugacagucccgucuagcucccuugggacccagacguacaucuguaauguuaaccauaagcccagcaauacaaagguggacaaaagaguggaaccuaagucuugcgauaaaacccacacaugucccccuugccccgcuccggagcugcucggaggcccuuccgucuuccuguuucccccuaagcccaaagacacccugaugauuagccggacccccgaggugacauguguuguggucgaugugucucaugaagacccugagguuaaguucaacugguauguggauggggucgaagugcacaaugccaagacgaaaccgcgcgaggagcaguacaacuccaccuauagagucgugagcguucucacagugcugcaucaggacuggcuuaauggaaaggaauacaaaugcaaggucuccaacaaagcucugcccgccccuaucgagaagaccauuucuaaagcgaagggccaaccccgggaaccucagguguauacacugcccccgagccgcgaggaaaugaccaagaaucagguuucccucacgugucuugugaaaggguuuuacccuucugauaucgccgucgagugggagagcaacggacagcccgaaaauaacuacaagacaaccccucccgugcuggacuccgacggcagcuucuuucucuauucuaaacugaccguggauaaguccagauggcaacagggcaacguuuucagcugcucugucaugcacgaggcucugcacaaucauuacacacagaaaucccucagccugucuccugggaag

SEQ ID NO: 39082 - RNA, 642 nt, Artificial Sequence
  derived and/or modified sequence opt5 from Tisotumab_vedotin_LightChain1
gacauccagaugacccaaagcccucccagccugucugccagcgcuggcgauagagugacaauuacgugccgggccucccaggggaucucuagccgccucgcgugguaccagcagaagccggagaaagcucccaagucccugauuuaugccgccucuagccuucaauccggagucccuagcagauucucuggcuccgggagcggaaccgacuuuacacugaccaucucuucccuccagcccgaagauuucgcuacauacuauugucagcaguacaacagcuauccuuacaccuuuggccaagggacaaaacuggagauuaagcggaccguugccgcucccucuguguucaucuuuccuccguccgacgaacagcuuaaaagcggaacggccuccguggucugccugcucaauaacuucuauccccgcgaggcgaaggugcaguggaagguugauaaugcccugcagucuggcaacagccaagaauccgugaccgagcaggacagcaaagauucuacauacucccugagcucuacccucacacugagcaaggcugacuacgagaaacacaaggucuaugccugugaagugacccaucagggccuuuccucuccuguuacgaaauccuuuaauagaggggagugc

SEQ ID NO: 39083 - RNA, 1341 nt, Artificial Sequence
  derived and/or modified sequence opt5 from Tocilizumab_HeavyChain1
gugcaacugcaagagagcggccccgggcucgucagaccuucccagacccugucucuuacaugcacgguuagcggauacuccaucaccucugaccacgccuggagcugggugcggcagccgcccggccgcgggcuggaauggauuggauauaucuccuacucuggcauuacaaccuauaacccuagccucaaguccagagugacaaugcugcgggauaccagcaaaaaucaguucucucuucgccuguccagcgucacagcugccgacaccgcgguguacuauugugcuagaucucucgcccggacgaccgccauggauuacugggggcaaggaucccugguuacagugagcucugcuuccaccaagggccccagcgucuuuccucuggcccccuccucuaaaagcacauccggcgggaccgcugcccucggaugccuggugaaggacuauuucccugagccgguuacggugagcuggaacucuggcgcgcuuacauccgggguccauaccuuucccgccgugcugcagagcucuggacucuacagccuguccucuguggucacaguuccuagcuccagccuuggcacccagaccuacaucuguaaugugaaccacaaacccucuaauacaaagguggauaagaaagucgaaccuaaguccugcgacaaaacgcauaccugucccccgugcccugcucccgagcugcucgggggaccuagcguguuccuguuuccucccaagcccaaagauacacugaugauuucucgcaccccggaaguuacauguguggucguggacguuucccacgaggaucccgaggugaaguucaacugguaugucgacggcguggaaguccauaaugccaagaccaaaccuagagaggaacaguacaacagcacguaucgggugguuuccgugcucacaguccugcaccaagauuggcuuaauggcaaggaguacaaaugcaaggugucuaacaaagcucugcccgccccuaucgagaagaccaucagcaaagcgaaggggcagccccgcgaaccgcagguuuauacccucccucccuccagagacgagcugacaaagaaucaggugucucuuaccugucuggucaaaggauuuuacccuagcgauauugccguggaaugggaguccaacggccaacccgaaaauaacuauaagacaacgccucccgugcucgacagcgacgggucuuucuuucuguacuccaaacugaccguugauaagagccgguggcagcagggaaaugucuucucuugcuccgugaugcacgaggcucuccauaaccacuacacacagaaaagccugucucuuagcccgggc

SEQ ID NO: 39084 - RNA, 642 nt, Artificial Sequence
  derived and/or modified sequence opt5 from Tocilizumab_LightChain1
gacauccagaugacccaaagccccuccucucugagcgccuccgugggcgauagagucacaauuacgugccgggcuucucaggacaucagcuccuaccucaacugguaucagcagaagccugggaaagccccgaagcugcuuauuuacuauaccucucgccugcacagcggaguucccuccagauucagcggcucuggguccggaacagauuuuaccuucacaaucagcucucuccaaccugaggacauugcgaccuacuauugucagcagggcaauacacugcccuacaccuuugggcagggaacgaaaguggaaaucaagcggaccguggcugccccuuccgucuucaucuuucccccuagcgaugagcaacuuaaaucuggcacagccuccgugguuugccugcucaacaauuucuauccgcgcgaagcuaaggugcaguggaaggucgacaacgcccugcagagcggcaauucccaggagucugugaccgaacaagauagcaaagacuccacauacagccugucuuccacccucacgcugagcaaggcugauuacgagaaacauaagguuuaugccugugaggugacacaccaggggcuuucuagccccgucaccaaauccuuuaacagaggagaaugc

SEQ ID NO: 39085 - RNA, 1353 nt, Artificial Sequence
  derived and/or modified sequence opt5 from Tosatoxumab_HeavyChain1
gaggugcagaugguccaaagcggcgccgaaguuaagaaacccggggagccucugaagaucuccugcaaaggaucuggcuacaaguucgggacccacuggauuggaugggugagacagcggccgggcaaagggcucgaauggaugggaaucauucaucccgcugacagcgagacaaaguauuccccuucuuuucagggccaggugagcuucuccgccgauaagucuagcaacacggcguaccugcacugguccacccuucgcgcuagcgacacagccauguauuacugugccagacggucuggcuccagcucuugguaugcucuggauuuuugggggcaaggaaccauggucacaguguccagcgccucuaccaaaggccccuccguuuucccucucgcucccagcuccaagucuacaagcgggggaaccgccgcgcugggcugccuugugaaagacuacuuuccugaaccggucacgguguccuggaauagcggggcccugaccucuggaguucauacauuccccgcugugcuccaguccagcggccuguauucucugagcuccgucgugaccgugccuucuagcucccucggcacacagaccuacaucuguaacgucaaucacaagcccagcaacacgaaaguugauaagcgcguggagccuaagucuugcgacaaaacacauaccugucccccgugcccugcccccgagcugcuugggggaccuuccguguuucuguucccucccaagcccaaagauacacucaugauuagcagaaccccggaagucaccugugugguuguggacgucucucacgaggaucccgaagugaaguuuaauugguacguugacggcguggagguccacaacgcuaaaacaaagccucgggaggaacaguauaauuccacguaccgcguggucagcgugcugaccguucuucaucaagauuggcugaacgggaaagaguauaagugcaagguguccaauaaagcccuccccgcgccuaucgaaaagacaaucucuaaagccaagggacagcccagagagccgcaggucuacacccugccucccagccgggaagagaugaccaaaaaccaggugucccugacaugucucguuaagggcuucuauccuucugacauugcuguggagugggaaagcaaugggcaacccgagaacaauuacaagacgacaccucccguccuggauuccgacggcagcuuuuuccuuuauucuaaacugaccguggacaagucccgcuggcagcagggaaacguguuuagcugcucuguuaugcacgaagcccuccauaaucacuacacccaaaaaucccugagccuuucuccgggcaag

SEQ ID NO: 39086 - RNA, 651 nt, Artificial Sequence
  derived and/or modified sequence opt5 from Tosatoxumab_LightChain1
cagagcgugcugacccaaucccccucugccagcggcacaccugggcagagagucacgaucuccugcucuggaggcagcuccaacauugggucuaauaccguuaacugguaccagcaguucccgggagcugcccccaagcuccugaucuauacaaauaaccaacggccuagcggcgugcccgaccgcuuuuccgggagcaaaucuggaaccuccgcgagccuugcuauuucuggccugcaguccgaggaugaagccgacuacuauugugccacaugggaugacagccucaauggccuguacguguucgggaccggaacaaaggucaccgugcuuggccagccuaaagcuaaccccacgguuacccuguuuccuccgucuuccgaggaacuccaggccaauaaggcuacacuggugugccugaucagcgauuucuaucccggggccgucaccguggcguggaaagccgacggauccccuguuaaggcuggcguggagacaaccaagcccucuaaacaaagcaacaauaaguacgccgcuuccagcuaucucucucugacgccugaacaguggaaaucccacagaagcuacucuugucaggucacacaugaggggagcaccguggagaagacaguggcccccaccgaaugcucc

SEQ ID NO: 39087 - RNA, 1341 nt, Artificial Sequence
  derived and/or modified sequence opt5 from Tositumomab_HeavyChain
caggcuuaccugcaacagagcggcgcugagcucgugagacccggggccuccgucaagaugucuugcaaagcgagcggauauaccuucacauccuacaacaugcacuggguuaagcagacgccucggcagggccuggaauggaucggggcuauuuauccgggaaauggcgacaccucuuacaaccaaaaauuuaaggggaaagccacacuuaccguggauaagagcuccucuacagccuauaugcagcugagcucccucaccagcgaggacucugcuguguacuucugugcccgcgucguguauuacuccaauagcuacugguauuuugauguuuggggaacaggcaccacggugaccgucucuggccccuccguguucccucuggcucccagcucuaaguccacaagcgggggaaccgccgcgcuuggcugccugguuaaagacuacuuuccugaacccgugacagucuccuggaacucuggggcccucaccagcggagugcauacguucccugcugugcugcaguccagcggccuguauucucucuccagcgucguuacagugccgucuagcucccuggggacccagacauacaucuguaaugugaaccacaagcccucuaauaccaaagucgauaagaaagccgagccuaagagcugcgacaagacccauacaugucccccuugccccgcuccggaacuucugggaggcccuuccguguuucucuuucccccuaaacccaaggauacgcugaugauuagcagaacccccgagguuacauguguggucguggacguuucucacgaggauccugaagugaaauuuaacugguaugucgacggcguggagguccauaaugccaagaccaaaccgcgggaagaacaauacaacuccacauaucgcgugguuagcgugcuuaccguccugcaccaggauuggcucaaugggaaggaguacaaaugcaaggugucuaacaaggcgcugcccgccccuaucgagaaaacgauuuccaaggcuaaaggacagcccagagagccucagguuuacacacugcccccgagccgggacgaacucaccaagaaucaagugucccugaccugucuugucaaaggcuucuauccuucugauaucgccguggagugggaaagcaacgggcagcccgagaauaacuacaagacaaccccucccgugcuggacuccgacggaucuuucuuccucuauagcaagcugacaguugauaaaucccgcuggcagcaaggcaacgucuuuagcugcucugugaugcacgaggcccuucauaaucacuacacgcagaagucccugagccucucuccugggaaa

SEQ ID NO: 39088 - RNA, 630 nt, Artificial Sequence
  derived and/or modified sequence opt5 from Tositumomab_LightChain
cagaucgugcugagccaaucccccgccauucucucugcuagcccuggcgagaaggucaccaugacaugcagagccuccucuagcguuuccuacaugcacugguaucagcagaaaccggggucuagccccaagccuuggaucuacgcgcccuccaaccuggcuagcggagugccugcccgguucucuggcuccgggagcggaacgucuuauucccuuaccauuagccgcguggaagccgaggacgcugccacauacuauugucagcaauggucuuuuaaucccccuaccuucggcgcugggacaaaacuggaacucaagagaaccgucgccgcgccguccguguuuaucuuucccccuagcgaugagcagcugaaauccggaacagccucuguugugugccuucugaacaauuucuacccccgggaagcuaagguccaguggaagguggacaacgcccuccagagcggcaauucccaagagagcguuaccgagcaggauucuaaagacuccacguauagccugucuagcacccugacacucuccaaggcugauuacgaaaaacauaagguguacgccugugaggucacccaccagggccugucuagcccugugacaaaauccuucaaccgc

SEQ ID NO: 39089 - RNA, 1338 nt, Artificial Sequence
  derived and/or modified sequence opt5 from Tovetumab_HeavyChain1
caggugcaacuggucgagagcggcgggggacucguuaagcccggcgggucccugagacuuucuugcgccgcuagcggauucaccuuuuccgacuacuauaugaacuggauccggcaggccccuggcaaagggcuggaaugggugucuuacauuagcuccucuggaagcaucauuuauuacgcggauuccgugaagggccgcuucacaaucagcagagacaaugcuaaaaacucucucuaucugcagaugaacucccuucgggccgaggauacggccgucuacuauugugcucgcgaaggcagaauugccgcucgggggauggacguguggggacagggcaccacaguuaccgugagcucugccuccacaaaggggccgagcgucuuuccccuggcgccuugcucucgcuccaccagcgaguccacagccgcucucggaugucuggugaaagauuacuuccccgaaccuguuaccgugucuuggaauagcggcgcccugacguccgggguccacaccuuucccgcugugcuccaaagcucuggacuguacucccuuagcucuguggucacaguuccuagcuccaauuucggcacccagacauauaccugcaacguggaccauaagccgucuaauacgaagguggauaaaacagucgagagaaaguguugcguggagugucccccuugccccgccccucccguugcgggcccgagcguguuucuguucccucccaaaccuaaggacacccucaugaucucccggacacccgaagucaccugugugguuguggaugucagccacgaggaccccgaagugcaguuuaacugguacgucgaugggguggagguucauaaugccaaaaccaagccucgcgaggaacaguucaacucuacauuuagaguggucuccgugcugacgguugugcaccaagacuggcuuaauggaaaggaguauaaaugcaaggucagcaacaaaggccugccggcucccaucgaaaagaccauuucuaaaacaaaggggcagccucgggagccccagguguacacccucccucccucccgcgaagagaugaccaaaaaucaggugagccugacaugucugguuaagggauucuauccguccgauaucgccgucgagugggaaucuaacggccaaccugagaauaacuacaagacgacacccccuaugcucgacagcgacggguccuuuuuccuguauucuaaacuuaccguggauaagagcagauggcagcagggaaacguguucuccugcagcgucaugcaugaagcucugcacaaucacuacacccaaaaaucucucucccugagccccggcaag

SEQ ID NO: 39090 - RNA, 645 nt, Artificial Sequence
  derived and/or modified sequence opt5 from Tovetumab_LightChain1
gacauccagaugacgcaaagccccuccucucugagcgccuccgugggcgauagagucucuauuacaugccggccuagccaguccuucucucgcuacaucaacugguaucagcagaagccggggaaagcucccaagcuccugauucacgccgcgagcucccuuguuggaggcgugccuagcagauuuucuggguccggaagcggcacggacuucacccugacaaucucuucccuccaacccgaggauuuugcuaccuacuauugucagcagacauacagcaauccucccauuaccuucgggcagggaacacggcuggaaaugaaacgcaccguggccgccccuucugucuuuaucuucccgcccuccgacgagcaacuuaagagcggcacggcuuccgugguuugccugcucaacaauuuuuauccuagagaagccaaagugcaguggaaggucgauaacgcucugcagucuggcaauagccaggaguccgugaccgaacaagacagcaaggauucuacauacucccugagcucuacccucacacugagcaaagccgacuaugagaagcauaaaguuuacgcgugugaggugacccaccaggggcuuuccucucccgucaccaagagcuucaaccggggagaaugc

SEQ ID NO: 39091 - RNA, 1347 nt, Artificial Sequence
  derived and/or modified sequence opt5 from Tralokinumab_HeavyChain1
caggugcaacugguccagagcggcgccgagguuaagaaacccggggcuuccgugaaggugucuugcaaagccagcggauacaccuucacaaacuauggccucuccugggucagacaggcgccugggcagggacuggaauggaugggcuggaucucugcuaauaacggggacacgaauuacggacaagaguuucagggccgggugaccaugacaaccgauacaagcaccuccacagccuauauggaacuucgcucucugagaagcgacgauaccgccguuuacuauugugcucgggacuccucuucuuccugggcccgcugguucuuugaucucuggggcagagggacgcuggugaccgucagcucugcuuccacaaagggaccgagcguguucccccuugccccuugcucucgguccaccagcgaguccacagcggcccugggcugucucguuaaagacuacuuucccgaaccugugaccgucucuuggaacagcggggcucugacguccggagugcacacauuccccgccgugcugcagagcucuggccucuauucccugagcucugucguuaccgugccuagcuccucucuugggacaaagaccuauaccugcaauguggaucauaagccgagcaacacaaaagucgacaagcgcguggaguccaaauacggacccccuugucccagcugcccugcucccgaguuucugggcggcccgucuguuuuccucuuuccucccaagccuaaagauacgcugaugauuuccagaacccccgaagugacaugugucgugguugacgugagccaggaggaucccgaaguccaauucaauugguacguggacggggucgaggugcacaacgccaagaccaagccucgggaggaacaguuuaauucuacauaccgcguuguguccguccuuaccgugcugcaucaggauuggcucaacggaaaagaguauaagugcaaaguuagcaauaagggccugccguccucuaucgagaaaacgauuagcaaggcgaaagggcagcccagagaaccucaaguguacacacugcccccuucccaggaagagaugaccaagaaccaggucucucucaccugucuggugaagggauucuaucccagcgacaucgccguggagugggaauccaauggccaaccggagaacaauuacaaaacaaccccucccguucuugacagcgaugggagcuuuuuccuguauucccggcucacagucgacaagagccgcuggcaggaaggaaacguguucucuugcuccgugaugcacgaggcucugcauaaccacuacacgcagaaaagccuuucucugagccucggcaag

SEQ ID NO: 39092 - RNA, 642 nt, Artificial Sequence
  derived and/or modified sequence opt5 from Tralokinumab_LightChain1
agcuacgugcugacccagcccccuuccgucucuguugccccgggcaagacagcuagaaucacgugcgggggaaacauuaucggcagcaaacucgugcacugguaucaacagaagcccgggcaggccccugugcuggucauuuacgacgauggagaccggcccuccggcaucccugagcgcuucucugggagcaauuccggaaacaccgcgacacuuaccauuucuagaguggaagcuggcgaugaggccgacuauuacugucagguuugggauacaggcagcgaccccguggucuuugggggaggcaccaaacugacagugcucgggcaaccuaaggccgcuccguccguuacccuguuucccccuagcucugaggaacuucaggccaauaaagcuacgcuggugugccucaucuccgauuucuaucccggagccgucaccguggcguggaaggccgacagcucuccugugaaggcuggcgucgaaacaaccacacccuccaaacagagcaacaauaaguacgccgcuucuuccuaucugagccugaccccggagcaguggaaaucccaucggucuuacagcugucaaguuacgcacgagggguccacaguggaaaagaccguggccccuacagagugcagc

SEQ ID NO: 39093 - RNA, 1332 nt, Artificial Sequence
  derived and/or modified sequence opt5 from Trastuzuab_HeavyChain1
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaauagccugcgcgcugaagauacagccguguauuacuguucuagauggggcggggacggauucuaugcugauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccuaagucuugcgacaaaacacauaccugucccccuugccccgccccggagcuccugggcgggccuagcguguuccuuuuucccccuaagcccaaggauacccugauuucccggacacccgagguuacguguguggucguggacguuucucacgaagauccugaggugaaauucaacugguaugucgacggaguggaaguccauaaugcgaagaccaaaccgcgcgaggagcaguacaacagcacauauagagugguuuccgugcucaccguccugcaccaggauuggcugaauggcaaggaauacaaaugcaaggugagcaacaaagcccuccccgcuccuaucgagaagacaaucucuaaggccaaagggcaaccccgggaaccucagguuuauacccugcccccgucccgcgaggaaacgaagaaucaggugagccuuacaugucuggucaaaggauuuuacccuucugacauugcuguggagugggaguccaacggccagcccgaaaauaacuacaagaccaccccucccgugcucgacagcgauggcuccuucuuucuguauucuaaacuuacaguugacaagagcagauggcaacaggggaacgucuucuccugcucugugcacgaggcccugcauaaucacuacacccaaaagagccucucccugagcccugga

SEQ ID NO: 39094 - RNA, 639 nt, Artificial Sequence
  derived and/or modified sequence opt5 from Trastuzuab_LightChain1
gacauccagacccaaagccccuccucucugagcgccuccgugggcgauagagucacaauuacgugccgggcuucucaggacguuaacaccgccguggcgugguaccagcagaaaccugggaaagcuccgaagcuccugaucuauagcgccuccuuccuuuacucuggagugcccagccgcuuuuccggcagcagaucugggacagauuucacccugacaauuuccagccuccaaccugaggacuuugccaccuauuacugucagcagcacuauacaacgcccccuaccuucggacagggcaccaaagucgaaaucaagcggacaguggcugcccccucuguuuuuauuuucccuccguccgaugagcaacugaaaagcgggaccgcuucuguggucugccuucugaauaacuuuuacccccgcgaagccaaggugcaguggaagguugacaaugcgcuccaguccggaaacagccaggaguccgugacagaacaagauucuaaagacagcaccuauucccugagcucuacgcugacacucuccaaggccgauuacgagaaacauaaggucuacgcuugugaggugacccaccagggccugagcucuccugugacaaagagcuucaauagaggcgaaugc

SEQ ID NO: 39095 - RNA, 1347 nt, Artificial Sequence
  derived and/or modified sequence opt5 from Trastuzumab_emtansine_HeavyChain1
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccuaagucuugcgacaaaacacauaccugucccccuugccccgccccggagcuccugggcgggccuagcguguuccuuuuucccccuaagcccaaggauacccugaugauuucccggacacccgagguuacguguguggucguggacguuucucacgaagauccugaggugaaauucaacugguaugucgacggaguggaaguccauaaugcgaagaccaaaccgcgcgaggagcaguacaacagcacauauagagugguuuccgugcucaccguccugcaccaggauuggcugaauggcaaggaauacaaaugcaaggugagcaacaaagcccuccccgcuccuaucgagaagacaaucucuaaggccaaagggcaaccccgggaaccucagguuuauacccugcccccgucccgcgaggaaaugacgaagaaucaggugagccuuacaugucuggucaaaggauuuuacccuucugacauugcuguggagugggaguccaacggccagcccgaaaauaacuacaagaccaccccucccgugcucgacagcgauggcuccuucuuucuguauucuaaacuuacaguugacaagagcagauggcaacaggggaacgucuucuccugcucugugaugcacgaggcccugcauaaucacuacacccaaaagagccucucccugagcccugga

SEQ ID NO: 39096 - RNA, 642 nt, Artificial Sequence; identical to SEQ ID NO: 38952
  derived and/or modified sequence opt5 from Trastuzumab_emtansine_LightChain1

SEQ ID NO: 39097 - RNA, 1347 nt, Artificial Sequence; identical to SEQ ID NO: 39095
  derived and/or modified sequence opt5 from Trastuzumab_HeavyChain1

SEQ ID NO: 39098 - RNA, 1353 nt, Artificial Sequence
  derived and/or modified sequence opt5 from Trastuzumab_HeavyChain
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccucccaagucuugcgacaaaacacauaccuguccucccugcccggccccugagcuccugggcgggcccagcguguuccuuuuuccucccaagcccaaggauacccugaugauuucccggacaccugagguuacguguguggucguggacguuucucacgaagauccggaggugaaauucaacugguaugucgacggaguggaaguccauaaugcgaagaccaaaccccgcgaggagcaguacaacagcacauauagagugguuuccgugcucaccguccugcaccaggauuggcugaauggcaaggaauacaaaugcaaggugagcaacaaagcccucccugcucccaucgagaagacaaucucuaaggccaaagggcaaccucgggaaccccagguuuauacccugccgccuucccgcgacgagcuuacgaagaaucaggugagccugacaugucucgucaaaggauuuuaccccucugacauugcuguggaaugggaguccaacggccagccugagaauaacuacaagaccacacccccugugcuggauagcgacggcuccuucuuucuuuauucuaaacugaccguugauaagagcagauggcaacaggggaacgucuucuccugcucugugaugcacgaagcccuccauaaucacuacacccaaaagagccugucccugagccccggaaaa

SEQ ID NO: 39099 - RNA, 660 nt, Artificial Sequence
  derived and/or modified sequence opt5 from Trastuzumab_HeavyChain_variant_1n8z_B
gaggugcagcuggucgaaagcggcgggggacucguucaacccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccu

SEQ ID NO: 39100 - RNA, 45 nt, Artificial Sequence
  derived and/or modified sequence opt5 from Trastuzumab_HeavyChain_variant_7637_H
gagcccaagagcugcgacaaaacccacacauguccuccgugcccc

SEQ ID NO: 39101 - RNA, 642 nt, Artificial Sequence; identical to SEQ ID NO: 38952
  derived and/or modified sequence opt5 from Trastuzumab_LightChain1

SEQ ID NO: 39102 - RNA, 642 nt, Artificial Sequence; identical to SEQ ID NO: 38952
  derived and/or modified sequence opt5 from Trastuzumab_LightChain_variant_1n8z_A

SEQ ID NO: 39103 - RNA, 642 nt, Artificial Sequence; identical to SEQ ID NO: 38952
  derived and/or modified sequence opt5 from Trastuzumab_LightChain_variant_7637_L

SEQ ID NO: 39104 - RNA, 1344 nt, Artificial Sequence
  derived and/or modified sequence opt5 from TRC-105_HeavyChain1
gaggugaagcuggaagagagcggcgggggacucguccagcccggcggguccaugaaacugucuugcgccgcuagcggauucaccuuuuccgacgccuggauggauuggguuagacaaucuccugaaaagggccuugaguggguggcggaaauccggagcaaggcuuccaaccacgccacauacuaugccgagucugugaaggggcgcuucacgauuagcagagacgauuccaaaagcucugucuaccugcagaugaauagccuccgggcugaggacaccggaaucuauuacuguacacgcuggagacgguuuuucgauuccuggggccagggcaccacacugaccgugucuuccgccagcacaaaggggccgucuguuuuuccccuugcuccuuccagcaaguccaccucuggaggcacggccgcgcuggggugccucgugaaagacuauuuccccgaaccugucaccgugagcuggaacuccggagcccugacaagcggcguucauaccuuucccgcugugcugcagucuuccgggcucuacagccugucuagcgucgugacagugccuuccucuagccuuggaacccaaacguauauuuguaaugucaaccacaagccguccaauacaaaaguugauaagaaaguggagcccaagagcugcgacaagacccauacauguccucccugcccugcccccgaacugcucggcggcccgucuguguuccuguuuccucccaaaccuaaggauacccuuaugaucucccgcacccccgaggucacaugugugguuguggacgucagccacgaggaucccgaagugaaauucaacugguacguugacgggguggagguccauaaugcuaagacgaaaccuagagaggaacaguacaacucuaccuaucggguggucuccgugcugacaguucuccaccaggauuggcugaauggaaaggaauacaaaugcaaggugagcaacaaggcccugccggcgcccauugagaaaaccaucuccaaggccaaaggccagccucgcgagccccaagucuauacacucccucccucuagagacgaacugaccaagaaucaggugagccuuacgugucugguuaaaggguuuuacccguccgacaucgcuguggagugggaaucuaacggacagccugagaauaacuauaagacaacacccccuguccucgauagcgacggcuccuucuuucuguacagcaaacuuaccguggauaaaucucgguggcagcaagggaauguguucuccugcagcguuaugcacgaagcccugcauaaccacuauacccagaagucucucucccugagccccggaaaa

SEQ ID NO: 39105 - RNA, 639 nt, Artificial Sequence
  derived and/or modified sequence opt5 from TRC-105_LightChain1
cagaucgugcugagccaaucccccgccauucucucugcuagcccuggcgagaaagucaccaugacaugcagagccuccucuagcguuuccuacaugcacugguaucagcagaaaccggggucuagccccaagccuuggaucuacgcgacguccaaccuggcuagcggagugcccgugcgguucucuggcuccgggagcggaaccucuuauucccuuacaauuagccgcgucgaagccgaggacgccgcuaccuacuauugucagcaauggucuuccaauccucugacauuuggcgccgggaccaaacucgaacugaagagaacaguggcugcccccagcguuuucaucuuuccuccguccgaugagcagcuuaaaucuggaaccgcgagcguggucugccugcucaacaauuucuacccccgggaagccaaggugcaguggaagguugacaacgcucugcaguccggcaauagccaagagucugugacggagcaggauuccaaagacagcaccuauucucugagcuccacacucacccugucuaaggccgauuacgaaaaacauaaggucuacgcuugugaggugacacaccagggccuuagcuccccugugaccaagagcuuuaaccgcggggaaugc

SEQ ID NO: 39106 - RNA, 1362 nt, Artificial Sequence
  derived and/or modified sequence opt5 from Tregalizumab_HeavyChain1
gaggaacagcugguggagagcggcgggggacucgucaagcccggcgggucccugagacuuucuugcgccgcuagcggauucuccuuuucugacugucggauguacuggcugcgccaagccccuggcaaagggcucgaauggaucggaguuauuagcgugaaguccgagaacuauggcgcgaauuacgcugaaucugugagaggccgguucaccaucagccgcgaugacuccaaaaacacagucuaucugcagaugaauagccuuaagacggaggauaccgccguguacuauugcucugccuccuacuauagauacgacguuggggcuugguuugccuacuggggacagggcacacuggugaccgucagcucugcuuccacaaaagggccgagcguguucccccucgccccuucuuccaagagcaccuccggaggcacagcggcccuggggugucugguuaaggauuauuuucccgagccugugaccgucucuuggaacagcggagcucucacguccggcgugcacaccuuccccgccgugcugcagagcucuggccuuuacucccugagcucugucguuacagugccuagcuccucucucgggacccaaacauauauuugcaaugugaaccauaaaccgagcaauaccaaggucgacaaaaagguggaacccaaauccugugauaagacgcacacaugcccucccuguccugcucccgagcugcuuggaggcccgagcguuuuucuguucccucccaagccuaaagacacccucaugaucucucggacacccgaagugaccugcgucgugguugaugugucccaugaggaccccgaggucaaguuuaacugguacguggauggggucgaagugcacaaugccaaaaccaagccucgcgaggaacaguauaacagcacauacagaguugugucuguccugacggugcugcaucaggacuggcucaauggaaaagaguauaaguguaaaguuuccaacaaggcgcugccggcccccauugaaaagaccaucagcaaagcuaagggccagccucgggagccccaaguguacacacuuccucccucccgcgaugagcugaccaaaaaucaggucucucucacaugccuggugaagggguucuacccgagcgacaucgccguggaaugggaguccaacggacagccugaaaauaacuauaaaaccacgcccccuguucuugacucugauggcagcuuuuuccuguacuccaagcucacagucgacaagagcagauggcagcaaggcaacguguuuucuuguuccgugaugcacgaggcucugcacaaucauuauacccagaaaagccugucucucucccccgggaag

SEQ ID NO: 39107 - RNA, 654 nt, Artificial Sequence
  derived and/or modified sequence opt5 from Tregalizumab_LightChain1
gacaucgugaugacccagagccccgauucccuggccgucucucucggcgagagagcuacaauuaacugccgggccagcaaguccguuucuacgagcggguacuccuauaucuacugguaucaacagaaaccuggacagccgcccaagcugcuuauuuaccuggcgucuauccucgaaagcggcgugccugaccgcuucuccgggagcggaucuggcaccgauuuuacacugaccauuuccagccuucaggcugaggacguggccgucuauuacugucaacacucuagagaacugcccuggacauucgggcagggaaccaaaguggagaucaagcggacaguugccgcuccuuccguguuuaucuuucccccuagcgaugaacagcucaaaucuggcaccgccuccgucgugugccugcugaauaacuucuauccgcgcgaggcuaagguucaguggaagguggacaaugcccuccaaagcggcaacucccaggagucugucacggaacaggauagcaaagacuccaccuacagccugucuuccacacuuacccugagcaaggcggauuacgagaaacauaagguguaugccugugaagugacacaccaggggcucucuagccccgucaccaaauccuucaauagaggagagugc

SEQ ID NO: 39108 - RNA, 1353 nt, Artificial Sequence
  derived and/or modified sequence opt5 from Tremelimumab_HeavyChain1
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucugguaugacggaagcaacaaauacuaugcugauuccguuaagggcagauucacaauuucucgggacaauagcaaaaacacgcuguaccuccagaugaacucccugcgcgccgaggauaccgccguguauuacugugcuagagacccgcggggcgccacacuuuauuacuacuauuacgggauggaugucuggggacaaggcaccacagugaccguuagcucugcuuccacaaaggggcccagcguguuuccucuggcccccugcucucgcuccaccagcgaaucuacggcggcccucggaugucuggucaaagacuauuucccugagcccgugaccguguccuggaauagcggcgcucugacauccgggguccauaccuuuccugccguucuccagucuagcggacuguacucccuuagcucuguggugacagucccguccagcaauuucggcacccagacguauacaugcaacguggaucacaagcccucuaauaccaagguugacaaaacaguggaaagaaaguguugcgucgaguguccucccugcccugcucccccgguggccggcccuagcguuuuucuguuucccccuaaacccaaggauacccucaugaucucccggacccccgaggugacaugugucguggucgacgugucucaugaagauccugagguucaguucaacugguacguggacggggucgaagugcacaaugcgaaaacgaagccgcgcgaggagcaauucaacagcaccuuuagaguuguguccguccugacaguggugcaucaggauuggcuuaauggaaaggaauauaaaugcaagguuagcaacaaaggccugcccgccccuauugagaagaccaucucuaaaacaaaggggcagccccgggaaccucaggucuacacccugcccccgucccgcgaggaaaugacgaaaaaucaagugagccucacaugucuggugaagggauucuacccuucugacauugcugucgagugggaguccaacggccagcccgaaaauaacuauaagaccaccccucccaugcucgacagcgauggguccuuuuuccuguacucuaaacuuacaguggacaagagcagauggcagcaaggaaacguuuucuccugcucugugaugcacgaggcccugcacaaucauuauacccagaaaagccucucccugagcccuggcaag

SEQ ID NO: 39109 - RNA, 642 nt, Artificial Sequence
  derived and/or modified sequence opt5 from Tremelimumab_LightChain1
gacauccagaugacccaaagccccuccucucugagcgccuccgugggcgauagagucacaauuacgugccgggcuucucagagcaucaacuccuaccucgacugguaucagcagaaaccugggaaagccccgaagcugcuuauuuacgcggcuucuagccugcaauccggaguucccagccgcuucucuggcuccgggagcggaaccgauuuuacacucaccaucucuucccugcagccugaggacuucgccacauauuacugucagcaguauuacagcacccccuuuacauucggcccugggaccaaaguggaaauuaagagaacgguggccgcucccucugucuuuaucuucccuccguccgaugagcaacuuaaaagcggaaccgccuccgugguuugccugcucaauaacuuuuauccccgggaagcuaaggugcaguggaaggucgacaaugcccugcagucuggcaacagccaggaguccgugacagaacaagauagcaaagacucuaccuacucccugagcucuacacucacccugagcaaggcggauuacgagaaacacaagguuuaugccugugaggugacgcaucagggccuuuccucuccugucacaaagagcuucaaucgcggggaaugc

SEQ ID NO: 39110 - RNA, 1341 nt, Artificial Sequence
  derived and/or modified sequence opt5 from Trevogrumab_HeavyChain1
gaggugcagguccuggaaagcggcggggaccucguucaacccggaggcucccugagacuuucuugcgccgcuagcggguucaccuuuuccgccuacgcgaugacaugggugcggcaggcuccuggaaagggccuggagugggugucugccaucagcggguccggaggcucugccuauuacgcugauagcgucaaaggccgcuucacgauuuccagagacaacagcaagaauaccguguaucuccagaugaacucucugcgggccgaagauacagcuguuuacuauugugccaaagacggggcguggaagauguccggacuugauguguggggccaggggaccacagucaucgugagcucugccuccaccaaaggaccgagcguuuuuccccuggcuccuugcucucgcuccacaagcgaguccaccgccgcucucggcugucuggugaaggacuacuuccccgaaccugucacggugucuuggaauagcggggcccugaccuccggagugcacacauuucccgcgguccuccaaagcucuggccuguauucccuuagcucuguugugaccgugccuagcuccucucugggcacaaagaccuacacgugcaacgucgaucauaaaccgagcaauacaaagguggacaaaagaguugaguccaaguacgggcccccuugucccccuugccccgccccggaguuccucggaggcccuagcguguuucuguuucccccuaaacccaaggauacccuuaugauuucucggacacccgaagucaccugugugguuguggacgucucccaggaggauccugaagugcaguucaacugguaugucgacgggguggagguucacaaugcuaagaccaaaccgcgcgaggaacaguucaacagcacauacagaguggucucugugcugacgguucuccaucaagauuggcugaauggaaaggaguauaaaugcaagguguccaacaaaggccugcccagcuccaucgaaaagaccauuucuaaagccaaggggcagccucgggagccccaggucuacacacucccucccagccaggaagagaugaccaagaaucaagugucccugacaugucuugugaaaggauuuuauccgucugacaucgcuguugagugggaaagcaacggccagccugagaauaacuacaagaccacgcccccuguccuggacuccgauggcagcuucuuucucuauucucgccugacaguggacaaauccagauggcaggaagggaauguguucagcugcucugucaugcacgaggcccuucauaaccacuacacccaaaagucccugagccucucucugggaaaa

SEQ ID NO: 39111 - RNA, 642 nt, Artificial Sequence
  derived and/or modified sequence opt5 from Trevogrumab_LightChain1
gacauccagaugacccaaagccccgccucccugucugcuagcgugggcgauagagucacaauuacgugccgggccucccaggacaucucugauuaccucgcgugguaucagcagaagccugggaaaauuccgcgccugcuuaucuacaccacaagcacccugcaauccggaguucccucuagauuccggggcagcggguccggaacagacuuuacccucacaauuagcucucugcagccugaggauguggcuaccuauuacugucagaaguaugacuccgcuccccuuacguucggcgggggaaccaaaguggaaaucaagcgcacagucgccgccccuagcguguuuaucuuucccccuucugaugagcagcugaaauccggcaccgccagcguugugugccuccugaacaauuucuacccgagagaagcuaagguccaauggaagguggacaacgcccugcagucuggcaauucccaggagagcguuacagaacaggauuccaaagacucuaccuauagccucuccagcacgcugacacuuucuaaggcggauuacgagaaacacaagguguacgccugugaggucacccaucaagggcuguccagccccgugacaaaaucuuucaaccggggagaaugc

SEQ ID NO: 39112 - RNA, 1737 nt, Artificial Sequence
  derived and/or modified sequence opt5 from Tucotuzumab_celmoleukin_HeavyChain1
cagauccaacuggugcagagcggcgccgaagucaagaaacccggggaaaccguuaagauuuccugcaaagcuagcggauacacauucacgaacuauggcaugaauugggugaagcagaccccugggaaaggacucaaguggaugggcuggaucaacacauacaccggggagccgacauaugccgacgauuuuaagggaagauucgcguuuagccuggaaaccuccacaucuaccgcuuuccuucagauuaauaaccugcggagcgaggacacggccaccuacuuuugugugcgcuucaucuccaaaggcgauuauuggggccaagggacaucugucaccgugagcuccgccagcacaaagggacccucuguuuuuccucucgcucccuccagcaaaucuaccuccggcgggacggccgcucugggaugccuugugaaggacuacuucccugaacccgucacagugagcuggaacucuggcgcccugaccuccgggguucacacauuuccugcggugcuccagagcuccggacuguauucucugagcuccgucgugaccgugccgucuucuucccucggcacccagacauacauuuguaaugucaaucacaaacccagcaacacgaagguugauaagagaguggagccuaaaucuugcgacaagacccacacaugucccccuugccccgccccggagcugcuuggcgggccuagcguguuccuguuucccccuaaacccaaggauacccucaugaucucccggacacccgaagucaccugugugguuguggacgucucucaugaggauccugaagugaaauucaauugguacguugacggaguggagguccacaacgcuaagacgaaaccgcgcgaggaacaguauaauagcacauacagaguggucuccgugcugaccguucuucaucaagauuggcugaacggcaaggaguauaagugcaaagugagcaauaaggcccuccccgcuccuaucgagaaaaccauuucuaaggccaaagggcagccccgggaaccucaggucuacacacugcccccgucccgcgaagagaugaccaagaaccaggugagccugacaugucucguuaagggauuuuauccuucugacaucgcgguggagugggaauccaauggccaacccgagaacaacuacaaaacgaccccucccguccuggauagcgacggguccuucuuccuuuauucuaagcugacaguggacaaaagcagauggcagcagggaaauguguuuuccugcucuguuaugcacgaagcccuccacaaccauuacacccaaaagagccugucccuuagcccuggcaaagcucccacaucuuccagcaccaagaagacgcagcugcagcucgagcaucugcugcucgaucugcagaugauucuuaauggcaucaacaauuacaaaaacccgaagcugacccggaugcucacauucaaauuuuauaugccuaagaaagccaccgaacugaagcaccuucaaugucuggaggaggaacucaagccccuggaggaaguccugaaucucgcucagucuaaaaacuuccaucugcgccccagagaccuuauuuccaauaucaacgugauugugcuggagcucaaggggagcgaaacaaccuuuaugugcgaguacgccgaugagacggccacaaucgucgaguuccugaaucgguggaucaccuuuugccagucuauuaucagcacacugacc

SEQ ID NO: 39113 - RNA, 639 nt, Artificial Sequence
  derived and/or modified sequence opt5 from Tucotuzumab_celmoleukin_LightChain1
gagaucgugcugacgcagagccccgccacacucucccugucuccuggcgaaagagucacgcuuaccugcagcgcuuccucuagcguuuccuacaugcugugguaucaacagaagccggggucuagccccaaaccuuggauuuucgacacauccaaccucgccagcggauuucccgcgcgguucucuggcuccgggagcggaaccucuuacucccugaucauuagcucuauggaggcugaagaugccgccacauauuacugucaccagcgcuccggcuauccuuacaccuuugggggaggcacaaaacuugagaucaagagaaccguggcugcccccagcguguucauuuuuccuccguccgacgaacagcugaagucuggcacggcuagcgucgugugccuccugaauaacuucuauccccgggaggccaaaguucaauggaagguggauaaugcgcugcaguccgggaacagccaggagucugucaccgaacaggacuccaaggauagcacauacucucucagcuccacccugacacuuucuaaagccgacuacgagaagcauaaaguguaugcuugugaaguuacccaccaaggacugagcuccccugugaccaagagcuuuaaucgcggcgagugc

SEQ ID NO: 39114 - RNA, 1344 nt, Artificial Sequence
  derived and/or modified sequence opt5 from Ublituximab_HeavyChain1
caggcuuaccugcaacagagcggcgcugagcucgugagacccggggccuccgucaagaugucuugcaaagcgagcggauauaccuucacauccuacaacaugcacuggguuaagcagacgccucggcagggccuggaauggaucgggggaauuuauccgggcaauggggacaccucuuacaaccaaaaauuuaagggaaaagcuacacuuaccgugggcaagagcuccucuacagccuauaugcagcugagcucccucaccagcgaggauucugccguguacuucugugcucgcuaugacuacaauuacgccauggauuauuggggccaggggacauccgucaccgugagcucugcuuccacgaagggacccagcguuuuuccucuggcccccucuuccaaaagcaccuccggcgggacagcggcccuuggaugccuggugaaggacuacuucccugaacccgucaccgugucuuggaacagcggcgcucucacauccgggguucauaccuuuccugccgugcugcagagcucuggacuguauucccucagcucugucgugacggugccgagcuccucucugggcacacaaaccuacaucuguaaugucaaccacaaacccagcaauacaaagguugauaaaaagguggagccuaaguccugcgacaaaacccauaccugucccccuugccccgcuccggaacuucugggcgggccuagcguguuccucuuucccccuaagcccaaagauacacugaugauuucuagaacgcccgaggucaccugugugguuguggacgucucccacgaggauccugaagugaaguucaacugguauguugacggaguggagguccauaaugccaaaacaaagccgcgggaggaacaguacaacagcaccuaucgcguggucucugugcuuacaguucugcaccaggauuggcucaauggcaaagaguacaagugcaagguguccaacaaagcgcugcccgccccuaucgaaaagaccauuagcaaagcuaaggggcagcccagagagccucaagucuacacgcugcccccgucccgggacgaacucaccaaaaaucaggugucucugacaugucuuguuaagggauuuuauccuagcgauaucgccguggagugggaauccaacggccagcccgagaauaacuacaagaccacaccucccguccuggacucugacgggagcuucuuucucuauuccaaacugaccguggauaagagccgcuggcaacagggaaacguguucucuugcuccguuaugcacgaggcccuucauaaucacuacacacagaaaagccugucucucuccccuggcaag

SEQ ID NO: 39115 - RNA, 639 nt, Artificial Sequence
  derived and/or modified sequence opt5 from Ublituximab_LightChain1
cagaucgugcugagccaaucccccgccauucucucugcuagcccuggcgagaaggucacgaugacaugcagagccuccucuagcguuuccuacaugcacugguaucagcagaaaccggggucuagccccaagccuuggaucuacgcgacguccaaccuggcuagcggagugcccgcccgguucucuggcuccgggagcggaaccucuuauuccuuuacaauuagccgcguggaagccgaggacgcugccaccuacuauugucagcaauggacauucaauccucccaccuuuggcgggggaacaagacuugaaaucaaacggaccgucgcugccccuucuguguucauuuuuccgcccuccgaugagcagcuuaagagcggcacggcguccguugugugccuccugaacaauuucuacccucgcgaagccaaaguccaguggaagguggacaacgcucugcagucuggcaauagccaagaguccguuaccgagcaggauagcaaggacucuacauauucccugagcucuacccucacacugagcaaagccgauuacgaaaagcauaaaguguacgcuugugaggucacccaccaggggcuguccucucccgugaccaagagcuuuaacagaggagaaugc

SEQ ID NO: 39116 - RNA, 1353 nt, Artificial Sequence
  derived and/or modified sequence opt5 from Ulocuplumab_HeavyChain1
gaggugcagcuggucgaaagcggcgggggacucguucaacccggcgggucccugagacuuucuugcgccgcugccggauucaccuuuagcuccuacucuaugaacugggugcggcaggcgccuggcaaggggcuggagugggugagcuauaucuccucucgcagcagaacaauuuacuaugcugacuccgucaaaggacgguucacgaucagccgcgauaaugccaagaacucucucuaccugcagaugaacucccuuagagacgaagauaccgccguguauuacugugcucgggacuauggcggccagccgcccuacuacuauuacuaugggauggauguuuggggacaaggcacaaccgugacagucagcucugccuccaccaaagggccuagcguguuuccccuggcuccuugcucucgcuccacaagcgaguccaccgccgcgcucggaugucugguuaaggacuacuuccccgaaccugugacggucucuuggaauagcggcgcccugaccuccggggugcacacauuuccggcugugcuccagagcucuggacuguauucccuuagcucugucguuaccgugcccagcuccucucugggcacaaaaaccuacacgugcaauguggaucauaagccuagcaacacaaaggucgacaaaagaguggaguccaaguaugggcccccuugucccccgugcccugcccccgaguuccucggcggaccuagcguuuuucuguucccucccaaacccaaggauacccuuaugauuucucggacaccggaagugaccugugucgugguugacgugucccaggaggaucccgaaguccaguuuaauugguacguggacggcgucgaggugcacaacgcuaaaaccaagccucgcgaggaacaauucaauagcacauacagaguugugucuguccugacggugcuccaucaggauuggcugaacgggaaggaguauaaaugcaagguuuccaauaaaggacugcccagcuccaucgaaaagaccauuucuaaagccaagggccagccucgggagccccagguguacacacucccgccuagccaagaagagaugaccaaaaaccaggucucccugacaugucuugugaagggguuuuaucccucugacaucgcgguggagugggaaagcaauggacagccugagaacaauuacaagaccacgcccccuguucuggacuccgauggcagcuucuuucucuauucucgccugacagucgacaaauccagauggcaagaaggcaacguguucagcugcucugugaugcacgaggcccuucauaaccacuacacccagaagucccugagccucucucugggg

SEQ ID NO: 39117 - RNA, 642 nt, Artificial Sequence
  derived and/or modified sequence opt5 from Ulocuplumab_LightChain1
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgugacauacuauugucagcaguacaacucuuaucccagaaccuuuggccaagggacaaaaguggagauuaagcggaccgucgccgcuccuuccguguucaucuuucccccuagcgacgaacagcugaaauccggaacggccucuguugugugccuucugaauaacuucuacccgcgcgaggcuaagguccaguggaagguggauaaugcccuccagagcggcaacucccaagaaagcguuaccgagcaggacucuaaagauuccacauauagccugucuagcacccugacacucuccaaggcggacuacgagaaacacaagguguacgccugugaagucacccaucagggccugucuagccccgugacgaaauccuuuaauagaggggagugc

SEQ ID NO: 39118 - RNA, 1344 nt, Artificial Sequence
  derived and/or modified sequence opt5 from Urelumab_HeavyChain1
caggugcaacugcagcaguggggcgccgggcuccugaagcccagcgagacccuuucccugacaugcgcugucuacggaggcucuuucagcggguauuacugguccuggaucagacagucuccugaaaaaggacucgaguggauuggcgaaaucaaccacgggggauauguuacguacaauccgagccuggagucccgggugaccauuucuguggacacaagcaagaaccaauuuucccuuaaacugagcucugucaccgccgcggauacagcuguguauuacugugcccgcgacuauggccccggcaauuacgauugguacuucgaccucugggggagaggaacccugguuacaguguccagcgccucuaccaagggcccuuccgucuuuccccuggcuccuugcagccggucuacguccgaaagcaccgccgcucucgggugucuggugaaagauuauuuccccgagccuguuacaguguccuggaacucuggagcccuuaccagcggcguccauacauuuccggcggugcugcaguccagcgggcucuacucucuguccagcguggucaccguucccucuagcucccuuggaacgaagacauauaccugcaauguggaccacaagccuucuaacacaaaaguggauaagcgcgucgagagcaaauacgggcccccuugucccccgugcccugcccccgaguuccugggcggcccuuccguguuucucuucccucccaagcccaaagacacccugaugaucagcagaaccccggagguuacauguguggucguggauguuucucaggaagaccccgaggugcaguuuaauugguaugucgauggaguggagguccauaacgcuaagacgaagccucgggaagaacaauucaauuccaccuaccgcgugguuagcgugcugacaguccuccaccaggacuggcugaacggcaaagaauauaagugcaaagugucuaauaaggggcuucccuccagcauugagaaaaccaucuccaaggccaaaggacagccuagagaaccccagguuuacacacugccgccuucucaagaggagaugaccaagaaccaggugagccucacgugucuggucaagggcuuuuaccccuccgauaucgcuguggaaugggagucuaaugggcagccugaaaacaauuauaaaacaacacccccugugcuugacagcgacggauccuucuuucuguacagccggcucaccguugauaagucucgcuggcaagagggcaacgucuucuccugcagcgugaugcaugaagcccugcacaaccacuauacccagaaaucucugucccucagccugggcaag

SEQ ID NO: 39119 - RNA, 648 nt, Artificial Sequence
  derived and/or modified sequence opt5 from Urelumab_LightChain1
gagaucgugcugacccagagccccgccacacucagccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagcaauuggccucccgcucucaccuuuugcggcgggacaaaaguggagaucaagagaaccguggccgcgccuucugucuucauuuuuccgcccuccgaugaacagcugaaaagcggaacggccucugugguuugucugcucaacaauuucuauccucgggaggcuaaggugcaguggaaagucgacaacgcccugcaauccggcaauagccaggaguccgugaccgaacaggauucuaaggacagcacauacucccuuagcucuacccugacacucuccaaggcugauuaugagaaacacaagguuuacgccugcgaagugacccaucagggccugagcucucccgucacgaaauccuuuaaccgcggggagugu

SEQ ID NO: 39120 - RNA, 1347 nt, Artificial Sequence
  derived and/or modified sequence opt5 from Urtoxazumab_HeavyChain1
gaggugcagcuggucgaaagcggcgggggacucguucaacccggcgggucccugagacuuucuugcgccgcuagcggauucaccuuuuccucuuacggcaugagcugggugcggcaggccccugggaagggacuggaguggguggcgacaaucuccacgggcggcucuuauaccuacuauccggacagcgucaaagggcgcuucacaauuuccagagauaacgcuaagaauacccucuaccugcagaugaacagccuucgggccgaagacacagccguguauuacugugcucgcagaggagaugccuggggcaaucuggacuauugggggcagggaacccucguuacagugucuuccgcuagcaccaaaggccccucugucuuuccucuggcccccuccagcaagucuacguccgggggaaccgcggcccugggcugccucgugaaagauuacuucccugagcccguuacagugagcuggaacuccggcgcucugaccucugggguccacacauuuccugccgugcuucaaagcuccggacuguacagccucucuuccguggucaccguuccgagcucuagccugggcacgcagacauauaucuguaaugugaaccauaagcccuccaauaccaagguggacaaaaaggucgaaccuaaaucuugcgauaagacacacaccugucccccuugccccgcuccggagcuucucgggggaccuagcguguuccuguuucccccuaaacccaaggacacccugaugauuucccggacacccgagguuacguguguggucguggauguuagccaugaagacccugaggugaaguucaacugguacgucgauggcguggaaguccacaaugccaaaaccaagccgcgcgaggagcaguauaacucuacauacagagugguuuccgugcugaccguccuccaucaggacuggcugaaugggaaagaauauaagugcaaagugagcaacaaggcgcuucccgccccuaucgagaaaacaauuucuaaggcuaagggacaaccccgggaaccucagguuuacacccugcccccgucccgcgaugagcucacgaaaaaucaggugagccugacaugucuugucaagggcuuuuauccuuccgacaucgccguggaaugggagucuaacggccagcccgagaauaacuacaaaaccaccccucccgugcuggacagcgauggguccuucuuucucuacucuaagcugacaguugacaaaagcagauggcaacagggaaacgucuucuccugcagcgugaugcacgaagcucugcacaaucauuauacccagaagucucucucccugagcccuggcaag

SEQ ID NO: 39121 - RNA, 642 nt, Artificial Sequence
  derived and/or modified sequence opt5 from Urtoxazumab_LightChain1
gagaucgugcugacgcagagccccgccacacucuccgucucuccuggcgaaagagcuacgcugagcugccgggccucccaaaccauuucuaacaaucuucacugguaccagcagaagccggggcaggcgccccgccugcucaucaaaagcgcuucccaaucuauuagcggaaucccugccagauucuccggcagcgggucuggaacagacuuuacccugacaauuuccagccuugagucugaagauuucgccguuuauuacugucagcaguccuauagcuggccccugaccuuuggccaggggacaaagguggagaucaaacggaccguggcugccccuucugucuucaucuuucccccuuccgacgaacaacucaagagcggaacggcuuccgugguuugccugcugaacaauuucuacccgcgcgaggccaaagugcaguggaaggucgauaacgcgcuccagucuggcaauagccaggaguccgugaccgaacaagacagcaaggauucuacauauucccugagcucuacccuuacacugagcaaagccgacuacgagaagcauaaaguuuaugcuugugaagugacccaccagggccucuccucucccgucaccaagagcuuuaacagaggggagugc

SEQ ID NO: 39122 - RNA, 1347 nt, Artificial Sequence
  derived and/or modified sequence opt5 from Ustekinumab_HeavyChain1
gaggugcagcugguccagagcggcgccgaaguuaagaaacccggggagucccucaagaucucuugcaaaggaagcggcuacuccuucaccacauauuggcuggggugggugagacagaugccuggaaagggccuugacuggauugggaucaugucuccgguggauagcgacauucgguacucccccucuuuucagggacaggucacgaugagcguggauaaauccaucaccacagcuuaucugcaauggaacagccucaaggccucugacaccgcgauguacuauugugcucgcagacggccuggccagggcuacuucgauuuuugggggcagggaacacugguuaccguguccagcucuagcacaaagggccccagcgucuucccucuugcccccucuuccaaaagcaccuccgggggaacggccgcucugggcugccucgugaaggacuauuuuccugaaccgguuaccgugucuuggaauagcggggcccugacauccggaguccacaccuuccccgcugugcugcagagcucuggccucuacucccugagcucuguggucacaguuccuagcuccucucuuggcacccaaacguacauuuguaacgugaaucauaaacccagcaacacaaagguggauaaacgcgucgagccuaaguccugcgacaagacccacacaugucccccgugcccugcccccgaacugcucgggggaccuagcguguuucuguucccucccaaacccaaggauacccuuaugaucucuagaaccccggagguuacauguguggucguggacguuucccaugaggaucccgaagugaaauuuaauugguaugucgacggcguggagguccacaacgcgaagacgaaaccucgggaggaacaguacaauagcaccuaucgcgugguuucugugcugacaguccuccaucaggauuggcugaacgggaaggaguacaaaugcaagguguccaauaaggcccugcccgcuccuaucgaaaagaccauuagcaaggccaaaggacagcccagagagccgcaaguuuauacacucccucccucccgggacgaacugaccaagaaccaggugucucuuacgugucuggucaaaggcuucuacccuagcgacaucgcuguggagugggaauccaaugggcagcccgagaacaauuauaagacaaccccucccgugcucgauucugacggauccuuuuuccuguacuccaaacuuaccguugauaaaagccgcuggcaacagggcaacgucuuuucuugcuccgugaugcacgaggcccugcacaaucauuacacacaaaagagccucucucuguccccgggcaaa

SEQ ID NO: 39123 - RNA, 642 nt, Artificial Sequence
  derived and/or modified sequence opt5 from Ustekinumab_LightChain1
gacauccagaugacccaaagccccagcucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacauuuaucccuacaccuuuggccaagggacaaaacuggagaucaagagaaccguggcugccccuucuguguucaucuuucccccuuccgacgaacagcuuaaaagcggaacggcuuccgucgugugccugcucaauaacuucuauccgcgggaggccaagguucaguggaagguggauaaugcgcugcagucuggcaacagccaagaauccgucaccgagcaggacagcaaagauucuacauacucccugagcucuacccucacacugagcaaggccgacuacgagaaacacaagguguaugcuugugaaguuacccaucagggccuuuccucucccgugacgaaauccuuuaaucgcggggagugc

SEQ ID NO: 39124 - RNA, 1341 nt, Artificial Sequence
  derived and/or modified sequence opt5 from Vadastuximab_talirine_HeavyChain1
caggugcaacugguccagagcggcgccgagguuaagaaacccggggcuuccgugaaggugucuugcaaagccagcggauacaccuucacaaacuaugacaucaauugggucagacaggcgccuggccaggggcucgaauggauuggauggaucuacccgggcgauggguccacgaaguauaacgagaaauuuaaggcuaaggccacccugacagccgacaccucuacaagcaccgcuuacauggaacuucggucccugcgcucugaugacacagccguguauuacugugcuagcggauaugaggaugccauggacuacuggggccaaggcaccacgguuaccguguccagcgcgucuacaaaagggcccuccgucuucccucucgcccccagcucuaaguccaccagcggaggcacagcugcccuggggugccuugugaaagauuacuuuccugaacccguuaccgugucuuggaacuccggagcucugacgagcggcguccacacauucccugccgugcuccaguccucugggcuguauagccuguccagcguggucaccguuccgucuuccagccucggaacacagaccuacauuuguaaugugaaucauaagcccucuaacaccaaaguggacaagaaggucgagccuaaaagcugcgauaagacacacacgugucccccuugccccgcgccggagcugcuuggcggcccuuguguguuucuguuucccccuaaacccaaggacacccucaugaucuccagaacacccgaaguuaccugcguggucguggauguuucucaugaggacccugaagugaaauucaauugguaugucgaugggguggagguccacaacgccaagacaaaaccgcgggaggaacaguacaauagcaccuaucgcgugguuuccgugcugacgguccuucaucaagacuggcugaacggaaaggaguacaaguguaaagugagcaauaaggcucuccccgccccuauugagaaaacaaucucuaaggcuaaaggccagcccagagaaccucagguuuauacccugcccccgucccgggacgaacugaccaagaaccaggugagccucacaugccuggucaagggguucuacccuucugauaucgccguggagugggaguccaauggacaacccgaaaacaauuacaaaaccacaccucccgugcuugacagcgauggcuccuuuuuccuguauucuaagcucacgguugacaaaagccgcuggcagcaggggaacgucuuuuccuguucugugaugcacgaggcccugcacaaccauuacacccaaaagagccuuucccugagcccuggaaaa

SEQ ID NO: 39125 - RNA, 642 nt, Artificial Sequence
  derived and/or modified sequence opt5 from Vadastuximab_talirine_LightChain1
gacauccagaugacccaaagccccuccucucugagcgccuccgugggcgauagagucacaauuaacugcaaggcuucucaggacaucaauagcuaccucuccugguuccagcagaaaccugggaaggccccgaaaacgcugauuuaucgggcgaaccgccuuguugauggagugcccucuagauuuagcggcuccgggagcggacaagacuacacccugacaaucucuucccuccagccugaggauuucgcuaccuauuacugucugcaguaugacgaauuuccccuuacauucggcgggggaaccaagguggagauuaaacggacagucgccgccccuagcguguuuaucuuucccccuucugaugaacagcugaaguccggcaccgcuagcguugugugccuccugaauaacuucuacccgcgcgaggccaagguccaauggaaaguggacaaugcucugcagucuggcaacucccaggaaagcguuacggagcaggauuccaaggacucuaccuauagccucuccagcacacugacccuuucuaaagccgauuacgagaagcacaaaguguacgcgugugaagucacacaucaagggcuguccagccccgugaccaagucuuucaauagaggagagugc

SEQ ID NO: 39126 - RNA, 1362 nt, Artificial Sequence
  derived and/or modified sequence opt5 from Vandortuzumab_vedotin_HeavyChain1
gaggugcagcuggucgaaagcggcgggggacucguucaacccggcgggucccugagacuuucuugcgccgugagcggauacuccaucaccucugacuaugcuuggaacugggugcggcaggccccuggcaaggggcuggagugggucggauacauuagcaauuccggcucuacaagcuauaacccgucccucaaaagccgcuucacgaucucuagagauaccuccaagaauacacuguaccuucagaugaacagccugcgggcggaagacaccgcuguguauuacugugcccgcgagagaaauuaugauuacgacgauuacuauuacgccauggacuauuggggccaggggacacucguuaccgugucuuccgcuagcacaaaaggacccucugucuuuccucuggcccccuccagcaaguccaccucuggcgggacggcugcccugggaugccucgugaaagauuacuucccugaacccguuaccgugagcuggaacuccggcgcgcugacaagcgggguccacaccuuuccugccgugcuucaaucuuccggacuguauagccucucuagcguggucacaguuccguccucuagccugggcacccagacguacauuuguaaugugaaccauaagcccuccaauacaaagguggacaaaaaggucgagccuaaaagcugcgauaagacccacacaugucccccuugccccgcuccggagcuucugggcgggccuucuguguuccucuuucccccuaaacccaaggacacccugaugaucucccggacccccgaaguuacauguguggucguggauguuagccaugaggacccugaagugaaguucaacugguaugucgauggaguggagguccacaaugccaaaacgaagccgcgcgaggaacaguacaacucuaccuacagagugguuuccgugcugacaguccuccaucaggacuggcugaauggcaaagaguauaagugcaaagugagcaacaaggcccuucccgcuccuauugagaaaaccaucuccaaggcgaaggggcaaccccgggaaccucagguuuacacacugcccccgucucgcgaagagaugaccaaaaaucaggugagccucacgugucuggucaagggauuuuauccuuccgacaucgccguggagugggaaucuaacggccagcccgagaacaauuacaaaacaaccccucccgugcuugauagcgacggguccuucuuucuguauagcaagcucaccguugauaaaucuagauggcaacagggaaacgucuucuccugcagcgugaugcacgaagcucugcacaaucauuacacacagaagucucugucccucagcccuggcaag

SEQ ID NO: 39127 - RNA, 660 nt, Artificial Sequence
  derived and/or modified sequence opt5 from Vandortuzumab_vedotin_LightChain1
gacauccagaugacccaaagccccuccucucugagcgccuccgugggcgaucgggucacaauuacgugcaagucuagccagucccuccuguaccggucuaaccagaaaaauuaucuugcuugguaccagcaaaagccugggaaagccccgaagcugcucaucuauugggcgagcacccgcgaguccggaguucccagcagauucucuggcuccgggagcggaacagacuuuacccugacaauuucuucccuucagccugaagauuucgcuaccuacuauugucagcaguacuauaacuacccccggacauuuggccaagggaccaaaguggagaucaagcgcacgguggccgccccuagcgucuucauuuuucccccuucugacgaacagcugaaguccggaaccgcuagcgugguuugccuccugaauaacuucuacccgagagaggccaaagugcaguggaaggucgauaaugcucugcaguccggcaacucucaagaaagcgugacagagcaggacuccaaagauagcaccuauucucucuccagcacacugacccuuucuaaggccgacuacgagaaacacaagguuuaugcgugugaagugacgcaucagggccugagcucccccgucacaaagucuuuuaauagaggggagugc

SEQ ID NO: 39128 - RNA, 1329 nt, Artificial Sequence
  derived and/or modified sequence opt5 from Vantictumab_HeavyChain1
gaggugcagcuggucgaaagcggcgggggacucguucaacccggcgggucccugagacuuucuugcgccgcuagcggauucaccuuuucccacuacacacugucuugggugcggcaggccccuggcaaggggcucgagugggugagcgucaucuccggagacggcucuuauacguacuaugcggauagcgugaaaggccgcuucaccauuuccagcgacaacucuaagaauacacuguaccuucagaugaacucccugagagcugaagauaccgccguuuauuacugugcccggaauuuuaucaaauauguguucgcuaacugggggcagggaacacucgucaccgugagcucugccuccacaaagggcccgagcguuuuuccccuggcuccuugcucucgcuccaccagcgaguccacggccgcgcuggggugucucgugaaagacuacuuccccgaaccugucaccgugucuuggaauagcggagcccugacauccggcgugcauaccuuucccgcuguccuucaaagcucugggcuguacucccucagcucuguugugacagugccuagcuccaacuucggaacccagacguauacaugcaaugucgaucacaagccgucuaacaccaagguggacaaaacaguugagagaaaguguugcguggagugucccccuugccccgccccucccgucgcuggcccgagcguguuucuguucccucccaaaccuaaggauacccuuaugauuucccggacccccgaaguuacauguguggucguggacgucagccaugaggaucccgaagugcaguuuaauugguacguugacggcguggagguccacaacgccaaaacgaagccucgcgaggaacaguucaauucuaccuuuagagugguuuccgugcugacagucgugcaucaagauuggcucaacgggaaggaguauaaaugcaaggugagcaauaaaggacugccggcgcccaucgaaaagaccauuucuaaaacaaagggccagccucgggagccccagguuuacacccugccucccucccgcgaagagaugacgaaaaaccaggucagccucacaugucuggugaagggguucuauccguccgacaucgccguggagugggaaucuaauggacaaccugagaacaacuacaagaccacacccccuaugcuugauagcgacggcuccuucuuucuguauucuaaacucaccgucgacaagagcagauggcagcaggggaauguguucuccugcagcguuaugcacgaagcucugcacaaccauuacacccaaaaaucucuuucccugagccccgga

SEQ ID NO: 39129 - RNA, 639 nt, Artificial Sequence
  derived and/or modified sequence opt5 from Vantictumab_LightChain1
gacaucgagcugacccagcccccuagcguguccgucgccccgggccaaacagcuagaauuucuugcagcggggauaacaucggauccuucuacguucacugguaucagcagaagcccggccaggccccugugcucgugauuuacgacaaaucuaaucggcccagcgggaucccugaacgcuuuuccggaucuaacagcggcaauacggcgacccugacaauuuccgggacccaagcugaggaugaagccgacuauuacugucagagcuaugccaacacacuuucucuggucuucggaggcggcaccaagcucacagugcuggggcagcccaaagcugccccuuccguuacccuuuuuccgcccagcucugaggaacugcaggcuaauaaggccacgcucgugugccugaucuccgauuucuacccuggagcggucaccguggccuggaaagcugacagcucucccguuaaggccggcguggagacaaccacaccuuccaagcaaagcaacaauaaauaugcugccuccucuuaccugagccucacccccgagcaguggaagucccauagaagcuacucuugucaggucacgcacgaaggguccacaguggagaaaaccguggcgccgacagaaugcagc

SEQ ID NO: 39130 - RNA, 1389 nt, Artificial Sequence
  derived and/or modified sequence opt5 from Vanucizumab_HeavyChain1
caggugcaacugguccagagcggcgccgagguuaagaaacccggggcuuccgugaaggugucuugcaaagccagcggauacaccuucacaggcuauuacaugcacugggucagacaggcgccugggcagggacucgaauggaugggcuggaucaaccccaauuccgggggaacgaacuaugcucaaaaguuucagggccgggugaccaugacacgcgacaccucuauuagcacagccuacauggagcuguccagacuucggucugaugacaccgccguuuauuacugugcucgcagccccaauccuuauuacuacgauuccagcggcuauuacuaucccggggccuucgacaucuggggacagggcacaauggugaccgucucuuccgcuagcguggccgcgccuucuguuuuuauuuucccgccuuccgaugaacagcugaaaagcgggacggccucuguggucugccuccugaacaauuuuuacccgagagaggcuaaggugcaauggaagguggacaacgcccuucaguccggaaauagccaggaauccgucaccgagcaggauucuaaagacagcacauauucccugagcucuacccucacacuguccaaggcugauuacgagaaacauaagguuuaugccugugaagugacccaccaaggccugagcucucccgugacgaaauccuucaaccggggagagugcgacaagacacauaccuguccucccugcccugcgcccgaacuccugggaggcccgagcgucuuucuuuucccucccaagccuaaagauacacugaugaucucucgcacccccgaggugaccuguguuguggucgacgugagccacgaggaucccgaaguuaaguuuaauugguacguggacggcgucgaggugcauaacgccaaaacaaagccuagagaggaacaguacaauuccacguaucgggucgugagcguucucaccgugcugcaccaggacuggcuuaacgggaaagaauacaagugcaaagucucuaauaaggcucugccggcccccauugagaagacaaucuccaaagcuaagggacaaccucgcgagccccagguguguacccucccucccagcagagaugaacugacaaagaaccagguuucucuguccugcgccgugaagggcuucuauccgagcgacaucgccgucgagugggaauccaaugggcagccugagaacaacuacaaaaccacgcccccugugcucgauucugacgggagcuuuuuccugguguccaaacuuacaguugauaagucucgguggcaacagggcaaugucuuuagcuguuccgugaugcacgaagcucugcauaaccacuauacccagaaaagccucucucugucccccgggaag

SEQ ID NO: 39131 - RNA, 1359 nt, Artificial Sequence
  derived and/or modified sequence opt5 from Vanucizumab_HeavyChain2
gaggugcagcuggucgaaagcggcgggggacucguucaacccggcgggucccugagacuuucuugcgccgcuagcggauacaccuucacaaacuauggcaugaauugggugcggcaggccccugggaagggacuggagugggugggcuggaucaacacguacaccggcgaaccgacauaugcggcugacuuuaaacgcagauucaccuuuucccucgauacaucuaagagcaccgccuaccugcagaugaauagccuucgggccgaggacacagcugucuauuacugugccaaauauccccacuacuacgggucuagccauugguauuucgauguguggggacagggcacccugguuacgguguccagcgcuucuaccaaggggccuuccgucuuuccccucgccccuagcucuaaauccacaagcggaggcaccgcggcccuggggugccuggugaaggacuacuuccccgaaccuguuacagugucuuggaacuccggagcucucaccagcggcguccacacguuuccggccgugcugcaauccucuggccuuuauagccuguccagcguggucacaguucccucuuccagccucgggacccagacauacauuuguaaugugaaccauaagccuucuaauaccaaaguggauaagaaagucgagcccaagagcugcgacaaaacccacacauguccucccugcccggcuccugagcugcuuggaggccccuccguguuccuguuuccucccaagcccaaggauacgcucaugaucucucgcaccccugaaguuacauguguggucguggacguuagccaugaggauccggaagugaaauucaacugguaugucgacgggguggagguccacaaugccaagaccaaacccagagaggaacaguacaacuccacauaucgggugguuagcgugcugaccguccugcaccaggauuggcucaauggaaaggaguacaaaugcaaggugucuaacaaagcgcugccugcccccauugaaaagacgaucuccaaggcuaaaggccaaccucgcgagccccagguuuacacacuuccgccuuguagagacgaacugaccaagaaucaggugagccucuggugccuggucaaaggguuuuaucccucugauauugccguggagugggaguccaacggacagccugaaaauaacuacaagaccacacccccugugcuugacagcgacggcuccuucuuucuguauucuaaacucaccguugauaagagccgguggcaacagggcaacgucuucuccuguucugugaugcaugaggcucugcacaaucauuacacacagaagucccugucccucagccccgggaaa

SEQ ID NO: 39132 - RNA, 639 nt, Artificial Sequence
  derived and/or modified sequence opt5 from Vanucizumab_LightChain1
cagcccggccugacccaaccuccgagcguguccgucgcccccgggcagacagcuagaaucacgugcggaggcaacaauauugggucuaagagcguucacugguaccagcagaaaccuggacaagcccccgugcucguggucuaugacgauuccgaccggccuucuggcauccccgagcgcuucagcggguccaacucuggaaauaccgcgacacugaccauuagcagaguggaagcuggcgaugaggccgacuacuauugucagguuugggauuccagcucugaccauuacguguuuggcacagggaccaaggucacagugcuuuccagcgccucuaccaaaggaccuuccguuuucccgcuggcucccagcucuaaguccacgagcggcgggaccgccgcucucggaugccuggugaaagauuauuuuccugaacccgucacaguguccuggaacucuggcgcccuuaccagcggggugcacacauucccugcgguccugcaguccagcggacucuacucucuguccagcguugugaccgugcccucuagcucccugggcacgcagacauauaucuguaaugucaaccauaagccgucuaauaccaagguggacaaaaagguugagccuaaaagcugc

SEQ ID NO: 39133 - RNA, 642 nt, Artificial Sequence; identical to SEQ ID NO: 38294
  derived and/or modified sequence opt5 from Vanucizumab_LightChain2

SEQ ID NO: 39134 - RNA, 1356 nt, Artificial Sequence
  derived and/or modified sequence opt5 from Varlilumab_HeavyChain1
caggugcaacuggucgagagcggcgggggaguugugcagcccggcagaucccuccggcugucuugcgccgcuagcggguucaccuuuuccucuuacgacaugcacugggugcgccaggccccuggaaagggccuugaaugggucgcggugaucugguaugaugggagcaacaaauacuaugcugacuccguuaagggaagauucacaauuucucgggauaauagcaaaaacacgcuguaccuccagaugaacucccugcgcgccgaggacaccgccguguauuacugugcuagaggcagcggcaauuggggguuuuucgauuauuggggacaaggcacacuugucaccgugucuuccgccagcacaaaggggccgucuguuuuuccccuggcuccuuccagcaaaucuaccuccggaggcacagccgcgcucgggugccuggugaaggacuacuuccccgaaccugucaccgugagcuggaacuccggagcccugacgucuggcgugcauaccuuucccgcuguccuccagagcuccggccuguacagccuuucuuccguugugacagugccuagcucuagccuggggacccagacauauaucuguaaugucaaucacaagccguccaacaccaaaguggauaagaaaguugagcccaagucuugcgacaaaacgcauacauguccucccugcccugcccccgaacuccugggaggcccgagcguguuccuuuuuccucccaagccuaaggauacccugaugauuucccggacacccgaggucaccugugugguuguggacgucagccacgaggaucccgaagugaaauucaauugguacgucgacgggguggagguucauaacgcuaagaccaaaccucgcgaggaacaguauaauucuacauacagaguggucuccgugcucacgguucugcaccaagauuggcugaacggaaaggaguauaaaugcaaggugagcaauaaagcccucccggcgcccaucgaaaagaccauuucuaaggccaaaggccagccucgggagccccaggucuacacacugccucccucccgcgacgaacuuaccaagaaccaggugagccugacaugucucgugaaaggguuuuauccguccgacaucgcuguugagugggaaucuaauggacaaccugagaacaacuacaagaccacgcccccuguccuggauagcgacggcuccuucuuucuuuacucuaaacugacaguggauaagagcagauggcagcagggcaauguguucuccugcagcgucaugcacgaggcccuccauaaccacuauacccaaaagucucugucccugagccccgggaaaggaucuucc

SEQ ID NO: 39135 - RNA, 642 nt, Artificial Sequence
  derived and/or modified sequence opt5 from Varlilumab_LightChain1
gacauccagaugacccaaagccccuccucucugagcgccuccgugggcgaucgggucacaauuacgugccgggcuucucaggggaucagccgcuggcucgccugguaccagcagaagccugagaaagcgccgaagucccugauuuaugcugccucuagccuucaauccggaguucccagcagauucucuggcuccgggagcggaaccgacuuuacacugaccaucucuucccuccagccugaagauuucgccacauacuauugucagcaguacaacaccuauccccggacauuuggccaagggaccaaaguggagauuaagcgcacgguggcugccccuagcgucuucaucuuucccccuucugacgaacagcugaaauccggaaccgcuagcgugguuugccuucugaauaacuucuacccgagagaggccaaggugcaguggaaggucgauaaugcgcuccaguccggcaacucucaagaaagcgugacagagcaggacuccaaagauagcaccuauucucuguccagcacacugacccucucuaaggccgacuacgagaaacacaagguuuacgcuugugaagugacgcaucagggccugagcucccccgucacaaaaucuuuuaauagaggggagugc

SEQ ID NO: 39136 - RNA, 1338 nt, Artificial Sequence
  derived and/or modified sequence opt5 from Vatelizumab_HeavyChain1
caggugcaacugcaggagagcggccccgggcucgucaagccuuccgaaacccugucucuuacaugcacgguuagcggauucucccugaccaacuacggcauccacuggauuagacagccgcccgggaaaggacucgaguggcugggcgugaucugggcccggggguuuacaaauuauaacucugcucuuaugagccgccugaccauuuccaaggacaauucuaaaaaccaggugagccucaagcuguccagcgucacagccgcggauaccgcuguguacuauugugccagagccaaugacggaguuuacuaugcuauggauuacuggggccaaggcacacuggugaccgucucuuccgccagcacgaaagggccuucuguguucccccucgcuccuugcucccggagcaccucugaauccacagccgcgcugggaugucuuguuaaggacuauuuucccgagccugugaccgucagcuggaacuccggcgcccugacaucuggggugcauaccuucccggcugugcuccagagcuccggacuguacagccuuucuuccgucguuacggugcccagcucuagccugggcacaaagaccuacacaugcaauguggaucacaaaccuuccaacaccaaggucgacaaacgcguggaaucuaaguaugggcccccuugucccagcugcccggccccugaguuucucggaggccccuccguuuuccuguuuccucccaaacccaaggauacccugaugaucagcagaacaccugaggugacgugugucgugguugacgugucucaggaagauccggagguccaguucaauugguacguggacggcgucgaagugcauaacgcuaagaccaaaccccgggaggagcaauuuaauuccacauaucgcguugugagcguccucaccgugcugcaccaggauuggcuuaacgggaaggaauacaaaugcaagguuucuaauaaaggacugccuuccagcauugagaagacaaucuccaaagccaagggccagcccagagaaccucagguguauacccugcccccgucucaagaggaaaugacgaagaaccaggucagccucacaugucuugugaaaggguucuacccuuccgacaucgcgguggagugggagucuaauggacagcccgaaaacaacuauaagaccaccccucccguucuggauagcgacggcuccuuuuuccucuacagccggcugacagucgacaaaucucgcuggcaagaggggaauguguuuuccugcagcgugaugcaugaagcccugcacaaccacuacacccagaagucucucucccugagccuuggaaaa

SEQ ID NO: 39137 - RNA, 639 nt, Artificial Sequence
  derived and/or modified sequence opt5 from Vatelizumab_LightChain1
gacuucgugaugacccagagccccgccuuucuguccgucacaccuggcgagaagguuacgauuaccugcucugcucaaagcuccgugaacuacauccacugguaucagcagaaaccggaucaggcccccaagaaacucaucuacgacacaucuaagcuggcgagcggggugccuuccagauucucuggaagcggcuccgggaccgauuauacauuuaccauuagcucucuugaagcugaggacgccgccacauacuauugucaacaguggaccacgaauccccugaccuucggacagggcacaaaagucgaaaucaagcggaccguggcugccccuuccguuuuuauuuuucccccuagcgaugagcagcucaagucugggacagcuuccguggucugccugcuuaacaauuucuacccgcgcgaagccaaagugcaauggaagguugacaacgcgcugcagagcggaaauucucaggaguccgugaccgagcaggauagcaaagacuccacguauucucucagcuccacacugacccugagcaaggccgauuacgaaaaacauaaggucuacgcuugugaggugacacaccaaggccucucuucccccgugaccaagagcuucaacagaggcgaaugc

SEQ ID NO: 39138 - RNA, 1353 nt, Artificial Sequence
  derived and/or modified sequence opt5 from Vedolizumab_HeavyChain1
caggugcaacugguccagagcggcgccgagguuaagaaacccggggcuuccgugaaggugucuugcaaaggaagcggcuacaccuucacauccuauuggaugcacugggucagacaggccccugggcagcggcucgaauggaucggagagauugacccgucugaaagcaacacgaauuacaaccaaaaguuuaaaggccgcgugacccugacaguugauaucuccgcgucuaccgcuuauauggagcuuagcucccugagaagcgaagacacagccguguacuauugugcccgcgggggauacgauggcugggacuaugcuauugauuacuggggccaggggacccucgucacagugucuuccgccagcaccaagggacccucuguuuucccucuggcucccuccagcaagucuacguccggcgggaccgccgcgcuuggaugccuggugaaagacuacuuuccugagcccgucacagugagcuggaacuccggcgcccucaccucuggggugcauacauucccugcuguccugcagagcuccggacuguauagccucucuuccguugugaccgugccgagcucuagccugggcacgcagacauacaucuguaaugucaaucacaagcccuccaacaccaaaguggauaagaaaguugagccuaagucuugcgacaagacacauaccugucccccuugccccgccccggaacuugcuggcgccccuagcguguuucuguuucccccuaaacccaaggauacccucaugauuucccggacacccgaggucacgugugugguuguggacgucagccacgaagauccugaggugaaauucaauugguaugucgacgggguggagguucauaacgcgaagaccaaaccgagagaggaacaauacaauucuacauaucggguggucuccgugcugaccguucuucaccaggauuggcugaacggaaaggaauacaaaugcaaggugagcaauaaggcccuccccgcuccuaucgagaaaacaaucucuaaggccaaaggccagccccgcgaaccucaggucuauacccugcccccguccagagacgagcugacgaagaaccaagugagccucacaugucuggugaaaggguucuacccuuccgacauugcuguugagugggaaucuaauggacagcccgagaacaauuacaagaccaccccucccguccuugauagcgacggcuccuuuuuccuguauucuaagcucacaguggauaaaagccgguggcagcaagggaacguguuuuccugcagcgucaugcacgaagcccugcauaaccacuacacccagaagucucuuucccugagcccuggaaaa

SEQ ID NO: 39139 - RNA, 657 nt, Artificial Sequence
  derived and/or modified sequence opt5 from Vedolizumab_LightChain1
gacguggucaugacccagagcccccugucccucccuguuacaccgggcgagcccgccucuaucagcugcagauccucucaaagccuggcuaaguccuacgggaacacguaucuuucuugguaccugcagaaaccuggacagagcccccagcuccugauuuauggcaucuccaaucgguucagcggggugccugaucgcuuuucuggauccggcagcgggaccgacuucacacuuaagauuucuagaguggaagccgaggaugucggaguguacuauugucugcaaggcacccaccagcccuacacauuuggccaggggaccaaaguugaaaucaagcggacaguggcggcuccuuccgucuucauuuuuccgcccagcgacgagcagcucaaaucuggaaccgccuccgugguuugccugcugaacaauuucuauccucgcgaagccaaggugcaauggaaggucgauaacgcucuccagagcggcaauucccaggagucugugacggagcaggacagcaaagauuccaccuacagccugucuuccacacuuacccugagcaaggccgacuacgaaaaacauaagguguaugcuugugaggucacacaccaagggcucucuagccccguuaccaaauccuuuaacagaggagaaugc

SEQ ID NO: 39140 - RNA, 1353 nt, Artificial Sequence
  derived and/or modified sequence opt5 from Veltuzumab_HeavyChain1
caggugcaacugcagcagagcggcgccgaggucaagaaacccggguccucuguuaaggugagcugcaaggcuuccggauacaccuucacaucuuauaacaugcacugggugaaacaggccccuggccaagggcucgaauggaucggagcgauuuacccgggcaugggggacacgagcuauaaucagaaauuuaagggaaaggcuacccugacagccgaugaguccaccaacacagccuacauggaacuuucuagccugagauccgaggacaccgcuuucuauuacugugcccggagcacauauuacggcggcgauugguacuuugacgucugggggcagggaaccacggugaccguuucuuccgcuagcacaaaaggccccucuguguucccucucgcccccuccagcaagucuaccuccgggggaacagcggcccugggcugccuugucaaagauuauuuuccugaacccgugaccguuagcuggaacuccggggcucugacgucuggagugcauacauucccugccguccuccagagcuccggccuguacagccugucuuccguggugaccgucccgagcucuagccucggcacacaaaccuauaucuguaauguuaaucacaagcccuccaacaccaaaguggacaagcgcguggagccuaagucuugcgauaaaacacauacgugucccccuugccccgcuccggagcugcuugggggaccuagcgucuuucuguuucccccuaagcccaaagacacccucaugauuuccagaacacccgaagugaccuguguuguggucgaugugagccacgaggacccugaaguuaaguuuaauugguacguggauggcgucgaggugcauaacgccaaaacaaagccgcgggaggaacaguauaauucuaccuaccgcgucguguccguucugacggugcuucaccaggacuggcugaacgggaaagaguauaagugcaaggucagcaauaaagcgcuccccgccccuaucgaaaagacaauuucuaaagcuaagggacagcccagagagccucaaguguacacccugcccccgucccgggaagagaugaccaaaaaccagguuagccugacaugucucgugaagggcuucuacccuuccgauaucgccgucgagugggaaucuaaugggcagcccgagaacaauuauaagaccacaccucccgugcuggacagcgacggauccuuuuuccuuuacucuaaacugacgguggauaagagccgcuggcaacagggcaacguuuucuccugcagcgucaugcacgaagcucuccauaaccacuauacccagaaaucucugucccuuagcccuggcaag

SEQ ID NO: 39141 - RNA, 639 nt, Artificial Sequence
  derived and/or modified sequence opt5 from Veltuzumab_LightChain1
gacauccagcugacccaaagccccuccucucucagcgccuccgugggcgauagagucacaaugacgugccgggcuucuagcuccguuucuuacauucacugguuccagcagaagccugggaaagccccgaagcccuggaucuaugcgaccagcaaccuggcuuccggagugccugugcgcuuuagcggcucuggguccggaacagacuacaccuucacaauuagcucucuucagcccgaggauaucgccaccuauuacugucaacaguggacauccaauccucccaccuuuggcgggggaacgaaacuggaaauuaagagaaccgucgccgcuccuagcguguucaucuuuccgcccucugacgagcagcucaaauccggcacagccagcguugugugccugcuuaacaauuucuauccucgggaagcuaagguccaguggaagguggauaacgcccugcaauccggcaauucucaggagagcguuaccgaacaggacuccaaagauagcacauacucucucuccagcacccugacgcugucuaaggcggacuaugagaaacauaagguguacgccugugaggucacacaccaggggcucagcucccccgugaccaaaucuuuuaaccgcggagaaugc

SEQ ID NO: 39142 - RNA, 1359 nt, Artificial Sequence
  derived and/or modified sequence opt5 from Vesencumab_HeavyChain1
gaggugcagcuggucgaaagcggcgggggacucguucaacccggcgggucccugagacuuucuugcgccgcuagcggauucaccuuuuccucuuacgccaugagcugggugcggcaggcgccuggcaaggggcuggagugggugucccagaucucuccggcuggaggcuauacaaacuacgccgacagcgucaaaggccgcuucacgauuuccgccgauaccagcaagaauacagcuuaucuccagaugaacucucugagagccgaagacaccgcuguguacuauugugcccgcggggagcuucccuacuaucggauguccaaaguuauggauguguggggacaaggcacacuggucaccgugagcucugcguccacaaaggggccuagcguuuuuccccucgccccuucuuccaaaagcaccuccggaggcacggcugcccuggggugccuggugaaggacuacuuccccgaaccugucaccgugucuuggaauagcggagcucucacauccggcgugcacaccuuuccggccguccugcagagcucuggccuuuacucccugagcucuguugugacagugcccagcuccucucucgggacccagacguauaucuguaacgucaaucauaagccuagcaacacaaaaguggauaagaaaguugagcccaaguccugcgacaaaacccacacauguccucccugcccggcgccugagcugcuuggaggccccagcguguuccuguuuccucccaagcccaaggauacccucaugauuucuagaaccccugaagucacaugugugguuguggacgucucccaugaggauccggaagugaaauucaauugguacgucgacgggguggagguucacaacgccaagacgaaaccccgggaggaacaguauaauagcaccuaccgcguggucucugugcugacaguucugcaucaagauuggcucaacggaaaggaguauaaaugcaagguguccaauaaagcucugccugcccccaucgaaaagaccauuagcaaggcuaaaggccagccuagagagccccaggucuacacacuuccgccuucccgggaagagaugaccaagaaccaggugucucugacgugucucgugaaaggguuuuaucccagcgacaucgccguugagugggaauccaauggacaaccugagaacaauuacaagacaacacccccuguccuggauucugacggcagcuucuuucuuuacuccaaacugaccguggacaagagccgcuggcagcagggcaacguguucucuugcuccgucaugcacgaagcccuccacaaccauuauacccaaaagagccugucucugucccccgggaaa

SEQ ID NO: 39143 - RNA, 642 nt, Artificial Sequence
  derived and/or modified sequence opt5 from Vesencumab_LightChain1
gacauccagaugacccaaagccccagcucucugagcgccuccgugggcgauagagucacaauuacgugccgggcuucucaguacuucagcuccuaucucgccugguaccagcagaagccugggaaagcgccgaagcugcuuaucuauggagcuucuagccgcgccuccggcguucccagcagauuuucuggguccggaagcggcaccgacuucacacugaccauuucuucccuccaaccugaggauuuugccacauacuauugucagcaguaccuggggucucccccuaccuucggacagggcacaaaaguggaaaucaagcggaccguggcugcccccagcgucuuuauuuucccuccguccgacgagcaacuuaaaagcggcacggcuuccgugguuugccugcucaacaauuuuuauccccgcgaagccaaggugcaguggaaggucgauaacgcgcugcagucugggaauagccaggaguccgugaccgaacaagacagcaaagauucuacauacucccugagcucuacccucacacugagcaaggccgacuacgagaaacacaagguuuaugcuugugaggugacccaucagggacuuuccucuccugucacgaaauccuucaacagaggcgaaugc

SEQ ID NO: 39144 - RNA, 1338 nt, Artificial Sequence
  derived and/or modified sequence opt5 from Visilizumab_HeavyChain1
caggugcaacugguccagagcggcgccgagguuaagaaacccggggcuuccgugaaggugucuugcaaagccagcggauacaccuucaucuccuauacaaugcacugggucagacaggcgccuggccaggggcucgaauggaugggauacauuaacccgcggucuggcuauacgcauuacaaucaaaagcugaaagacaaggcuacccuuacagccgauaagagcgccuccaccgcuuauauggagcugucuagccuccgcuccgaagacacagccguguacuauugugcuagaagcgccuacuacgauuaugacggguuugcguacuggggacagggcacccugguuacagugucuuccgccagcaccaaaggccccucugucuucccucuugcucccugcucccggagcacgucugaguccaccgccgcucuggggugucucgugaaggauuauuuuccugaacccguuacagugagcuggaacuccggagcccugaccucuggcguccacacauucccugcggugcugcagagcuccgggcucuacagccugucuuccguggucaccguuccgagcucuaauuuuggaacgcagacauauaccugcaacguggaccauaaacccagcaauacaaagguggauaaaaccgucgagcgcaaguguugcguggaguguccucccugcccugcucccccggccgccgcuccuuccguuuuccuuuuucccccuaagcccaaagacacccugaugaucucuagaacacccgaagugacgugugucgugguugaugugagccacgaggacccugaaguccaauucaacugguacguggauggcgucgaggugcauaaugccaagaccaaaccgcgggaggaacaguuuaacuccacauuccgcguugugagcguccucaccgugguucaccaggacuggcugaaugggaaggaguauaaaugcaaggugucuaacaaaggacuucccgccccuauugaaaagacaaucuccaagaccaaaggccagcccagagagccucaagucuacacgcugcccccgagccgggaagagaugacaaagaaucaggugucucucaccugucuggugaaaggcuuuuacccuuccgauauugcuguugagugggaaagcaacgggcagcccgagaauaacuauaagaccacaccucccaugcuggacuccgacggaucuuucuuucucuacagcaaacugaccgucgauaagucccgcuggcaacagggcaauguguucucuugcagcgugaugcacgaagcgcuucauaaccacuauacacagaagucccugagccucucuccuuccaaa

SEQ ID NO: 39145 - RNA, 639 nt, Artificial Sequence
  derived and/or modified sequence opt5 from Visilizumab_LightChain1
gacauccagaugacccaaagccccuccucucugagcgccuccgugggcgauagagucacaauuacgugcucugcuagcuccucuguuagcuacaugaacugguaucagcagaagccugggaaagccccgaagcggcucaucuacgacaccuccaaacuggcgagcggagugcccucucgcuucuccggcagcgggucuggaacagauuuuacccuuacaauuuccagccugcagccugaggacuucgcuaccuauuacugucaacaguggucuuccaaucccccuacauuuggcgggggaaccaagguggaaaucaaaagaacggucgccgcccccagcguguucauuuuuccuccguccgaugagcagcucaagucuggcaccgcuagcguugugugccugcuuaacaauuucuauccccgggaagccaagguccaguggaaaguggacaacgcucugcaauccggcaauagccaggagucuguuacagaacaggauuccaaggacagcaccuacucucucagcuccacacugacccugucuaaagccgauuaugagaagcacaaaguguacgcgugugaggucacgcaucaggggcucagcuccccugugacaaagagcuuuaaccgcggagaaugc

SEQ ID NO: 39146 - RNA, 1353 nt, Artificial Sequence
  derived and/or modified sequence opt5 from Volociximab_HeavyChain
caggugcagcugaaggagagcggccccgggcucgucgccccuucccagucucugagcauuaccugcacaaucuccggauucucucuuacggacuacggcguucacugggugagacagccgcccgggaaaggacuggaauggcucguggucaucuggagcgauggcuccucuaccuauaacagcgcucugaagucccggaugacaauucgcaaagacaauagcaagucucagguguuucuuaucaugaacucccugcaaaccgaugacagcgccauguacuauugugcgagacaugggacauacuauggaaugaccacaaccggcgaugcucucgacuacuggggccaggggacgucuguuaccguguccagcgccucuacaaaaggaccuuccgucuucccccuggccccuugcagccgguccaccucugagagcacagcugcccugggcugucucgugaaggauuauuuucccgaaccuguuaccguguccuggaauagcggggcucugacgucuggaguccacacauucccggccgugcuucaguccagcggccuguacucucucagcuccguggucaccguucccucuagcucccuggggacaaagaccuauaccugcaacguggaccauaaaccuagcaauacaaagguggauaaacgcgucgagucuaaguacggacccccuugucccuccugcccggcgccugaauuucuuggcggccccagcguguuccuguuuccucccaaacccaaggacacgcucaugauuucuagaaccccugagguuacauguguggucguggauguuucccaggaggacccggaagugcaauucaacugguacgucgaugggguggagguccacaaugccaagaccaaaccccgggaggaacaguuuaacagcacauaucgcgugguuuccgugcugaccguccugcaucaggacuggcucaauggaaaggaguacaaaugcaaggugucuaacaaaggccugccuagcuccaucgaaaagacgaucucuaaagcuaaggggcagcccagagagccucaaguuuauacacuucccccgagccaggaagagaugaccaagaaucaggugucccugaccugucucgucaaaggauucuacccuagcgacauugccguggaaugggagucuaacggccaacccgagaauaacuauaagacaaccccucccgugcuggauuccgacgggagcuuuuuccuuuacucucggcugacaguugauaaaucccgcuggcaggaaggaaaugucuuuagcugcucugugaugcacgaggcucuccacaaccauuacacgcaaaagagccugucccugagccucggcaaa

SEQ ID NO: 39147 - RNA, 645 nt, Artificial Sequence
  derived and/or modified sequence opt5 from Volociximab_LightChain
cagaucgugcugacccaaagccccgccauuauguccgcuucucucggcgagagagucacaaugacgugcaccgccagcuccucuguuagcuccaacuaccugcacugguaucagcagaaaccugggucugcgccgaaucuuuggaucuacagcacauccaaccuggcuagcggagugcccgcccgguucucuggcuccgggagcggaaccucuuauucccucacaauuagcucuauggaagccgaggacgcugccaccuacuauugucaucaguaccugcgcuccccucccacauuuggcgggggaaccaaacuugaaaucaagagaacgguggcugccccuagcgucuucauuuuucccccuuccgaugagcaacugaaaucuggcaccgcgagcgugguuugccuccugaauaacuucuauccgcgggaagccaaggugcaguggaaagucgacaaugcucugcaguccggcaacagccaggagucugugacagagcaagauuccaaggacagcaccuacucucucagcuccacacugacccuuucuaaggccgauuacgaaaaacacaagguuuaugcuugugaggugacgcaucaggggcugagcucccccgucacaaagagcuuuaaucgcggagaaugc

SEQ ID NO: 39148 - RNA, 1344 nt, Artificial Sequence
  derived and/or modified sequence opt5 from Vorsetuzumab_HeavyChain1
caggugcaacugguccagagcggcgccgagguuaagaaacccggggcuuccgugaaggugucuugcaaagccagcggauacaccuucacaaacuauggcaugaauugggucagacaggcgccugggcagggacucaaguggaugggcuggaucaacacguacaccggggaaccgacauaugcugacgccuuuaaaggacgggugaccaugacacgcgauaccuccauuucuacagccuacauggagcugagcagacuucgguccgacgauaccgcuguuuauuacugugcccgcgacuauggcgauuacggcauggacuacugggggcaaggaacgaccgugacagucucuagcgcuuccaccaagggccccagcguguucccucuggcccccucuuccaagagcacaucugggggaaccgcggcccucggcugccugguuaaagauuauuuuccugaacccgugacggucuccuggaauagcggggcucuuacaucuggagugcacaccuucccugccgugcugcaguccagcggccucuacucccugucuagcgucguuacagugccguccagcucucugggcacccagaccuauaucuguaacgugaaucauaagcccuccaacacaaaagucgacaagaaaguggagccuaagagcugcgauaagacgcacaccugucccccuugccccgcuccggaacuccucgggggaccuucuguuuuucuuuuucccccuaaacccaaggacacacugaugauuagcagaacccccgaggugacaugugucgugguugaugugucccaugaggacccugaagucaaauucaauugguacguggauggcgucgaggugcacaacgccaagaccaaaccgcgggaagaacaguauaauucuacguaccgcguugugagcguccucacagugcugcaucaagacuggcuuaacgggaaggaguauaaaugcaagguuuccaauaaggcgcugcccgccccuaucgagaaaaccauuagcaaggcuaaaggacagcccagagagccucagguguacacccugcccccgucucgggacgaacugacaaagaaccaggucucccugaccugucucgugaaaggcuucuacccuagcgauaucgccguggagugggaaucuaaugggcaacccgagaacaauuauaagacaacgccucccguucuggacuccgauggcagcuuuuuccuuuacuccaagcugaccgucgacaaaucucgcuggcagcagggaaacguguuuagcugcuccgugaugcacgaggcucuccacaaccauuauacacaaaagucucugagccuuuccccuggcaaa

SEQ ID NO: 39149 - RNA, 654 nt, Artificial Sequence
  derived and/or modified sequence opt5 from Vorsetuzumab_LightChain1
gacaucgugaugacccagagccccgauucccuggccgucucucucggcgagagagcuacaauuaacugccgggccagcaaguccguuucuacgagcggguacuccuucaugcacugguaucaacagaaaccuggacagccgcccaagcugcuuaucuaccuggcgucuaaucucgaaagcggcgugccugaccgcuuuuccgggagcggaucuggcaccgauuucacacugaccauuuccagccuucaggcugaggacguggccgucuauuacugucaacauucuagagaagugcccuggacauuugggcagggaaccaaaguugagaucaagcggacaguggccgcuccuuccgucuucauuuuucccccuagcgaugaacagcugaaaucuggcaccgccuccgugguuugccuccugaacaauuucuauccgcgcgaggcuaaggugcaguggaaggucgacaacgcccugcaaagcggcaauucccaggagucugugacggaacaggauagcaaagacuccaccuacagccucucuuccacacugacccuuagcaaggcggauuaugagaaacacaagguguacgccugugaagucacacaucaggggcugucuagccccguuaccaaauccuuuaacagaggagagugc

SEQ ID NO: 39150 - RNA, 1344 nt, Artificial Sequence; identical to SEQ ID NO: 39148
  derived and/or modified sequence opt5 from Vorsetuzumab_mafodotin_HeavyChain1

SEQ ID NO: 39151 - RNA, 654 nt, Artificial Sequence; identical to SEQ ID NO: 39149
  derived and/or modified sequence opt5 from Vorsetuzumab_mafodotin_LightChain1

SEQ ID NO: 39152 - RNA, 1347 nt, Artificial Sequence; identical to SEQ ID NO: 38374
  derived and/or modified sequence opt5 from Yttrium_(90Y)_clivatuzumab_tetraxetan_HeavyChain1

SEQ ID NO: 39153 - RNA, 645 nt, Artificial Sequence; identical to SEQ ID NO: 38375
  derived and/or modified sequence opt5 from Yttrium_(90Y)_clivatuzumab_tetraxetan_LightChain1

SEQ ID NO: 39154 - RNA, 1338 nt, Artificial Sequence
  derived and/or modified sequence opt5 from Yttrium_Y_90_epratuzumab_tetraxetan_HeavyChain1
caggugcaacugguccagagcggcgccgagguuaagaaacccggguccucugugaaggugagcugcaaggcuuccggauacaccuucacaucuuauuggcuccacugggucagacaggccccuggccaggggcuggaauggaucggauacauuaacccgcggaaugacuauacggaguacaaccaaaauuuuaaagauaaagcgaccaucacagcugacgaaagcaccaacacagccuauauggagcuuuccucucugcgcagcgaagauaccgccuucuacuuuugugcuagacgggacauuacaaccuucuauuggggccaggggacgaccgugacaguuuccagcgccucuaccaagggacccuccguguuuccucucgcucccagcucuaaguccacaagcggcggcaccgccgcgcuggggugccuugucaaagauuacuucccugagcccgugacgguuucuuggaacuccggagcccugacaagcggcgugcauaccuuuccugcuguccuccaguccucugggcuguacagccuguccagcguggugacagucccgucuuccagccucggaacccagaccuauaucuguaauguuaaucacaagcccucuaacacaaaaguggacaagcgcguggagccuaaaagcugcgauaagacgcauaccugucccccuugccccgccccggaacugcuuggcgggccuuccgucuuccuguuucccccuaagcccaaagacacacucaugauuucuagaacccccgaggugacauguguuguggucgaugugagccacgaagacccugagguuaaguucaauugguacguggauggagucgaggugcauaacgcuaaaaccaagccgcgggaggaacaauauaauuccacguaccgcgucgugagcguucugacagugcuucaccaggacuggcugaacggcaaagaauauaagugcaaagucucuaauaaggcccuccccgcgccuaucgagaagaccaucuccaaagccaagggccagcccagagaaccucagguguacacccugcccccgagccgggaggagaugaccaaaaaccaaguuucucugacaugucucgugaagggguuuuauccuuccgauauugcugucgaaugggagagcaauggacagcccgaaaacaacuacaaaacaacgccucccgugcuggacuccgacggcucuuucuuucuuuacagcaagcugaccguggauaagucccgcuggcagcaagggaauguuuucucuugcagcgucaugcacgaggcccuccauaaccacuauacacagaaaucccugagccuuucuccuggaaag

SEQ ID NO: 39155 - RNA, 657 nt, Artificial Sequence
  derived and/or modified sequence opt5 from Yttrium_Y_90_epratuzumab_tetraxetan_LightChain1
gacauccagcugacgcaaagccccuccucucucagcgccuccgugggcgauagagucacaaugucuugcaagagcucccagucuguucuguacagcgcuaaccacaaaaauuaucuugccugguaccagcagaagccugggaaagcgccgaagcugcucauuuauugggcuuccacgcgggagagcggagugcccucucgcuucuccggcagcgggucuggaaccgacuuuacauucaccaucuccagccugcaaccugaagauauugccacauacuauugucaucaguaccuuucuuccuggaccuuuggcgggggaacaaaagugcagaucaagagaaccgucgccgcucccagcguguucauuuuuccucccuccgacgagcagcugaagucuggcacggccagcguugugugccuccugaacaauuucuauccucgggaagcuaaaguccaauggaagguggauaacgcccugcaguccggcaauagccaggagucuguuaccgaacaggacuccaaagauagcacauacucucucagcuccacccugacacuuucuaaggcggacuacgagaaacacaagguguaugccugugaggucacccaucaagggcugagcuccccggugaccaagagcuuuaaccgcggagaaugc

SEQ ID NO: 39156 - RNA, 1326 nt, Artificial Sequence
  derived and/or modified sequence opt5 from Yttrium_Y_90_epratuzumab_HeavyChain1
caggugcaacugguccagagcggcgccgagguuaagaaacccggguccucugugaaggugagcugcaaggcuuccggauacaccuucacaucuuauuggcuccacugggucagacaggccccuggccaggggcuggaauggaucggauacauuaacccgcggaaugacuauacggaguacaaccaaaauuuuaaagauaaagcgaccaucacagcugacgaaagcaccaacacagccuaugagcuuuccucucugcgcagcgaagauaccgccuucuacuuuugugcuagacgggacauuacaaccuucuauuggggccaggggacgaccgugacaguuuccagcgccucuaccaagggacccuccguguuuccucucgcucccagcucuaaguccacaagcggcggcaccgccgcgcuggggugccuugucaaagauuacuucccugagcccgugacgguuucuuggaacuccggagcccugacaagcggcgugcauaccuuuccugcuguccuccaguccucugggcuguacagccuguccagcguggugacagucccgucuuccagccucggaacccagaccuauaucuguaauguuaaucacaagcccucuaacacaaaaguggacaagcgcguggagccuaaaagcugcgauaagacgcauaccugucccccuugccccgccccggaacugcuuggcgggccuuccgucuuccuguuucccccuaagcccaaagacacacucauuucuagaacccccgaggugacauguguuguggucgaugugagccacgaagacccugagguuaaguucaauugguacguggauggagucgaggugcauaacgcuaaaaccaagccgcgggaggaacaauauaauuccacguaccgcgucgugagcguucugacagugcuucaccaggacuggcugaacggcaaagaauauaagugcaaagucucuaauaaggcccuccccgcgccuaucgagaagaccaucuccaaagccaagggccagcccagagaaccucagguguacacccugcccccgagccgggaggagaccaaaaaccaaguuucucugacaugucucgugaagggguuuuauccuuccgauauugcugucgaaugggagagcaauggacagcccgaaaacaacuacaaaacaacgccucccgugcuggacuccgacggcucuuucuuucuuuacagcaagcugaccguggauaagucccgcuggcagcaagggaauguuuucucuugcagcguccacgaggcccuccauaaccacuauacacagaaaucccugagccuuucuccuggaaag

SEQ ID NO: 39157 - RNA, 654 nt, Artificial Sequence
  derived and/or modified sequence opt5 from Yttrium_Y_90_epratuzumab_LightChain1
gacauccagcugacgcaaagccccuccucucucagcgccuccgugggcgauagagucacaucuugcaagagcucccagucuguucuguacagcgcuaaccacaaaaauuaucuugccugguaccagcagaagccugggaaagcgccgaagcugcucauuuauugggcuuccacgcgggagagcggagugcccucucgcuucuccggcagcgggucuggaaccgacuuuacauucaccaucuccagccugcaaccugaagauauugccacauacuauugucaucaguaccuuucuuccuggaccuuuggcgggggaacaaaagugcagaucaagagaaccgucgccgcucccagcguguucauuuuuccucccuccgacgagcagcugaagucuggcacggccagcguugugugccuccugaacaauuucuauccucgggaagcuaaaguccaauggaagguggauaacgcccugcaguccggcaauagccaggagucuguuaccgaacaggacuccaaagauagcacauacucucucagcuccacccugacacuuucuaaggcggacuacgagaaacacaagguguaugccugugaggucacccaucaagggcugagcuccccggugaccaagagcuuuaaccgcggagaaugc

SEQ ID NO: 39158 - RNA, 1365 nt, Artificial Sequence
  derived and/or modified sequence opt5 from Zalutumumab_HeavyChain1
caggugcaacuggucgagagcggcgggggaguugugcagcccggcagaucccuccggcugucuugcgccgcuagcggguucaccuuuuccacauacggaaugcacugggugcgccaggccccuggcaaggggcuugaaugggucgcggugaucugggacgauggaucuuauaaauacuauggcgacagcguuaagggcagauucacgauuucccgggauaacucuaaaaauacccuguaccuccagaugaacagccugcgcgcugaggacacagccguguauuacugugccagagaugggaucaccaugguccggggagugaugaaggacuauuuugauuacuggggccaagggacacuuguuaccguguccagcgcuucuacaaaaggaccguccgucuucccccuggccccuagcucuaaguccaccagcggcgggacggcugcccucggaugccuggugaaggacuacuuucccgaaccugugaccgucucuuggaacuccggcgcgcugacaagcggcguucauaccuuccccgccgugcuccaguccucugggcuguauagccuuuccagcguggucacagugccuucuuccagccugggaacccagacguacauuuguaauguuaaucacaaaccgucuaacacaaagguggauaaacgcgucgagcccaagagcugcgacaaaacccauacauguccucccugcccugcucccgaacuccugggcgggccguccguguuucuuuucccucccaagccuaaggauacccugaugaucucuagaacccccgagguuacauguguggucguggacgucagccacgaggaucccgaagugaaauuuaauugguauguugacggaguggagguccauaacgccaagacgaaaccucgggaggaacaguacaauuccaccuaucgcgugguuagcgugcucacaguccugcaccaagacuggcugaacggcaaggaguacaaaugcaaggugucuaauaaagcucucccggcccccauugaaaagaccaucuccaaggcgaaagggcagccuagagagccccagguguauacacugccucccagccgggaagagaugaccaagaaccagguuucucuuacgugucuggucaaaggauucuacccguccgauaucgccguggaaugggagagcaauggccaaccugagaacaauuacaagacaacacccccugugcucgacuccgauggcagcuuuuuccuguauucuaaacuuaccgucgacaagucccgcuggcagcaggggaacguguuuucuugcagcguuaugcacgaagcucugcauaaccacuacacccaaaagucccucagccugucucccggaaaa

SEQ ID NO: 39159 - RNA, 642 nt, Artificial Sequence
  derived and/or modified sequence opt5 from Zalutumumab_LightChain1
gccauccagcugacccaaagccccagcucucucagcgcuuccgugggcgacagagucacaauuacgugccgggccucucaggauaucagcuccgcgcugguuugguaccagcagaagccugggaaagcuccgaaacuucugauuuaugacgccucuagccucgaguccggagugcccagccgcuucucuggcuccgaaagcgggaccgauuuuacacugaccaucucuucccuucaaccugaggacuucgccacauacuauugucagcaguuuaacagcuacccccugaccuucggaggcgggacaaagguggaaauuaagagaaccgucgcugccccuucuguguuuaucuuucccccuuccgaugagcagcucaaaagcggaacggcuuccguugugugccugcugaauaacuucuauccgcgggaagccaagguccaauggaagguggacaaugcgcuccagucuggcaacagccaggaguccguuaccgagcaggauagcaaagacucuacauacucccugagcucuacccuuacacugagcaaggccgauuaugaaaaacacaagguguacgcuugugaggucacccaucaaggccucuccucucccgugacgaaauccuucaaucgcggggaaugc

SEQ ID NO: 39160 - RNA, 1332 nt, Artificial Sequence
  derived and/or modified sequence opt5 from Zanolimumab_H0_HeavyChain
caggugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagaucaaccacucuggaagcacgaauuauaaccccucccugaagucucggguuaccauuagcguggacacauccaaaaaucaauuuagccuuaagcugucuuccgugaccgccgcggauacagcugucuacuauugugcccgcgugaucaacugguucgacccuuggggccagggcacccucguuacagugagcucugccuccaccaaagggcccagcgucuuuccucuggcucccucuuccaagagcacguccggaggcaccgccgcucuggggugccucgugaaggauuacuucccugaaccgguuacagugucuuggaauagcggagcccugaccuccggcguccauacauuucccgcggugcuucagagcucugggcuguauucccucagcucuuggaccgugccuagcuccucucugggaacgcagacauacauuuguaacgucaauuucaucaaacccagcaacaccaagguugacaaaaagguggagccuaaauccugcgauaagacacacaccugucccccgugcccugcccccgaacuucugggcggcccuagcguguuucucuucccucccaagcccaaagacacccugaugaucucuagaacaccggaggucacgugugugugggauguuucccaugaggaccccgaagugaaguuuaauugguacgucgaugggguggagguucacaacgcuaaaaccaagccucgggaggaacaauauaauagcacauaccgcguggucucugugcugaccguccuccaucaggacuggcugaacggaaaagaguauaagugcaaaguguccaauaaggcccuucccgcuccuauugaaaagacaaucagcaaagccaagggccagcccagagagccgcagguuuacacccugccucccucccgggaagagaugacgaaaaaccaagugucucucacaugucuggucaagggguucuauccuagcgauauugcgguggaaugggaguccaauggacagcccgagaacaacuacaaaaccaccccucccguucuugacucugauggcagcuuuuuccuguauuccaagcucacaguggacaagagccgcuggcagcaagggaaugucuuuucuugcuccgugaugcacgaagcccugcacaaccauuacacccagaaaagccugucucucuccccgggaaag

SEQ ID NO: 39161 - RNA, 642 nt, Artificial Sequence
  derived and/or modified sequence opt5 from Zanolimumab_L0_LightChain
gacauccagaugacccaaagccccuccucugugagcgccuccgucggcgauagaguuacaauuacgugccgggcuucucaggacaucagcuccuggcuggccgugguguaccagcacaagccugggaaagcgccgaagcuccugauuuaugcugccucuagccuucaguccggaguccccagccgcuucucuggcuccgggagcggaaccgauuuuacacugaccaucucuucccuccaaccugaggacuucgccacauacuauugucagcaggcuaacagcuuucccuacaccuucggcgggggaacaaaacuggaaauuaagagaaccguggccgcuccuucuguuuuuaucuuucccccuuccgaugagcagcuuaaaagcggcacggccuccguggucugccugcucaauaacuucuauccgcgggaagcgaaggugcaauggaagguugacaaugcccugcagucuggcaacagccaggaguccgugaccgaacaggauagcaaagacucuacauacucccugagcucuacccucacacugagcaaggcugauuaugagaaacauaaggucuacgccugugaggugacccaccaagggcuuuccucucccgugacgaaauucaaucgcggagaaugc

SEQ ID NO: 39162 - RNA, 1344 nt, Artificial Sequence; identical to SEQ ID NO: 38781
  derived and/or modified sequence opt5 from Zatuximab_HeavyChain1

SEQ ID NO: 39163 - RNA, 657 nt, Artificial Sequence; identical to SEQ ID NO: 38782
  derived and/or modified sequence opt5 from Zatuximab_LightChain1

SEQ ID NO: 39164 - RNA, 1356 nt, Artificial Sequence
  derived and/or modified sequence opt5 from Actoxumab_HeavyChain
caagugcaacuggucgagagcggcgggggaguugugcagcccggcagaucccuccggcugucuugcgccgcuagcggguucuccuuuucuaacuacggaaugcacugggugcgccaggccccuggcaaggggcuugaaugggucgcgcugaucugguaugacggaagcaaugaggauuacaccgacuccgugaaaggcagauucacaauuucucgggauaacagcaagaauacgcucuaucugcagaugaacucccuucgcgcugaagacaccgccguuuacuauugugccagauggggcauggugcgcggggucaucgauguguuugacauuuggggacaaggcacaguugugaccgucagcucugcuuccacaaaagggccgagcguguucccccuggccccuucuuccaagagcaccucuggaggcacagcugcccucgggugccuggugaaagauuacuuucccgagccugucaccguuuccuggaauagcggagcgcugacguccggcgugcauaccuuccccgccgugcuccagucuagcggccuguauucccuuagcucugucgugacaguuccuuccagcucucuggggacccagacauacaucuguaacgugaaucacaagccgagcaacaccaaggucgacaaacggguggaacccaaguccugcgauaaaacgcauacauguccucccugcccugcucccgagcuccugggaggcccgucuguuuuucuuuucccucccaagccuaaagacacccugaugauuagcagaacacccgaggugaccugugucguggucgaugugucccacgaagaccccgagguuaaguuuaauugguacguggauggggucgaagugcauaacgccaagaccaaaccucgggaggagcaguauaauagcacauaccgcguugugucuguccucacggugcugcaccaagacuggcugaacggaaaggaauauaaaugcaagguguccaauaaagcucucccggcccccaucgagaagaccaucagcaaagcgaagggccagccuagagaaccccagguuuacacacugccucccucucgggaggaaaugaccaagaaccaggucucccuuacaugucuggugaaaggguucuauccgagcgacauugccguggagugggaguccaauggacaaccugaaaacaacuacaagaccacgcccccuguccucgauucugacggcagcuuuuuccuguauuccaaacuuacaguggauaagucucgcuggcagcagggcaauguuuuuagcugcuccgugaugcacgaggcucugcauaaccacuacacccagaaaagccucucucugucccccgggaag

SEQ ID NO: 39165 - RNA, 642 nt, Artificial Sequence
  derived and/or modified sequence opt5 from Actoxumab_LightChain
gacauccagaugacccaaagccccagcucugugagcgccuccgucggcgauagaguuacaauuacgugccgggcuucucaggggaucagcuccuggcuggccugguaccagcacaagccuggaaaagcgccgaagcuccugauuuaugcugccucuagccuucaguccggcgugcccagccgcuucucuggguccggaagcggcaccgacuuuacacugaccaucucuucccuccaaccugaggauuucgccacauacuauugucagcaggcuaacagcuuucccuggaccuucgggcagggaacaaaaguggaaauuaagagaaccgucgccgcuccuucuguguuuaucuuucccccuuccgacgagcaacugaaaagcggcacggccuccguugugugccuucugaauaacuucuacccgcgggaagcgaagguccaguggaagguggauaaugcccuccagucuggcaacagccaggaguccguuaccgaacaagacagcaaagauucuacauauucccugagcucuacccugacacucagcaaggcugacuacgagaaacauaagguguaugccugugaggucacccaccaggggcuguccucucccgugacgaaauccuucaaucgcggagaaugc

SEQ ID NO: 39166 - RNA, 1326 nt, Artificial Sequence
  derived and/or modified sequence opt5 from Andecaliximab_HeavyChain
caggugcaacugcaggagagcggccccgggcucgucaagccuuccgaaacccugucucuuacaugcacgguuagcggauucucccugcucucuuacggcgugcacugggugagacagccgcccgggaaaggacuggaguggcuuggcgucaucuggaccgggggaacaaccaacuauaauagcgcccugaugucccgguuuacaauuucuaaggacgauagcaaaaacaccguguaccucaagaugaacucccugaaaacagaagacaccgcuaucuauuacugugcccgcuauuacuauggcauggauuacuggggccaggggacgcugguuaccgugagcucugcguccacaaagggaccuagcgucuucccccucgcuccuugcucuagauccaccagcgagucuacagccgcccugggcugucuugugaaggacuacuuucccgaaccuguuaccguguccuggaauagcggggcucugacguccggaguccauacauucccggccgugcuccaaucuagcggccuguauucccuuagcucuguggucaccguucccuccagcucucuggggacaaaaaccuauaccugcaauguggaucacaagccuagcaacacaaaaguggacaagcgggucgaguccaaauacggacccccuugucccccgugcccugcucccgaguuucucggcggcccuucuguguuccuguuuccucccaagcccaaggauacgcugaugauuagccgcaccccggaaguuacauguguggucguggacguuucccaggaggaucccgaagugcaguucaauugguacgucgacgggguggagguccauaacgccaaaaccaagccuagagaggaacaguuuaauagcacauaucgggugguuucugugcucaccguccugcaccaagauuggcuuaacggaaaagaguacaagugcaaaguguccaauaagggccugcccagcucuaucgagaaaacgauuuccaaggcgaaggggcagccucgcgaaccccagguuuauacacucccgccuagccaggaagagaugaccaaaaaccaagugucccugaccugucuugucaagggauucuaccccucugacaucgccguggagugggaaagcaauggccagccugagaacaauuacaaaacaacacccccugugcuggauuccgacgggagcuuuuuccucuauucuagacugaccguugacaagucccgguggcaggaaggaaacgucuuuagcugcucugugaugcaugaggcucugcacaaccacuacacgcaaaaaucccucagccugucucuuggcaag

SEQ ID NO: 39167 - RNA, 642 nt, Artificial Sequence
  derived and/or modified sequence opt5 from Andecaliximab_LightChain
gacauccagaugacccaaagccccuccucucugagcgccuccgugggcgauagagucacaauuacgugcaaggcuucucaggacguucggaacaccguggccugguaccagcagaaaccugggaaggcgccgaaacuccugaucuauagcuccucuuaccgcaauacaggagugcccgauagauucagcggcuccgggagcggaaccgacuuuacacuuaccauuucuucccugcaagcugaggaugucgccguguauuacugucagcagcacuauaucacaccuuacaccuucggcgggggaacgaagguugaaauuaaacggaccguggccgcucccagcgucuuuaucuucccucccucugacgagcagcucaaguccggcacagccagcgugguuugccugcuuaacaauuuuuauccucgcgaagcuaaggugcaauggaaagucgauaacgcccugcagucuggcaauucccaggagagcgugaccgaacaggacuccaaggauucuacauacagccucuccagcacccugacgcugucuaaagcggacuacgagaagcauaaaguguaugccugugaggucacacaccaagggcucuccagcccgguuaccaagucuuucaacagaggagaaugc

SEQ ID NO: 39168 - RNA, 1353 nt, Artificial Sequence
  derived and/or modified sequence opt5 from Aprutumab_HeavyChain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccgcuaucucuggaagcggcacauccacguauuacgccgacagcgugaaaggccgcuucaccauuucuagagauaacuccaagaauacacuguaucuucagaugaacagccugcgggccgaagacaccgcugucuacuauugugcccgcgugagauacaauuggaaccacggggauugguuugacccguggggacagggcacacucguuaccgugucuuccgcuagcacaaaagggcccucugucuucccucuggcccccuccagcaaguccaccucuggaggcacggcggcccuggggugccucgugaaagauuauuuuccugagcccguuaccgugagcuggaacuccggagcucugacaagcggcguccauaccuucccugccgugcuucaaucuuccggccuguacagccucucuagcguggucacaguuccguccucuagccuggggacccagacguacaucuguaaugugaaucacaagcccuccaacacaaagguggacaaaaaggucgaaccuaaaagcugcgauaagacccauacaugucccccuugccccgcuccggagcuucugggaggcccuucuguguuucucuuucccccuaaacccaaggacacccugaugauuucccggacccccgagguuacauguguggucguggauguuagccacgaagacccugaggugaaguucaauugguaugucgaugggguggaaguccauaacgccaaaacgaagccgcgcgaggagcaguacaauucuaccuauagagugguuuccgugcugacaguccuccaccaggacuggcugaacggaaaagaauacaagugcaaagugagcaauaaggcgcuucccgccccuaucgagaaaaccauuuccaaggcuaagggccaaccccgggaaccucagguuuauacacugcccccgucucgcgaugagcucaccaaaaaccaggugagccugacgugucuugucaagggguucuacccuuccgacaucgccguggaaugggagucuaauggacagcccgagaacaacuauaaaacaaccccucccgugcuggacagcgauggcuccuuuuuccucuacagcaagcugaccguugacaaaucuagauggcaacagggcaaugucuuuuccugcagcgugaugcacgaagcucugcauaaccacuacacacagaagucucucucccugagcccuggg

SEQ ID NO: 39169 - RNA, 648 nt, Artificial Sequence
  derived and/or modified sequence opt5 from Aprutumab_LightChain
cagagcgugcugacccaacccccuuccgccucuggcacaccggggcagagagucacgaucagcugcuccggaucuagcuccaacauuggcaauaacuacguuucuugguaucagcagcuccccgggaccgcuccuaagcugcuuaucuacgagaauuauaaccggcccgccggagugccugaccgcuucagcggcuccaagagcgggacaucugcgucccuggcuauuagcggacucagaucugaagaugaggccgacuacuauuguuccagcugggaugacucucugaauuacuggguguuuggcggcgggaccaaacuuacaguccugggacaacccaaagccgcuccuuccgugacccucuucccgcccagcuccgaggaacugcaggccaacaaggcuacacugguuugccucaucucugauuuuuauccuggcgccgugaccgucgcguggaaagccgacagcucccccgugaaggcugggguugaaacgaccacaccuagcaagcagucuaauaacaaauacgccgcuuccagcuaccugucucuuacccccgagcaguggaaaagccaccgguccuauucuugucaagugacacaugagggaagcaccgucgaaaagacgguggccccgacagagugcucc

SEQ ID NO: 39170 - RNA, 1341 nt, Artificial Sequence
  derived and/or modified sequence opt5 from Azintuxizumab_HeavyChain
gaggugcagcuggucgaaagcggcgggggacucguucaacccggcgggucccugagacuuucuugcgccgcuagcggauucaccuuuuccgacuacuauauggccugggugcggcaggcgccuggcaaggggcuggaguggguggcuucuaucaacuacgauggaagcuccacauauuacgucgacucugugaaaggccgcuucacgauuagcagagauaaugccaagaacucccucuaucugcagaugaauagccuucgggccgaagacaccgcuguuuacuauugugcccgcgauagaggcuacuacuuugacuauugggggcagggaacaaccgugacagucucuuccgcuagcaccaaaggcccgucuguguucccccuggccccuuccagcaagucuacauccgggggaaccgcggcccucggcugccugguuaaagauuacuuucccgagccugugacggucagcuggaacuccggggcucugaccucuggagugcacacauuccccgccgugcuccaaagcuccggccuguauagccuuucuuccgucguuaccgugccuagcucuagccugggcacacagaccuacaucuguaaugugaaccauaagccguccaauacgaaggucgacaaaaagguggaacccaaaucuugcgauaagacacacaccuguccucccugcccugcucccgagcuccuugggggaccgagcguuuuucuguucccucccaaaccuaaggacacacugaugauuucccggacccccgaggugaccugugucgugguugaugugagccaugaagaccccgaggucaaguuuaacugguauguggauggcgucgaagugcacaaugccaaaacaaagccucgcgaggagcaguacaacucuacguauagaguuguguccguccucaccgugcugcaucaggacuggcugaaugggaaagaauacaagugcaaaguuagcaacaaggcgcucccggcccccaucgagaaaacaauuucuaaggcuaagggacaaccucgggaaccccagguguacacccugccucccucccgcgaggaaaugacaaagaaucaggucagccuuaccugucuggugaagggcuucuauccguccgacaucgccguggagugggagucuaacgggcagccugaaaauaacuacaaaacgacacccccuguucucgauagcgacggauccuuuuuccuguauucuaaacuuaccgucgauaaaagcagauggcaacagggcaacguguuuuccugcagcgugaugcacgaggcucugcacaaucauuacacccagaagucucucucccugagccccggcaag

SEQ ID NO: 39171 - RNA, 660 nt, Artificial Sequence
  derived and/or modified sequence opt5 from Azintuxizumab_LightChain
gacguggucaugacccagacaccccugagccucuccguuacgccuggccaaccggccucuaucagcugcagauccucucagagccuggugcacuccaacgggaauaccuaccuucauugguaucugcagaagcccggacagucuccucaacuccugauuuacaaagugagcaaccgguucuccggcguccccgaucgcuuuagcgggucuggauccggcacagacuucacccuuaagaucagcagaguggaggcugaagauguugggguguauuuuuguucucaguccacacacgucccucccuucaccuuuggaggcggcacaaaaguggagauuaagcggaccguugccgcgccuagcguguucaucuuuccgcccucugacgaacagcugaaauccgggacggcuagcgucgugugccuccugaauaacuucuacccucgcgaggccaaggugcaguggaaggucgauaaugcccugcaauccggaaacucucaggaaagcguuaccgagcaggacuccaaagauagcacauauucucucuccagcacccugacacuuucuaaggcugacuacgagaaacauaagguguaugccugugaagugacccaccagggccugagcucccccgucacgaaaucuuuuaauagaggggagugc

SEQ ID NO: 39172 - RNA, 366 nt, Artificial Sequence
  derived and/or modified sequence opt5 from Blinatumomab_HeavyChain1
caggugcaacugcagcagagcggcgccgagcucgucagacccggguccucuguuaagaucagcugcaaggcuuccggauacgccuucucuagcuauuggaugaacugggugaaacagcggccuggccaagggcuggaauggauuggacagaucuggccgggcgacggggauaccaauuacaacggaaaauuuaagggcaaagcgacacuuacggcugacgaguccucuagcaccgccuauaugcagcuguccagccucgccucugaagauuccgcuguguacuucugugcccgcagagagacaaccacagucggccgguauuacuaugcuauggacuacugggggcagggaaccacagugaccguu

SEQ ID NO: 39173 - RNA, 363 nt, Artificial Sequence
  derived and/or modified sequence opt5 from Blinatumomab_HeavyChain2
gacaucaagcugcagcaaagcggcgccgagcucgcuagacccggggccuccgugaaaaugucuugcaagaccagcggauacacauucacgcgguauaccaugcacugggucaaacagcgcccuggccaggggcuggaauggauuggauacaucaacccguccagaggcuauacaaauuacaaccagaaguuuaaagauaaggcgacccuuacaaccgacaagucuagcuccacagcuuauaugcaacugucuagccucaccuccgaggauagcgccguuuacuauugugcccgguacuacgacgaucauuauugccuggacuacugggggcagggaacgacccuuacagugucuuccguggaa

SEQ ID NO: 39174 - RNA, 1494 nt, Artificial Sequence
  derived and/or modified sequence opt5 from Blinatumomab_LightChain_HeavyChain_HeavyChain_LightChain
gacauccagcugacccaaagccccgccucccucgcugugucucugggccagagagccacaauuagcugcaaggcgucccagucugucgauuacgacggggauagcuaucuuaacugguaccagcaaaucccuggacagccgcccaaacugcucauuuaugacgcuuccaaucugguuucuggcaucccuccccgguucagcggguccggaagcggcacggauuuuacccuuaacauucacccuguggagaagguggacgccgccacauaccauugucagcagucuaccgaagaucccuggacauucgggggaggcaccaaacuggagaucaagggcgggggaggcuccgggggaggcgggagcggaggcggcgggucucaaguccagcuccagcaguccggagcugaacuggugcgcccuggcagcucuguuaaaaucuccugcaaggccagcggguaugcuuuuuccucuuacuggaugaauugggugaagcaaagaccgggacagggccuggaguggauugggcagaucuggcccggagacggcgauacaaacuauaauggcaaauucaaggggaaagccacccucacggcggacgaaagcuccagcaccgccuacaugcaacugucuucccuugcuagcgaggauucugccgucuacuuuugugcucggcgcgagacaaccacagugggaagauauuacuaugccauggacuacuggggccaggggaccacgguuacagugagcuccggaggcgggggcucugauauuaagcugcagcagagcggagcggaacucgcccggccuggcgcuuccgucaaaaugagcugcaagaccucuggguauacauucacccgcuacaccaugcacugggugaagcaaagacccggacagggccuggaguggaucggguauauuaacccuucccggggauacacaaauuacaaccagaaauuuaaggacaaagccacgcuuaccacagacaagucuagcuccaccgcuuauaugcagcugagcucccucacaucugaagauagcgccguguacuauugugcccgcuacuaugacgaucauuacugccuggacuauuggggccaagggaccacgcugacagucuccucuguugagggcggaagcggcggguccggaggcagcgggggaucuggcgggguggaugacauccagcucacccagucccccgcuauuaugagcgcgucuccgggcgagaaagugaccaugacauguagagccuccagcucugucagcuacaugaauugguaccagcaaaaguccggaaccagcccuaaacgguggaucuaugauacaucuaagguggcuuccggcguucccuaccgcuucagcggguccggaucuggcacgagcuauucccugaccaucucuagcauggaagccgaggacgccgcuacauacuauugccagcagugguccucuaacccucuuaccuuuggggccggaacaaagcuggaacucaaa

SEQ ID NO: 39175 - RNA, 333 nt, Artificial Sequence
  derived and/or modified sequence opt5 from Blinatumomab_LightChain1
gacauccagcugacccaaagccccgccucccucgcugugucucugggccagagagccacaauuagcugcaaggcgucccagucugucgauuacgacggggauagcuaucuuaacugguaccagcaaaucccuggacagccgcccaaacugcucauuuaugacgcuuccaaucugguuucuggcaucccuccccgguucagcggguccggaagcggcacggauuuuacccuuaacauucacccuguggagaagguggacgccgccacauaccauugucagcagucuaccgaagaucccuggacauucgggggaggcaccaaacuggagaucaag

SEQ ID NO: 39176 - RNA, 324 nt, Artificial Sequence
  derived and/or modified sequence opt5 from Blinatumomab_LightChain2
guggacgauauccagcugacccaaagccccgccauuauguccgcuucuccuggcgagaaggucacaaugacgugcagagccagcuccucuguuagcuacaugaacugguaucagcagaaauccgggaccucuccgaagcgguggaucuacgacacaagcaaaguggcguccggagugcccuaucgcuucagcggcucuggguccggaaccagcuacucucucacaauuuccagcauggaagcugaggaugccgccaccuauuacugucagcaauggucuuccaauccucugacauuuggcgcugggaccaaacuugaacugaag

SEQ ID NO: 39177 - RNA, 1350 nt, Artificial Sequence
  derived and/or modified sequence opt5 from Brazikumab_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucugguaugacggaagcaacgaguacuaugcugauuccguuaaaggcagauucacaauuucucgggacaauagcaagaacacgcuguaccuccagaugaauagccugcgcgccgaagauaccgccguguauuacugugcuagagaccggggcuauacauccucuugguacccggaugccuuugacaucugggggcaaggaaccauggucacaguguccagcgcuucuaccaaaggccccuccguuuucccucuugcccccugcagccgcucuacauccgagagcaccgcggcccuggggugucucgugaaggauuacuuuccugaacccgucacgguguccuggaacucuggagcucugaccagcggcgugcauacauucccugccguccugcaguccagcgggcucuauucucuguccagcguugugaccgugccgucuagcaauuuuggaacacagaccuacacgugcaacgucgaccacaaacccuccaauacaaagguggauaagaccguugagagaaaauguugcguggaguguccucccugcccugcucccccggucgccggcccuucuguguuccuuuuucccccuaagcccaaagacacacugaugauuagccggacccccgaaguuaccuguguggucguggaugucucccaugaggacccugaagugcaguucaacugguauguugauggcguggagguccacaaugcgaagacaaaaccgcgcgaggaacaauuuaacagcacguucagagugguuucugugcucaccgucgugcaucaggacuggcugaaugggaaggaguacaagugcaaaguguccaacaagggacuucccgccccuaucgaaaagacaauuagcaagaccaaaggccagccccgggagccucagguuuauacacugcccccgucucgcgaagagaugaccaagaaucaagucucccucacgugucuggugaaaggguuuuacccuagcgacaucgcuguggagugggaauccaacggacagcccgagaauaacuauaagacaaccccucccaugcuggauucugacggcagcuucuuccucuacuccaagcugaccgucgauaaaucuagauggcagcaagggaacguguuuagcugcuccguuaugcacgaagcccuucacaaucauuacacacagaaaagccugucucucuccccuggaaaa

SEQ ID NO: 39178 - RNA, 651 nt, Artificial Sequence
  derived and/or modified sequence opt5 from Brazikumab_LightChain
cagagcgugcugacccaacccccuuccgucucuggcgccccggggcagagaguuacaaucagcugcacgggauccucuagcaacaccggcgcuggguacgacgugcacugguaucaacaggugcccggaacagccccuaagcuccugauuuacggcuccgggaaucggcccucuggagucccugaucgcuucagcggcuccaaaagcggcaccucugcgucccuugcuaucacagggcugcaggccgaggacgaagccgauuauuacugucagagcuaugacucuucccucagcggauggguguuuggcgggggaaccagacugacaguucuuggccagcccaaggcugccccuucugugacccuguucccgcccuccagcgaggaacuccaggcuaacaaagccacgcuggucugccugauuuccgauuuuuacccuggggcggugaccguugccuggaaggcugacucuagccccgugaaagccggagucgagacaaccacaccuuccaagcaaagcaauaacaaguaugcugccucuuccuaccucagccugacccccgaacaguggaaaucucaucggagcuacuccugucaggugacgcacgagggcucuacaguggagaagaccgucgcgccgacagaaugcagc

SEQ ID NO: 39179 - RNA, 363 nt, Artificial Sequence
  derived and/or modified sequence opt5 from Brolucizumab_HeavyChain
agcgaggugcagcuggucgaauccggcgggggacucguucaacccggcgggucucugagacuuagcugcaccgccuccggauucucucugacagacuacuauuacaugacgugggugcggcaggcuccuggcaaggggcucgagugggugggauuuaucgauccggacgaugaccccuauuacgccaccugggcgaaaggccgcuucacaauuagcagagauaacuccaagaauacccuguaucuucagaugaacucucugcgggcugaagacacagccgucuacuauugugccggcggggaucacaauagcggauggggccucgacaucugggggcagggaacccuggugacaguuuccagc

SEQ ID NO: 39180 - RNA, 333 nt, Artificial Sequence
  derived and/or modified sequence opt5 from Brolucizumab_LightChain
auggagaucgugaugacccagagccccuccacacugucugccagcgucggcgacagaguuauuaucacgugccaggcuuccgaaauuauccacucuuggcucgccugguaccaacagaagccugggaaagcgccgaagcugcuuauuuaucuggcuagcacccucgccuccggagugcccucucgguucagcggcuccgggagcggagccgaguuuacacugaccaucucuucccuucagccugaugacuucgcuacauacuauugucaaaacguguaccuggccagcaccaauggcgcuaacuuugggcagggaacaaaacucaccguccug

SEQ ID NO: 39181 - RNA, 1347 nt, Artificial Sequence
  derived and/or modified sequence opt5 from Cabiralizumab_HeavyChain
caggugcaacugguccagagcggcgccgagguuaagaaacccggguccucugugaaggugagcugcaaggcuuccggauacaccuucacagacaacuauaugaucugggucagacaggccccuggccaggggcucgaauggaugggagauauuaauccguacaacggcgggacgaccuuuaaucaaaaguucaaaggacgggugacaaucaccgcggacaagucuacaagcaccgcuuauauggagcuguccucucuucgcagcgaagauacagccguuuacuauugugccagagagucccccuacuuuagcaaccuguaugugauggacuacuggggccagggcacccucgucacggugucuuccgcuagcaccaaggggccuucuguuuucccccuggccccuugcucccggagcacaucugaauccaccgcugcccuuggaugucuggugaaagauuacuuucccgagccugucacagugagcuggaacuccggcgcgcucaccucuggggugcacacguucccggccguccugcagagcuccggacuguauagccucucuuccguugugacagugcccagcucuagccugggcaccaagacauauaccugcaaugucgaccauaaaccuuccaauaccaagguggauaaacgcguugagucuaaguacgggcccccuugucccccgugcccugcucccgaauuucuuggaggcccuagcguguuccuguuuccucccaagcccaaagacacacucaugauuuccagaacgccggaggucaccugugugguuguggaugucagccaggaagaccccgaggugcaauucaacugguacgucgauggcguggagguucacaaugccaagacaaaaccucgggaggaacaguuuaacucuaccuaucgcguggucuccgugcugacaguucuucaucaggacuggcugaaugggaaggaauacaaaugcaaggugagcaacaaaggacuccccucuuccaucgagaagaccauuagcaaggcuaaaggccagccuagagaaccccaagucuauacgcugccgccuucccaggaggagaugacaaagaaucaggugucucugaccugucucgugaaaggguucuaccccagcgauaucgccguugaaugggaguccaacggacaaccugaaaauaacuacaagaccacacccccuguccuggacucugacggcagcuuuuuccuuuauucccggcugaccguggauaaaagccgcuggcaggaggggaacguguucucuugcuccgucaugcacgaagcgcuccauaaucacuacacacagaaaagccugucucuuucccugggaaag

SEQ ID NO: 39182 - RNA, 654 nt, Artificial Sequence
  derived and/or modified sequence opt5 from Cabiralizumab_LightChain
gagaucgugcugacccagagccccgccacacucucccugucuccuggcgaaagagcuacgcuuagcugcaaggccucccaaucugucgacuacgauggggacaacuauaugaauugguaccagcagaaaccgggacaggcgccccggcugcucauuuaugcugccagcaaccuggaguccggcaucccugcccgcuucucugggagcggauccggcaccgauuuuacacuuaccauuagcucucuggaacccgaggacuucgcuguuuacuauugucaccucuccaaugaagaucugagcacauuugggggaggcaccaagguggagaucaaaagaacaguggccgcuccuucugucuucauuuuucccccuuccgacgagcaacucaagagcggcaccgccucugugguuugccugcugaacaauuucuacccgcgggaagcgaaagugcaguggaaggucgauaacgcccuucaguccgggaauagccaggaguccgugacggaacaagacucuaaggauagcaccuauucccugagcucuacacucacccuguccaaagcugacuacgagaagcauaaaguuuacgccugugaggugacacaccagggacuuagcucucccgucaccaagagcuuuaaccgcggcgaaugc

SEQ ID NO: 39183 - RNA, 1329 nt, Artificial Sequence
  derived and/or modified sequence opt5 from Camrelizumab_HeavyChain
gaggugcagcuggucgaaagcggcgggggacucguucaacccggcgggucccugagacuuucuugcgccgcuagcggauucaccuuuuccucuuacaugaugagcugggugcggcaggccccuggcaaggggcuggaguggguggcgacaaucuccggaggcggcgcuaacacguauuacccggacucugucaaagggcgcuucaccauuagcagagauaaugccaagaacucccucuaucugcagaugaauagccuucgggccgaagacacagcuguguacuauugugcccgccagcuguacuauuuugauuacuggggacaaggcaccacaguuaccgugucuuccgcuagcacaaaagggcccucugucuucccucucgcccccugcuccagaagcaccucugaguccacggcggcccugggaugucuggugaaggacuacuuuccugaacccguuaccgugagcuggaacuccggcgcucucacaucugggguccacaccuucccugccgugcugcagagcuccggacuuuauagccugucuuccguggucacaguuccgagcucuagccucggcaccaaaacguacacaugcaauguggaucauaagcccuccaacaccaagguggacaaacgggucgagucuaaguauggcccucccuguccucccugcccggcuccugaguuucuugggggacccagcguguuccuguuuccucccaaacccaaggauacacugaugaucucccgcaccccugaaguuaccuguguggucguggacguuagccaggaggauccggaagugcaguucaauugguacgucgacggcguggagguccacaacgccaaaacaaagcccagagaggaacaauuuaauucuacguaucgggugguuuccgugcucaccguccugcaucaggauuggcugaacgggaaggaguacaaaugcaaggugagcaauaaaggacucccuucuuccauugaaaagacaaucagcaaagcgaagggccagccccgcgagccucagguuuauacccugcccccgucccaagaagagaugacaaagaaccaggugucucuuaccugucuggucaagggguucuacccuagcgacauugccguggagugggaauccaauggacagcccgagaacaauuacaagacgacaccucccgugcucgauucugacggcagcuuuuuccuguauuccagacuuaccguugacaaaagccgguggcaagaaggcaacgucuucucuugcuccgugaugcacgaggcucugcauaaccacuacacccagaaaagccucucucugucccuggggaaa

SEQ ID NO: 39184 - RNA, 642 nt, Artificial Sequence
  derived and/or modified sequence opt5 from Camrelizumab_LightChain
gacauccagaugacccaaagccccuccucucugagcgccuccgugggcgauagagucacaauuacgugccucgcuucucagaccaucgggacauggcugaccugguaccagcagaagccuggaaaagccccgaaacuucugauuuauacagcgaccagccucgcugacggcguucccucccgguucucugggagcggauccggcacagauuuuacccugacgaucagcucucuucaaccugaggacuucgccaccuacuauugucaacagguguacuccauucccuggacauuugggggaggcaccaagguggaaaucaagcgcacagucgccgcuccuagcguguucaucuuucccccuucugaugagcagcugaaauccggcaccgccagcguugugugccuccugaacaauuucuauccgagagaagcuaagguccaguggaagguggacaacgcccugcagucuggaaauucccaggagagcguuacggaacaggauuccaaagacucuacauacagccucuccagcacccugacacuuucuaaggcggauuaugagaaacacaagguguacgccugugaggucacccaucaagggcuguccagccccgugaccaaaucuuuuaaccggggcgaaugc

SEQ ID NO: 39185 - RNA, 777 nt, Artificial Sequence; identical to SEQ ID NO: 38352
  derived and/or modified sequence opt5 from Caplacizumab_HeavyChain

SEQ ID NO: 39186 - RNA, 657 nt, Artificial Sequence
  derived and/or modified sequence opt5 from Citatuzumab_bogatox_HeavyChain
gaggugcagcugguccaaagcggccccgggcucguucagccuggaggcuccgugagaaucucuugcgccgcuagcggguacaccuucacaaacuauggaaugaauugggugaagcaggccccgggcaaagggcuggaauggaugggauggauuaacacguacaccggcgaguccacauaugcggacucuuuuaagggccgguucaccuuuagccuugauacauccgcuucugccgccuaccugcagaucaauagccuccgcgcugaagacaccgccgucuauuacugugcuagauucgccauuaaaggggauuauuggggacaaggcacacugcuuaccguguccagcgcgucuacgaaggggcccuccguuuuuccucuggcccccagcucuaaauccaccagcggaggcacagcugcccucgggugccuggugaaggacuacuucccugagcccgucaccgugucuuggaacuccggagcucugacaagcggcguucacaccuuuccugccgugcuccaguccucuggccuguacagccuuuccagcgucgugacggugccgucuuccagccuggggacacagaccuauaucuguaaugucaaccauaagcccucuaauacaaaaguugauaagaaaguggaaccuaagagcugc

SEQ ID NO: 39187 - RNA, 1356 nt, Artificial Sequence
  derived and/or modified sequence opt5 from Cosfroviximab_HeavyChain
gacgugaagcugcucgagagcggcgggggacugguccagcccggcgggucccuuaaacugucuugcgccgcuagcggauucucccucucuaccagcggcguuggggugggaugguuuagacaaccuuccggcaagggccuggaauggcuugcccugaucuggugggaugacgauaaauacuauaacccgucucucaagagccagcuguccauuagcaaagacuucucucggaaucagguguuucugaagaucuccaacgucgauauugcggacacagcuacguacuauugugcccgcagagaucccuucggguacgacaaugccaugggauauuggggccaggggaccagcgugacaguuucuuccgcuagcaccaagggaccuucuguguuuccccucgccccuuccagcaaauccacaucuggcgggaccgcugcccugggaugccuugucaaggauuacuuccccgagccugugacaguuagcuggaacuccggcgcgcugaccagcggcgugcacacguuuccggccguccuccaaucuuccgggcuguauagccuuucuagcguggugaccguccccuccucuagccugggaacacagaccuacaucuguaauguuaaccauaaaccuuccaauacaaagguggacaaacggguggaacccaagagcugcgauaagacccacacguguccucccugcccggcuccugagcuccugggcgggcccucugucuuccuguuuccucccaaacccaaggacacacucaugauuucccgcaccccugaagugacauguguuguggucgaugugagccaugaggacccggagguuaaauucaacugguacguggacggagucgaagugcacaaugccaagaccaaacccagagaggaacaguauaacucuaccuaccgggucguguccguucugacagugcuucaucaggauuggcugaauggcaaggaguauaaaugcaaggucagcaacaaggcucucccugcccccaucgagaaaacgaucuccaaggcgaaagggcaaccucgcgaaccccagguguacacccugccgccuucuagagacgagcuuacaaagaaucagguuagccugaccugucucgugaaaggauuuuaucccuccgauauugccgucgaaugggagucuaacggccagccugaaaauaacuacaagacaacgcccccugugcuggacagcgauggcuccuucuuucuguauagcaagcucaccguggacaaaucucgguggcaacaggggaacguuuucuccugcagcgucaugcacgaggcucugcacaaucauuacacacagaagucucuuucccugagccccggaaaa

SEQ ID NO: 39188 - RNA, 639 nt, Artificial Sequence
  derived and/or modified sequence opt5 from Cosfroviximab_LightChain
gacaucgugaugacccagagcccccugucccucucuacaagcgucggcgauagaguuucccugacgugcaaggccucucaaaacguggggaccgcuguggccugguaccagcagaaaccuggacagagcccgaagcugcugauuuauuccgcgucuaaucgguacacaggcguccccgaccgcuucaccgggagcggauccggcacagauuuuacccucacaaucagcaacaugcaaucugaggaccuggcugauuauuucugucagcaguacuccagcuauccucuuaccuuuggggccggaacgaaacuggaacucagaaccguggccgcucccucuguuuucauuuuuccucccuccgacgagcagcuuaagagcggcacagccucuguggucugccugcucaauaacuucuacccucgggaagcuaaagugcaauggaagguugauaaugcccugcaguccggcaacagccaggaguccgugaccgaacaggacucuaaggauagcacauauucccuuagcucuacccugacgcucuccaaagcggacuacgagaagcacaaagucuacgccugugaggugacacaucaagggcugagcucuccggugaccaagagcuuuaaucgcggagaaugc

SEQ ID NO: 39189 - RNA, 1344 nt, Artificial Sequence
  derived and/or modified sequence opt5 from Crizanlizumab_HeavyChain
caggugcaacugguccagagcggcgccgagguuaagaaacccggggcuuccgugaaggugucuugcaaagucagcggauacaccuucacauccuaugacaucaacugggugagacaggccccuggcaaggggcucgaauggaugggauggauuuacccgggcgaugggucuaucaaauauaaugagaaguuuaagggacggguuacgaugaccguggacaaaagcacagauaccgcguacauggaacuguccucucuucgcagcgaggacacagcugucuauuacugugccagacggggcgaauauggcaacuacgagggggccauggauuacuggggacagggcacccuggugacaguuuccagcgcuucuaccaaggggcccuccguguucccucucgcccccugcagccgcucuacguccgagagcaccgcugcccugggaugucuugucaaagacuauuuuccugaacccgugacagugucuuggaacuccggcgcgcugaccagcgggguccacacauucccugccguucuccaauccucuggacuguacagccuguccagcguggugaccgucacgucuuccaauuuuggcacacagaccuauacaugcaauguggaucauaagccgagcaacaccaaaguugacaagaccguggagagaaaguguugcgucgaaugucccccuugccccgcuccucccguggccggcccgucuguuuuccucuuuccucccaaaccuaaggauacacugaugauuagccggacgcccgaggugaccugugucguggucgacgugucccacgaggaucccgaaguucaguucaauugguacguggacgggauggagguccauaacgcuaaaacaaagccucgcgaggaacaguuuaauucuaccuucagagugguuagcgugcuuacagucgugcaccaagauuggcugaacggaaaagaauauaagugcgccguguccaauaaaggccucccggcgcccaucgagaagaccauuagcaagacgaaagggcagccucgggagccccagguuuacacacugccucccucucgcgaagagaugaccaagaaccaggucucccuuaccugucuggugaaaggauuuuauccgagcgacaucgccguggaaugggagucuaauggccaaccugaaaacaauuacaagacaacacccccuaugcucgacuccgaugggagcuucuuucuguacuccaaacugaccgucgacaagucuagauggcagcagggaaacguguucagcugcuccguuaugcaugaggcucuccacaaccacuauacgcaaaagucucugagccuuucccccggcaaa

SEQ ID NO: 39190 - RNA, 654 nt, Artificial Sequence
  derived and/or modified sequence opt5 from Crizanlizumab_LightChain
gacauccagaugacccaaagccccuccucucugagcgccuccgugggcgauagagucacaauuacgugcaaggcuucucagagcguugacuacgaugggcacuccuauaugaacugguaccagcagaaaccuggaaaggccccgaaacuccugaucuaugcggcuucuaaucuugagagcggcgugcccucccgguucagcgggucuggauccggcaccgacuuuacacugaccauuagcucucuccaaccugaagauuucgccacauacuauugucagcaguccgacgagaacccccugaccuuugggggaggcacaaagguggaaaucaaacgcaccgucgccgcuccuagcguguucauuuuucccccuucugaugagcagcuuaaguccggcacggccagcguugugugccugcucaauaacuucuacccgagagaagcuaagguccaauggaaaguggacaaugcccugcaguccgggaacucucaggagagcguuaccgagcaggauuccaaggacagcacauauucucuguccagcacccucacacugucuaaagcggauuacgaaaagcauaaaguguacgccugugaggucacccaccaaggacuuagcucccccgugacgaagucuuuuaaucggggcgaaugc

SEQ ID NO: 39191 - RNA, 1365 nt, Artificial Sequence
  derived and/or modified sequence opt5 from Crotedumab_HeavyChain
gaggugcagcuggucgaaagcggcgggggacucguucaacccggcgggucccugagacuuucuugcgccgcuagcggauucaccuuuuccaacuaccugaugaauugggugcggcaggccccuggcaaggggcucgaguggcuggcgaacauccaggaagacggaauugagaaauauuacguggauucugucaagggccgcuucacaaucagcagagacaaugcuaaaaacucccuuuaucugcagaugaauagccuccgggccgaagauacggccguguacuauugugcucgcgagccgucucacuacgacauucugaccggcuaugauuacuacuaugggauggacguuuggggacaaggcacaaccgugacagucuccagcgccucuaccaaggggcccuccguguuuccucuggcucccugcagcagaucuacauccgagagcaccgccgcgcucggaugucugguuaaagauuacuucccugaacccgugacggucucuuggaacuccggcgcccuuaccagcggggugcauacauuuccugcugugcugcaguccucuggacucuauagccuguccagcgucguuaccgugccgucuuccagccuuggcacaaagaccuacacgugcaauguggaccacaagcccucuaacacaaaagucgauaagcggguggagagcaaauauggcccucccuguccucccugcccggccccugaguuccucgggggacccuccguuuuucuguucccucccaagcccaaagacacccugaugaucucucgcacaccugaggugaccugugucgugguugaugugagccaggaggacccggaaguccaguuuaauugguacguggauggcgucgaggugcauaacgcuaagaccaagcccagagaagaacaauucaauuccacauaucggguugugagcguccugacggugcuccaccaggacuggcugaacgggaaagaauacaagugcaaaguuucuaauaagggacuuccuuccagcauugagaaaaccaucucuaaggccaaaggccagccccgcgagccucagguguacacacugcccccgucccaagaagagaugaccaagaaccaggucagccucacaugucuggugaagggguuuuauccuuccgacaucgcgguggaaugggagucuaauggacagcccgaaaacaacuacaaaaccacgccucccguucuugauagcgacggcuccuucuuucuguauucuagacucacagucgauaagagccgguggcaagagggcaauguguucuccugcagcgugaugcaugaggcccugcacaaccacuacacccagaaaucucugucccucagccuggggaag

SEQ ID NO: 39192 - RNA, 642 nt, Artificial Sequence
  derived and/or modified sequence opt5 from Crotedumab_LightChain
gacauccagaugacccaaagccccuccucucugagcgccuccgugggcgauagagucacaauuacgugccgggcuucucaggggauccgcaacgaccucggaugguaccagcagaagccuggcaaagccccgaagagacugauuuaugcggcuagcucccuucaaucugggguucccagccgguucuccggaagcggcucugggaccgaguuuauccugacaguguccagccuccagccugaagauuucgccaccuacuauugucugcaguacaauucuaaccccuuuacauucggaccuggcaccaaaguggacauuaagcgcacagucgccgcucccuccguguuuaucuucccuccgagcgaugagcagcuuaaaucuggcaccgccuccguugugugccugcucaauaacuuuuaucccagagaagcuaagguccaauggaagguggacaaugcccugcagagcgggaacucccaggagucuguuacggaacaggauagcaaagacuccaccuacagccugucuuccacacucacccugagcaaggcggauuaugagaaacacaagguguacgccugugaggucacacaucaaggacuuucuagcccugugaccaaauccuucaaucggggcgaaugc

SEQ ID NO: 39193 - RNA, 1356 nt, Artificial Sequence
  derived and/or modified sequence opt5 from Dezamizumab_HeavyChain
caggugcaacugguccagagcggcgccgagguuaagaaacccggguccucugugaaggugagcugcaaggcuuccggauucaccuuugccacauacaacaugcacugggucagacaggcgccuggccaggggcucgaauggaugggauauaucuacccgggcgacgggaaugcuaacuauaaucaacaguucaagggacgggugacgauuaccgccgauaaaucuacaagcaccgccuacauggagcuguccucucuucgcagcgaagacacagcuguuuauuacugugccagaggcgauuuugacuaugauggcggguacuacuucgacuccuggggacagggcacccuggugacagucagcucugcuuccaccaaggggcccagcguguuuccucucgcccccucuuccaagagcacgucuggaggcaccgcggcccuggggugccuuguuaaagauuauuucccugagcccgugacagucuccuggaacagcggagcucugaccuccggcgugcauacauuuccugccgugcuccagucuagcggccuguacucccugagcucugucguuaccgugccguccagcucucucgggacgcaaacauauaucuguaaugugaaccacaagcccagcaauaccaaagucgacaagaaaguggaaccuaaguccugcgauaagacacauaccugucccccuugccccgcuccggagcugcuuggaggcccuucuguuuuccuguuucccccuaaacccaaggacacccucaugauuagccggacacccgaggugacgugugucgugguugaugugucccacgaagacccugaggucaaauucaacugguacguggauggggucgaagugcauaaugccaagaccaaaccgcgcgaggagcaguauaacagcacauacagaguugugucuguccugaccgugcuucaccaggacuggcugaauggaaaggaauauaaaugcaagguuuccaacaaggcgcuccccgccccuaucgagaaaacaauuagcaaggcuaaaggccagccccgggaaccucaaguguacacccugcccccgucucgcgacgagcugacgaagaaucaggucucccucacaugucuggugaaaggguuuuacccuagcgauaucgccguggaaugggaguccaacggacagcccgagaauaacuauaagaccaccccucccguucuugacucugauggcagcuucuuucuguacuccaagcucacagucgacaaaucuagauggcaacagggcaacguguucagcugcuccgugaugcacgaagcucugcauaaucacuauacccagaaaagccuuucucuguccccugggaaa

SEQ ID NO: 39194 - RNA, 642 nt, Artificial Sequence
  derived and/or modified sequence opt5 from Dezamizumab_LightChain
gacauccagaugacccaaagccccuccucucugagcgccuccgugggcgauagagucacaauuacgugccgggcuucugagaacaucuacagcuaucucgccugguaccagcagaagccugggaaagcgccgaagcugcuuauucacaaugcuaaaacccuggccgaaggaguucccucccgcuucucuggcagcggguccggaacagacuuuacccucacaaucagcucucugcagccugaggauuucgccaccuauuacugucaacaucacuauggcgcuccccuuacauuugggcagggaaccaagcuggaaauuaaaagaacgguggccgcuccuuccguguucaucuuucccccuagcgacgagcagcucaagucuggcaccgccuccgucgugugccugcugaacaauuucuacccgcgggaagcgaagguucaguggaaaguggauaacgcccuccaaagcggcaauucucaggaguccgucacagagcaggacagcaaggauuccaccuauucucugagcuccacacuuacccugagcaaagcugacuacgaaaagcauaaaguguacgccugugagguuacgcaccaggggcucucuucccccgugacaaagagcuuuaaccgcggagaaugc

SEQ ID NO: 39195 - RNA, 1506 nt, Artificial Sequence
  derived and/or modified sequence opt5 from Duvortuxizumab_Chain1_scFv
gagaacgugcugacccagagccccgccacacucuccgucacgccuggcgaaaaggcuaccaucacaugcagagccucucaaagcguuuccuacaugcacugguaucagcagaaaccggggcaggcgccccggcugcuuauuuacgacgcuucuaaucgcgccagcggagugccuuccagauucucuggcagcggguccggaaccgaucauacacugaccaucagcucucucgaggccgaagacgcugccacauauuacuguuuucaaggcuccguguaucccuucaccuuugggcagggaacgaagcuggagauuaaaggcggcgggagcggaggcgggggagaaguccagcuuguggagucuggcgggggacugguucagccuggcggcucccuccggcugagcugcgcugccucuggguucaccuuuuccacauacgcgaugaacugggugcgccaagcccccggaaagggccuggagugggucgggagaauccggagcaaauauaauaacuacgcuaccuacuaugccgauuccgugaagggacgcuucacaauuucuagagacgauagcaaaaauucccucuaccugcagaugaacagccuuaagaccgaagacacggcuguuuauuacugugugcggcacggcaauuuugggaacucuuaugucuccugguucgccuacuggggacagggcacacuggugaccgugagcucugcgagcacaaagggcgaggucgccgcuugcgaaaaagagguugccgcucucgagaaggaaguggccgcccuggagaaagaaguggcugcgcuugagaaagggggaggcgauaagacccauaccuguccuccgugccccgccccugaagcugccgggggacccuccgucuuucuguucccucccaagccgaaggacacacucaugaucucucgcacgccugaggugaccuguguuguggucgaugugagccacgaggaccccgaaguuaaauuuaauugguauguggauggcgucgaggugcauaacgccaagacaaaaccuagagaggaacaguacaauuccaccuaccgggucgugagcguucugacagugcugcaccaagacuggcucaacgggaaggaauauaaaugcaaggucucuaauaaggcucugcccgcccccaucgagaaaaccauuuccaaggcgaaaggccagccucgcgagccccagguguacacgcuucccccuagcagagaagagaugacaaagaaccaaguuucucuguggugucucgugaaaggauucuaucccuccgauaucgcugucgaaugggagagcaauggccagccugaaaacaacuacaagaccaccccgccggugcuggacuccgacgggagcuuuuuccuuuauucuaagcugacaguggauaaaucccgguggcagcagggaaauguuuucucuugcagcgucaugcacgaggcccuccauaaccacuacacccaaaagucccugagccugucuccuggcaaa

SEQ ID NO: 39196 - RNA, 813 nt, Artificial Sequence
  derived and/or modified sequence opt5 from Duvortuxizumab_Chain2_scFv
caggccguggucacccaagagcccagccugacaguuuccccuggcgggacggugacccucacaugcagaucuagcaccggagcugugacaaccuccaacuacgccaauuggguccagcagaagccgggccaggcgccccgggggcugaucggaggcacaaacaaacgcgcuccuuggacccccgccagauucucugggagccuucugggaggcaaggccgcucucacgauuaccggcgcccaagcugaagacgaggccgauuauuacugugcgcugugguauuccaaucuuuggguguuugggggaggcacaaaacugaccguucucgggggaggcgggucuggaggcggcggacaggugacacugcgggaaagcgggccugcccuggucaagcccacccagacgcucacacugaccugcacauucuccggcuuuagccuuucuaccuccgggaugggagugggcuggauccgccagccuccggggaaagcucuggaguggcucgcccacauuuggugggacgaugacaagagauacaaccccgcucuuaagagccggcugaccaucucuaaagauacauccaagaaucaaguuuuccugacgaugaccaacauggacccuguggauacagccaccuauuacugugcgcgcauggaacucuggagcuauuacuuugacuacuggggacagggcacaaccgucacggugucuuccgccagcacaaaaggcaagguggcugccugcaaagagaaggucgcugcccugaaggagaaaguugccgcucugaaggaaaaaguggcggcccucaaggag

SEQ ID NO: 39197 - RNA, 681 nt, Artificial Sequence
  derived and/or modified sequence opt5 from Duvortuxizumab_Chain3_h-CH2-CH3
gacaagacccacacaugucccccuugcccggcccccgaggcugccggcgggccuagcguguuccuguuucccccuaaacccaaggauacgcucaugaucuccagaaccccugaagucacaugcguugugguggacgucucucaugaggauccggaagugaaauucaacugguacguugacggaguggagguccacaaugcgaagaccaaaccccgggaagaacaguauaacagcacauaccgcgugguuuccgugcugaccguccuucaucaagauuggcugaauggcaaggaguauaaguguaaagugucuaacaaggcucucccugcccccauugagaaaacaaucagcaaggccaaagggcagccuagagagccccagguguacacccugccgccuucccgggaagagaugacgaagaaucaggucucucuuagcugcgcuguuaagggauuuuaucccuccgacauugccguggagugggaaagcaacggccaaccugagaauaacuacaaaaccacaccucccgugcuggauucugacggguccuucuuucucgucagcaagcugaccguggauaaaucucgcuggcagcagggaaauguuuucuccuguagcgugaugcacgaagcucugcauaacagauauacacagaagucucucucccugagccccggcaaa

SEQ ID NO: 39198 - RNA, 360 nt, Artificial Sequence
  derived and/or modified sequence opt5 from Efungumab_HeavyChain
auggccgaggugcagcuggucgaaagcggcgcugagguuaagaaacccggggaaucccucagaaucucuugcaagggaagcggcuguauuaucuccucuuacuggauuagcugggugcggcaaaugccugggaaaggacuggaguggaugggcaagaucgacccgggggauuccuauauuaacuacucucccagcuuccagggacacgugaccaucuccgccgacaaaagcaucaauacagcguaucuucaguggaacucucugaaggcuuccgauacggccauguacuauugcgcccgcggcggcagagacuuuggggauagcuucgacuacuggggacagggcacccucgucacagug

SEQ ID NO: 39199 - RNA, 750 nt, Artificial Sequence
  derived and/or modified sequence opt5 from Efungumab_HeavyChain_LightChain
auggccgaggugcagcuggucgaaagcggcgcugagguuaagaaacccggggaaucccucagaaucucuugcaagggaagcggcuguauuaucuccucuuacuggauuagcugggugcggcaaaugccugggaaaggacuggaguggaugggcaagaucgacccgggggauuccuauauuaacuacucucccagcuuccagggacacgugaccaucuccgccgacaaaagcaucaauacagcguaucuucaguggaacucucugaaggcuuccgauacggccauguacuauugcgcccgcggcggcagagacuuuggggauagcuucgacuacuggggacagggcacccucgucacagugucuuccgggggaggcgggagcggaggcggcgggucuggaggcgggggauccgauguugugaugacccaaagcccuuccuuucugucugcuuucgucggcgaccggauuacaaucaccugucgcgccagcuccgggauuagcagauaucuugcuugguaccagcaggcccccggaaaggcgccuaaacugcucaucuacgccgcuucuacacugcagaccggcgugcccucccgguuuagcggcucugggagcggaacggaguucacccugacaauuaauucccuccaaccugaagauuuugccaccuauuacugccagcaucugaacucuuauccgcuuacauucggcgggggaaccaagguugacaucaaacgcgcugccgcgcuggag

SEQ ID NO: 39200 - RNA, 339 nt, Artificial Sequence
  derived and/or modified sequence opt5 from Efungumab_LightChain
gacguggucaugacccagagccccuccuuccugucugccuuuguuggcgauagaaucacaauuacgugccgggcuagcuccgggaucucucgcuaccucgccugguaucaacaggcgccuggaaaggcuccgaaacugcuuauuuacgccgccagcacccugcagacaggcgugcccuccagauucucugggagcggauccggcaccgaguuuacacucaccaucaacagccugcagccugaagacuucgcuacauauuacugucaacaccuuaauucuuauccccugaccuuugggggaggcacgaagguggauauuaaacgggccgcugcccucgag

SEQ ID NO: 39201 - RNA, 1350 nt, Artificial Sequence
  derived and/or modified sequence opt5 from Elezanumab_HeavyChain
gaggugcagcugguccaaagcggcgccgaaguuaagaaacccggggcuuccgugaaggugucuugcaaagccagcggauacaccuucacaucccacggcaucucuugggucagacaggcgccugggcagggacucgacuggaugggcuggauuagcccguauuccgggaacacgaauuacgcucagaagcugcaaggacgggugaccaugacaaccgauacaucuaccagcacagccuauauggagcuuuccagccugcgcucugaagacaccgccguuuacuauugugcuagagugggcuccggccccuacuauuacauggaugucugggggcagggaacgcucgugaccguuagcucugccuccacaaaaggcccuagcguguuuccccuggcuccuucuuccaagagcaccuccgggggaacagccgcgcuuggcugccuggucaaggacuacuuccccgagccugugaccgugucuuggaacagcggggcccucacguccggaguccauacauuuccggcuguucugcagagcucuggccuguauucccucagcucuguggugaccguccccagcuccucucugggcacacagaccuacaucuguaaugugaaccacaaaccuagcaauaccaagguugauaaaaagguggaacccaaauccugcgacaagacacauacguguccucccugcccggccccugaggcugccgggggacccagcgucuuccuuuuuccucccaagcccaaagaucaacugaugauuucucggaccccugaggugacauguguuguggucgacgugucccacgaagauccggaggucaaguucaacugguauguggacggcguugaagugcauaaugcgaaaaccaagccccgcgaggagcaguacaacagcacauauagagucgugucuguucucaccgugcugcaccaggauuggcuuaaugggaaagaauacaagugcaaagucuccaacaaggcccugccugcucccaucgagaagacgauuagcaaagccaagggacagccucgggaaccccaaguguauacacucccgccuucccgcgaggaaaugaccaaaaaucaggugucucugaccugucugguuaagggcuuuuaccccagcgacaucgcugucgagugggaguccaacgggcagccugaaaauaacuacaaaacaacacccccugugcucgauucugacggcagcuucuuucuguauuccaagcugaccguggacaagagcagauggcaacagggaaaugucuucucuugcuccgugcuucacgaggcccuccauaaccacuacacgcagaaaagccugucucuuucccccggcaag

SEQ ID NO: 39202 - RNA, 645 nt, Artificial Sequence
  derived and/or modified sequence opt5 from Elezanumab_LightChain
cagagcgcccugacccaacccagauccgugucuggcagcccugggcaguccgucacaaucucuugcacgggaaccagcuccucuguuggcgacagcauuuacguguccugguaucagcagcacccggggaaggcucccaaacucaugcuguacgaugugacaaagcggccuagcggaguccccgaccgcuucucuggcuccaaaagcgggaacaccgccucucuuacaaucuccggacugcaagcggaggaugaagcugacuauuacuguuauagcuacgccggcaccgauacacucuuuggcgggggaaccaaggugacgguucugggccagccuaaagccgcucccucugugacccuuuucccuccguccagcgaggaacugcaggccaauaaggcuacacucgucugccugauuuccgacuuuuaucccggggccgugaccguugcguggaaggccgauucuagcccugugaaagcuggagucgagacaaccacgcccuccaagcagagcaacaauaaauacgccgcuucuuccuaccugagccucacaccugaacaauggaagucucauagaagcuauuccugucaggugacccacgagggcucuacaguggagaaaaccgucgcccccaccgaaugcagc

SEQ ID NO: 39203 - RNA, 1359 nt, Artificial Sequence
  derived and/or modified sequence opt5 from Emapalumab_HeavyChain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguguccgcuaucucuggaagcggcggcuccacauauuacgccgacagcgugaaagggcgcuucacgauuucuagagauaacuccaagaauacccuguaucuucagaugaacagccugcgggccgaagacacagcugucuacuauugugccaaagauggaucuuccggcugguacgugccgcacugguuugaccccugggggcagggaacccucguuacagugagcucugcuuccaccaagggcccuagcgucuucccccuggccccuuccucuaaaagcacauccgggggaaccgcggcccugggcugccucgugaaggauuauuuucccgagccuguuacggugagcuggaacucuggcgcucugaccuccgggguccauacauucccggccgugcuucaaagcucuggacuguacagccucuccucuguggucaccguucccagcuccagccugggcacacagaccuacaucuguaaugugaaucacaagccuucuaacacgaaaguggacaagcgcgucgaacccaaauccugcgauaagacacauaccuguccucccugcccggcuccugagcuucucgggggacccagcguguuucuguucccucccaaacccaaggacacacugaugauuucuagaaccccugagguuaccuguguggucguggauguuucccacgaagacccggaggugaaguuuaauugguaugucgauggcguggaaguccauaacgccaaaacaaagccccgggaggagcaguacaauagcacguaucgcgugguuuccgugcugaccguccuccaccaggacuggcugaacgggaaagaauacaagugcaaagugucuaauaaggcgcuuccugcccccaucgagaaaacaauuagcaaggcuaagggacaaccuagagaaccccagguuuauacccugccgccuucccgggaggaaaugacaaagaaccaggugucucucaccugucuggucaagggcuucuaccccagcgauaucgccguggagugggaguccaauggccagccugaaaacaauuauaaaacgacacccccugugcuugacagcgacggguccuuuuuccuguacucuaagcucaccguugauaaaagccgcuggcaacagggaaacgucuuuucuugcuccgugaugcacgaggcucugcauaaccacuacacccagaaaagccugucucucagccccggcaag

SEQ ID NO: 39204 - RNA, 651 nt, Artificial Sequence
  derived and/or modified sequence opt5 from Emapalumab_LightChain
aacuucaugcugacccagccccacagcguguccgagucuccuggcaagacagucacgaucagcugcaccagauccucugggagcauugccuccaauuacguucaaugguaucagcagcggccgggaucuagccccacaaccgugaucuacgaagacaaccagcgcccuuccggcgugcccgauagauuuagcgggucuauugacuccagcucuaauuccgcuagccucacaaucucuggacugaaaaccgaggaugaagccgacuauuacugucaauccuaugauggcagcaaccgguggauguucgggggaggcacaaaacuuaccguccugggccagccuaaggcggcucccuccgugacgcucuuuccuccgucuagcgaggaacugcaggccaauaaggccacccuuguuugccugauuuccgacuucuaccccggggcugugacagucgccuggaaagcugauagcucuccugugaaggccggaguugagaccacaacccccuccaagcagagcaacaauaaauaugcggccucuagcuaccucucccugacgccugagcaauggaagucucaucgcagcuacuccugucaggugacacacgaaggcagcaccgucgagaaaacaguggcucccaccgaaugcucu

SEQ ID NO: 39205 - RNA, 1341 nt, Artificial Sequence
  derived and/or modified sequence opt5 from Enoblituzumab_HeavyChain
cagguggagcuggucgaaagcggcgggggacucguucaacccggcgggucccugagacuuucuugcgccgcuagcggauucaccuuuacauccuacuggaugucuugggugcggcaggccccuggcaaggggcuggagcucgugagcuccaucacgucuuauggcagcuucaccuacuaugcggacuccgucaaaggacgcuuuacaauuagcagagauaacucuaagaauacccuguaccuucagaugaacucccugcgggcugaagacacagccguguauuacugugcccgcaauauguauacccacuucgauagcuggggccaggggacacucguuaccgugucuuccgcuagcacgaaaggaccgucugucuuuccccuggccccuuccagcaaguccaccucuggcgggacagcugcccugggaugccucgugaaagacuacuuccccgagccuguuaccgugagcuggaacuccggcgcgcugacaagcgggguccauaccuuucccgccgugcuucaaucuuccggacuguacagccucucuagcguggucacgguuccuuccucuagccugggcacacagaccuauaucuguaaugugaaccacaagccguccaauacaaagguggauaaaaaggucgaacccaaaagcugcgacaagacccauaccuguccucccugcccugcucccgagcuucugggcgggccgucuguguuccucuuuccucccaaaccuaaggauacacugaugauuuccagaacgcccgagguuaccuguguggucguggacguuagccacgaagaucccgaggugaaguucaacugguacgucgacggaguggaaguccauaaugccaaaacaaagccucgggaggagcaguauaacucuaccuaccgcgugguuuccgugcugacaguccuccaccaggauuggcugaauggcaaagaauauaagugcaaagugagcaacaaggcccuuccggcucccaucgagaaaaccauuuccaaggcgaaggggcaaccuagagaaccccagguuuacacgcugccucccucucgggacgagcucaccaaaaaucaggugagccugacaugucuugucaagggauuuuauccguccgauaucgccguggaaugggagucuaacggccagccugagaauaacuacaaaaccacacccccugugcuggacagcgacggguccuucuuucucuacagcaagcugaccguugauaaaucucgcuggcaacagggaaacgucuucuccugcagcgugaugcacgaagcucugcauaaucacuauacacagaagucucucucccugagccccggcaag

SEQ ID NO: 39206 - RNA, 648 nt, Artificial Sequence
  derived and/or modified sequence opt5 from Enoblituzumab_LightChain
gacaucgugcugacccagcccccuagcgucuccggcgccccggggcaaagaguuacaauuucuugcagcggauccucuagcaacaucggcuccaauucugugagcugguaccagcagcuccccgggacggcuccuaagcugcuuauuuaugauaacuccaaacggcccagcggagugccugaccgcuucucuggcuccaagagcgggaccucugccucccuggcgaucacaggacuccagagcgaggaugaagcugacuacuauugucaaucuagagauaccuacggcuauuacugggucuuuggcgggggaacaaaacugaccgugcuuggccagcccaaggccgccccuuccguuacacuguucccgcccagcuccgaggaacuccaggcuaauaaagccacccuggugugccugauuucugacuuuuauccuggggcugucacgguggccuggaagggagauagcucccccguuaaggcgggcguggagaccacaaccccuagcaaacagucuaacaauaaguacgccgcuuccagcuaccucucucugacacccgaacaauggaaaagccaccgguccuauucuugucaggucacccaugaggggagcacgguggagaagacaguggccccgaccgaaugcucc

SEQ ID NO: 39207 - RNA, 1323 nt, Artificial Sequence
  derived and/or modified sequence opt5 from Eptinezumab_HeavyChain
gaggugcagcuggucgaaagcggcgggggacucguucagcccggcgggucccugagacuuucuugcgccgugagcggaaucgaccuguccggcuacuauaugaacugggugcggcaggcuccugggaagggacucgagugggucggcgugauuggcaucaauggggccaccuacuaugcgucuugggcuaaaggacgcuucacaauuagcagagauaacuccaagacgaccguuuaccugcagaugaauagccuucgggccgaagacacagccguguauuuuugugcucgcggcgauaucugggggcagggaacccuggucacagugagcuccgccagcaccaaaggcccgucuguuuucccccucgcuccuuccagcaagucuacauccgggggaaccgccgcgcugggcugccuggugaaagacuacuuucccgagccugucacggugagcuggaacucuggcgcccucaccuccggggugcacacauuccccgcuguccugcaaagcuccggacuuuauucucugagcuccguugugaccgugccuucuucuucccucggcacacagaccuacauuuguaaugucaaccauaagccgagcaauacgaagguggaugccagaguugaacccaaaucuugcgacaagacacacaccuguccucccugcccugcucccgagcugcuugggggaccgagcgugacacuguuuccucccaaaccuaaggauacccucaugaucucccggacccccgaggucacaugugugguuguggacgucucucaugaagaucccgaggugaaauucaacugguacgucgacggcguggaaguucacaaugccaagacgaagccucgcgaggagcaguaugcgagcaccuacagaguggucuccgugcugacaguucugcaucaggauuggcucaacgggaaagaauauaagugcaaagugagcaauaaggcccugccggcucccaucgagaaaaccauuucuaaggccaaaggacaaccucgggaaccccaggucuacacacuuccucccucccgcgaggaaaugaccaagaaccaggugagccugacgugucucgugaagggcuuuuauccgucugacaucgcuguugagugggaguccaauggccagccugaaaacaauuacaaaacaacacccccuguccuggauagcgacggguccuucuuucuuuauucuaagcugaccguggacaaaagcagauggcaacagggaaacguguucuccugcucugucaugcacgaggcccuccacaaccauuacacccaaaagagccugucccugagccccggcaaa

SEQ ID NO: 39208 - RNA, 657 nt, Artificial Sequence
  derived and/or modified sequence opt5 from Eptinezumab_LightChain
caggugcugacccaaagccccuccucucucagcgccuccgucggcgaccggguuacaaucaacugccaggcuucucagagcguguaccacaauacguaucuggccugguaccagcaaaagccugggaaagugccgaagcagcuuauuuaugaugcguccacccuggcuucuggaguccccagccgguucuccggcagcgggucuggaacagacuuuacccucacaaucuccagccugcagccugaggauguggccaccuacuauugucuuggcucuuacgacugcacaaacggggauuguuucguuuuuggaggcggcaccaaaguggaaauuaagcgcacggucgccgcucccuccguguucaucuuuccucccagcgacgagcagcugaaaucugggaccgccuccguugugugccuccugaauaacuucuauccuagagaagcuaagguccaauggaagguggauaaugcccugcagagcggaaacucccaggagucugugacagaacaggacagcaaagauuccaccuacagccucucuuccacacugacccuuagcaaggcggacuacgagaaacauaaggucuaugccugugagguuacgcaccaaggccugucuagcccggugacaaaauccuuuaauagaggggaaugc

SEQ ID NO: 39209 - RNA, 1368 nt, Artificial Sequence
  derived and/or modified sequence opt5 from Erenumab_HeavyChain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcuuugacggauccauuaaauacucuguugauagcgugaagggcagauucacaaucucccgggacaacagcaaaaauacgcuguuucuccagaugaacucucugcgcgcugaggauaccgccgucuauuacugugccagagaccggcuuaauuauuacgauuccagcggcuauuaccauuauaaguacuacgggauggcuguguggggacaaggcacaaccguuacagugucuuccgccagcaccaaagggccgucugucuucccccuggcuccuugcucccgcagcacauccgaaucuaccgccgcgcucggaugucuggugaaggacuauuuucccgagccugugacggucagcuggaacuccggcgcccugaccagcgggguucacacauuccccgcugugcuccagucuuccggacuguacagccuuucuagcguggucaccgugccuuccucuaauuuuggcacacagaccuauacgugcaacguugaucauaagccgagcaauacaaaaguggacaagaccgucgaaagaaaauguugcguggagugucccccuugccccgccccucccguugcuggcccguccguguuccuguuuccucccaagccuaaagauacacucaugauuagccggacccccgaggucaccuguguggucguggacguuucucacgaagaucccgaggugcaguucaacugguacgucgacgggguggaaguucauaaugccaagacaaagccucgcgaggagcaauuuaacuccacguucagaguggucagcgugcugaccgugguucaccaggauuggcuuaauggaaaagaauauaagugcaaagucucuaacaagggccugccggcgcccaucgagaaaacaauuuccaagaccaaagggcagccucgggaaccccagguguacacacucccucccagccgcgaggaaaugaccaagaaucaagugucccugacgugucuggucaagggauucuauccgucugacaucgccguggagugggagagcaacggccagccugaaaauaacuacaaaacaacacccccuaugcucgacuccgaugggagcuuuuuccuguacucuaaacuuaccguugacaaguccagauggcagcaaggaaacguguuuagcugcucugucaugcacgaggcucugcauaaucacuauacccagaagucccucagccugucucccggcaaa

SEQ ID NO: 39210 - RNA, 648 nt, Artificial Sequence
  derived and/or modified sequence opt5 from Erenumab_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgacaauaacaagagacccagcgggauuccugaucgguucuccggaagcaaaucuggcaccuccacaacccuggggaucacaggacuccaaaccggcgacgaggcggauuauuacuguggcacaugggacagccgccugucugcuguggucuuugggggaggcaccaaacuuacggugcuggggcagcccaaggccaauccuaccguuacacucuucccgcccuccagcgaggaacugcaggccaacaaggcuacccuggugugccucauuucugauuuuuauccuggagccgucacaguggcuuggaaggccgacggcucccccguuaaagcggggguggaaaccacgaagccuagcaaacaguccaauaacaaguacgccgcuucuagcuaucugucccuuacacccgagcaauggaaaagccacagaucuuacuccugucaggucacccaugaaggaagcacaguggagaagaccguggccccgaccgagugcucu

SEQ ID NO: 39211 - RNA, 1344 nt, Artificial Sequence
  derived and/or modified sequence opt5 from Fremanezumab_HeavyChain
gaggugcagcuggucgaaagcggcgggggacucguucaacccggcgggucccugagacuuucuugcgccgcuagcggauucaccuuuuccaacuacuggaucucuugggugcggcaggccccuggcaaggggcuggaguggguggcggaaauucgcagcgaguccgacgcuucugccacacacuaugccgaagcugucaaaggaagauucacgaucagccgggauaaugccaagaacucccucuaccugcagaugaauagccuucgcgcugaggacaccgccguguauuacugucuggcguauuuugauuacggccucgccauucagaacuauuggggccaagggacacugguuaccgugucuuccgcuagcacaaaaggaccgucugucuucccccuggccccuugcuccagaagcaccucugaguccacagcugcccucggcugucuggugaaggacuacuuucccgaaccuguuaccgugagcuggaacuccggggcgcuuacgucuggaguccauaccuuccccgccgugcugcagagcuccggccucuacagccugucuuccguggucacaguuccuagcucuaauuuugggacccagacauauaccugcaauguggaucacaaaccgagcaacacgaagguggacaagacagucgagcggaaauguugcguggaaugucccccuugccccgcuccucccguugccggaccguccguguuccuuuuuccucccaagccuaaagauacccugaugaucucucgcacacccgaggucaccugugugguuguggacgucagccaugaggaucccgaagugcaguucaauugguacgucgacggcguggagguucacaacgcuaagaccaaaccuagagaggaacaauuuaauuccacauuccggguggucagcgugcucacgguugugcaucaggauuggcugaacggcaaggaauauaagugcaaagucucuaauaaggggcugccguccagcauugagaaaaccaucucuaagacaaaaggacagccccgcgagccucagguguacacccugcccccuuccagagaagagaugacaaagaaccaagugagccucaccugucuuguuaaaggcuuuuaucccuccgacaucgccgucgaaugggagucuaaugggcagccggaaaacaacuacaagacgacaccucccaugcuggauagcgacggauccuucuuccucuauucuaagcugaccguggacaaaagccgguggcagcaaggcaauguguuuuccugcagcgucaugcacgaggcccuucacaaccauuacacccagaagucucugucccucagcccugggaaa

SEQ ID NO: 39212 - RNA, 642 nt, Artificial Sequence
  derived and/or modified sequence opt5 from Fremanezumab_LightChain
gagaucgugcugacccagagccccgccacacucucccugucuccuggcgaaagagcuacgcuuagcugcaaggccuccaaacgggucaccacauacguuucuugguaucaacagaagccggggcaggcgccccgccugcucauuuacggagcuagcaacagauaucugggcaucccugcccgguucuccgggucuggaagcggcaccgacuuuacacuuaccauuuccagccuggagcccgaagauuucgccguguacuauuguucucaguccuacaauuauccuuacacauuugggcaaggaaccaaacucgagaucaagcgcacgguggcugcccccagcgucuucauuuuuccuccgucugacgaacagcugaaauccggcaccgcuagcgugguuugccugcucaacaauuucuaccccagagaggccaaggugcaguggaaggucgauaacgcgcugcagucuggcaauucccaagagagcgugacagaacaggacuccaaagauucuaccuauagccuuuccagcacacugacccucucuaaggccgacuacgagaaacacaagguuuaugcuugugaagugacgcaucaggggcuguccagcccugucacaaaaucuuuuaaccggggagagugc

SEQ ID NO: 39213 - RNA, 1371 nt, Artificial Sequence
  derived and/or modified sequence opt5 from Frunevetmab_HeavyChain
caggugcaacuggucgagagcggcgccgaacucguucagcccggggagucccugagacuuaccugcgcugccucuggauucagccugacaaacaauaacgugaauugggugcggcaggcgccuggcaaggggcucgaauggaugggaggcgucugggcugggggagccacggacuacaacuccgcccugaaaucucgccuuaccaucacaagagauaccagcaagaauacaguguuucugcagaugcacucccuccaaucugaggacaccgcuacauauuacugugcccgggauggcggcuauagcuccagcacccuguacgcuauggacgccugggggcagggaacgaccguuacagugucugcggccuccaccacagcuccgagcgucuucccccuggccccuucuugcggcaccacguccggggcuacaguggcccucgcgugucugguucuuggauauuuucccgaaccugugaccgucagcuggaacucuggcgcccugacauccggggugcauaccuuccccgcugugcuccaggccagcggacuguacucccuuucuagcauggucaccguuccuuccagccgcuggcugucugauacauuuacgugcaauguggcucacccgcccuccaacaccaaaguggacaagacagucagaaaaaccgaucauccucccggcccuaagcccugugacugcccgaaguguccucccccugagaugcucggcgggcccagcauuuucaucuuucccccuaaaccgaaggauacacugucuauuagccggacccccgaggugacgugccugguuguggaccucggaccugaugacuccgauguccagaucacaugguucguggacaauacccaaguuuauaccgccaaaacaucuccccgcgaagaacaguuuaacagcaccuacagaguggucuccgugcugccuauucuucaccaggacuggcugaagggcaaagaguucaaguguaaggucaauagcaaaucucuccccuccccgaucgagcggacaaucagcaaggccaaagggcagccucaugagccccaaguguacguucugccucccgcucaggaggaacuuucucgcaacaagguguccgucacgugccugauuaagagcuuucacccucccgauaucgcgguggaaugggagauuaccggacagccggaaccugagaauaacuauagaacaaccccuccccaacucgacuccgauggcacauacuucguuuauucuaaacugagcguggaccggucccacuggcagcgcgggaauaccuacacguguucugucagccaugaggcccugcacucccaucacacccagaaaagccucacacagucucccggaaag

SEQ ID NO: 39214 - RNA, 651 nt, Artificial Sequence
  derived and/or modified sequence opt5 from Frunevetmab_LightChain
gacaucgagaugacccagagcccccugucccucucugugacaccuggcgaaagcgucuccauuucuugcagagccagcgaggauaucuacaacgcucuggccugguaucuucaaaagccggggcggucuccccgccugcucauuuacaauacggacacccugcacacaggaguuccugauagauucuccggcagcggguccggaaccgacuuuacacuuaaaaucagccgggugcagaccgaagaugugggcgucuauuucugucagcauuacuuucacuauccccgcacauucgggcagggaaccaagcuggagcucaaaagaucugacgcgcaaccuuccguguuucuguuccagcccagccuggaugaacuccauacgggcucugcuuccauuguuugcauccugaacgacuuuuacccuaaggaggugaaugucaaauggaagguggauggcguugugcagaacaaggggauccaggagagcaccacagaacaaaauucuaaagacuccaccuauagccuuuccucuacacugaccaugagcuccacggaguaccagagccacgaaaaguucucuugugaggucacacauaaaucccucgccagcacccuggugaagucuuuuaaccggagcgagugccagcgcgaa

SEQ ID NO: 39215 - RNA, 1341 nt, Artificial Sequence
  derived and/or modified sequence opt5 from Gatipotuzumab_HeavyChain
gaggugcagcuggucgaaagcggcgggggacucguucaacccggcggguccaugagacugucuugcguggccagcggauucccuuuuuccaacuacuggaugaauugggugcggcaggcuccgggcaaggggcuugagugggucggagaaauccgccugaaaucuaacaauuauaccacacacuacgccgagagcgugaagggcagauucacgauuucccgggacgauucuaaaaacagccucuaucugcagaugaacucccuuaagaccgaagacacagcgguuuacuauuguacccgccauuacuauuuugauuacuggggccaggggacacuggugaccgucagcucugcuuccacaaaaggacccagcguguucccucucgcccccucuuccaagagcaccucuggcgggacggccgcucugggaugccugguuaaggacuacuuuccugagcccgugaccgucuccuggaauagcggcgcccucacauccggggugcacaccuucccugcugugcugcaaucuagcggacuuuauucccugagcucugucguuacagugccguccagcucucucggcacccagacguacaucuguaaugugaaccauaaacccagcaauacaaaggucgauaaaaagguggagccuaaauccugcgacaagacccacacaugucccccuugccccgccccggaacugcuuggcgggccuucuguuuuucuguuucccccuaagcccaaagauacccucaugauuagcagaacccccgaggugacaugugucgugguugacgugucccaugaagauccugaggucaaguucaacugguauguggacggagucgaggugcacaaugcgaaaacgaagccgcgggaggaacaguacaacagcaccuaucgcguugugucuguccugacagugcugcaccaggauuggcucaauggcaaagaauacaagugcaaaguuuccaacaaggcccugcccgcuccuaucgagaagaccauuagcaaagccaaggggcaacccagagaaccucagguguauacacuucccccgucucgggacgagcugaccaaaaaucaggucucccucacgugucuggugaagggauucuacccuagcgauaucgcuguggagugggaauccaacggccagcccgagaacaauuacaaaacaaccccucccguucuugacucugacgggagcuuuuuccuguauuccaagcucaccgucgauaagucucgcuggcaacagggaaacguguuuagcugcuccgugaugcaugaaggccugcacaaucauuacacacagaaaagccugucucucuccccuggcaag

SEQ ID NO: 39216 - RNA, 657 nt, Artificial Sequence
  derived and/or modified sequence opt5 from Gatipotuzumab_LightChain
gacaucgugaugacccagagcccccuguccaacccugucacaccgggcgagcccgccucuauuagcugcagauccucuaagagccuccugcacuccaaugggaucacguacuucuuuugguaucuucaaaaaccuggacagucuccccagcugcucauuuaccagaugagcaaccuggcuuccggcguuccugaucgguucagcgggucuggauccggcaccgacuuuacacuucgcaucagcagaguggaagccgaggaugugggggucuauuacugugcgcaaaaucuggaacugcccccuaccuucggacagggcacaaagguggagauuaaacggaccguugcugccccgucuguguuuaucuuucccccuuccgacgaacagcucaagagcggcacagccucugucgugugccugcucaacaauuucuauccccgcgaggcuaaaguucaguggaagguggauaacgcccugcaauccgggaauagccaggaguccgucaccgaacaggacucuaaggauagcacguacucccuuagcucuacccugacacucuccaaagcugacuaugagaagcauaaaguguacgccugugaagugacccaccagggacugagcucuccugucacaaagagcuucaacagaggcgagugc

SEQ ID NO: 39217 - RNA, 1365 nt, Artificial Sequence
  derived and/or modified sequence opt5 from Gedivumab_HeavyChain
gaggugcagcuggucgaaagcggcgggggaguugugcaacccggcaagucccucagacugucuugcgccgcuagcgggcuuaccuucuccucuuacgccgugcacuggguccggcaggcgccuggaaaaggccuggagugggugacacucaucagcuaugacggggcuaaccaguacuaugccgauuccguuaagggacgcuuuacgauuucuagagacaauagcaaaaacaccguguaccugcagaugaacucccuucggccggaagauacagccgucuauuacugugcugugcccggcccuguuuucggcaucuuucccccuuggagcuauuucgacaauugggggcaaggcauucuggugaccgucucuuccgccagcacaaagggacccucuguguuuccucucgcuccguccagcaaaucuaccuccgggggaacagccgcgcugggcugccuggugaaggauuacuuccccgagccugucaccguuagcuggaacuccggggcccucacgucuggagugcauaccuuucccgcugugcugcagagcuccggccuuuacagccugucuuccgucgugacaguuccuagcucuagccucggcacccagacauauaucuguaaugugaaucacaagcccuccaacaccaaagucgacaagaaaguggaaccgaagucuugcgauaaaacgcauacauguccucccugcccugcccccgagcugcuugggggacccagcguuuuccuguuuccuccgaagcccaaggacacccucaugauuucccgcacaccugaggugaccugugucguggucgaugugagccacgaagaccccgagguuaaauucaauugguacguggauggcgucgaagugcauaacgcuaagaccaaaccuagagaggagcaguauaauucuacauaccggguuguguccguccugacggugcugcaccaagacuggcucaacgggaaggaauauaaaugcaaggugagcaauaaagcccugcccgcgccgaucgagaagaccaucucuaaggccaaaggacagccucgcgaaccccagguuuacacacuuccucccuccagagaggaaaugaccaagaaccaggucagccugacaugucucgugaaaggcuuuuauccuuccgauauugcuguggagugggagucuaaugggcaacccgaaaacaacuacaagaccacgccgccuguccuggacagcgacggauccuucuuucuuuacucuaaacugacaguggauaagagccgguggcagcagggcaauguuuucuccugcagcgugaugcacgaggcccuccauaaccacuauacccaaaagucucugucccugagccccggcaaa

SEQ ID NO: 39218 - RNA, 648 nt, Artificial Sequence
  derived and/or modified sequence opt5 from Gedivumab_LightChain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaaucugaggauuuugccguguauuacugucagcauuauuccaauuggcccccucgccugacauucgggggaggcaccaaaguggaaauuaagagaacggucgcugcccccagcguguuuaucuucccuccgucugacgagcagcucaaauccggcaccgcgagcguugugugccugcugaacaauuuuuacccccgggaagccaagguccaguggaaaguggauaacgcucuccaaucuggaaauucccaggagagcguuacagagcaggacuccaaggauucuaccuauagccuguccagcacacuuacccugucuaaggccgacuacgaaaaacacaagguguacgcuugugaggucacgcaucaggggcucuccagcccugugacaaaaucuuucaaccgcggcgaaugc

SEQ ID NO: 39219 - RNA, 1329 nt, Artificial Sequence
  derived and/or modified sequence opt5 from Gemetuzumab_HeavyChain
gaggugcagcugguccaaagcggcgccgaaguuaagaaacccggguccucugugaaggugagcugcaaggcuuccggauacaccaucacagacucuaacauucacugggucagacaggccccuggccagagccucgaguggaucggguauauuuacccguauaauggaggcacggauuacaaccagaaauucaaaaaucgggcgacccugacaguggacaaccccaccaauacagcuuauauggaacuuuccucucugcgcagcgaggauaccgccuuuuacuauuguguuaacgggaauccuuggcucgccuacuggggacaaggcacacuggugaccgucuccagcgcuucuacgaagggccccuccguguucccucuugcccccugcagcagaucuaccuccgaaagcacagcugcccuggggugucucguuaaggacuacuuuccugagccggugaccgucucuuggaacuccggagcgcugacaagcggcgugcauaccuuccccgccgugcugcaguccucugggcucuauagccuguccagcgucguuacggugccuucuuccagccuuggaacaaaaaccuacacaugcaauguggaucacaagcccucuaacaccaaagucgacaagcggguggagagcaaauauggcccucccuguccgccuugccccgcuccugaauuucucgggggacccuccguuuuccuguuucccccuaagccgaaggauacccugaugaucucucgcacacccgaggugacgugugucgugguugacgugagccaggaagauccugagguccaguucaauugguacguggacggcgucgaggugcauaacgccaaaaccaagcccagagaggaacaauuuaauuccacauaucggguugugagcguccuuaccgugcugcaccaggauuggcucaacggcaaagaauacaagugcaaaguuucuaauaaggggcugccuuccagcauugagaaaacaaucucuaaggcuaagggacagccccgcgaaccucagguguauacccugccgcccucccaagaggagaugacgaaaaaccaggucagccucacaugucuggugaagggcuucuacccuuccgacaucgccguggaaugggagucuaacgggcagcccgaaaauaacuacaaaaccaccccucccguucuugauagcgacggauccuuuuuccuguauucuagacucacagucgacaagagccgguggcaagagggcaauguguuuuccugcagcgugaugcaugaagcgcugcacaaccacuacacccagaaaucucuuucccugagccucgggaag

SEQ ID NO: 39220 - RNA, 654 nt, Artificial Sequence
  derived and/or modified sequence opt5 from Gemetuzumab_LightChain
gacauccagcugacccaaagccccuccacacucucugccagcgugggcgauagagucacgauuaccugccgggcuuccgagucucuggacaacuacgggauccgcuuccuuacaugguuucagcagaagccuggaaaagccccgaagcugcucauguaugcggcuagcaaucagggcuccgggguucccucuagauucagcggauccggcagcgggaccgaauuuacacugaccauuucuucccuucaaccugaugacuucgccacauacuauugucagcagaccaaagaggugcccuggagcuuuggacagggcacgaagguggaagucaaacggaccguggccgcuccuucuguuuucaucuuucccccuuccgaugagcaacucaagagcggcacagccucuguggucugccugcugaacaauuucuacccgcgcgaagcuaaggugcaguggaaaguugacaacgcccugcaguccgggaauagccaggaguccgugaccgagcaagauucuaaggacagcacauauucccucagcucuacccugacgcuuuccaaagcggauuacgaaaagcacaaagucuaugccugugaggugacacaucagggacugagcucucccgugaccaagagcuuuaacagaggcgaaugc

SEQ ID NO: 39221 - RNA, 1365 nt, Artificial Sequence
  derived and/or modified sequence opt5 from Gilvetmab_HeavyChain
gaggugcagcugguccaaagcggcggggaccucguuaagcccggaggcuccgugagacugucuugcguggcuagcggguucaacaucaaaaauaccuacaugcacuggguccggcaggcuccuggaaagggccuucaguggauugggcgcaucgccccggcgaacguggauacaaaauaugcucccaaguuucagggaaaagccacgauuuccgccgacaccgcuaagaauacagccuacaugcaacugaacucucucagagcugaagauaccgccguuuauuacugugugcugaucuauuacgacuaugauggcgacauugaugucuggggccaggggacacuugugaccguuagcuccgcgucuacaaccgccccuagcguguucccccuggcuccuuccugcggaagcacgucuggcuccaccgucgcccucgcuugucuggugagcggguacuuucccgagccugugacagucucuuggaacuccggaagccugaccucuggcguucauacauucccguccgugcuccagagcuccgggcuguacucucuuagcuccauggugaccguccccagcucucgguggccuuccgaaacguuuacaugcaauguggcccaccccgcgagcaagaccaaaguugacaagccugugcccaaacgcgagaauggaagagucccgcggccucccgauuguccuaagugccccgcccccgaaaugcugggcggcccuucuguguucaucuuuccgcccaaaccuaaggacacacuccugaucgcucgcacccccgagguuaccuguguggucguggcccuugauccugaggaccccgaaguccagauuagcugguucguggaugggaagcaaaugcagacagcuaaaacgcagccgagagaggaacaguuugccggaaccuaucggguuguguccguccugccuaucggccaucaagacuggcucaaggggaaacaguucacaugcaaggugaacaauaaagcccugcccucuccuauugagcgcaccaucagcaaggcuagaggacaggcgcaccaacccuccguuuacgugcugccucccagccgggaggaacucucuaaaaacacagucucccugaccugucuuauuaaggacuuuuucccgccugauaucgacguggaguggcagagcaauggccagcaggaacccgagucuaaguaucgcacgacacccccucaacuggaugaagacggguccuacuuucucuauagcaaacuguccguggauaagucuagauggcagcggggagacaccuucauuugcgccguuaugcaugaggcccuucacaaccacuacacccaggagagccugucccauucuccgggcaaa

SEQ ID NO: 39222 - RNA, 654 nt, Artificial Sequence
  derived and/or modified sequence opt5 from Gilvetmab_LightChain
gacaucgugaugacccagacaccccugagccucuccgucucucugggcgagccugccagcauuuccugccacgcuucucaaaacaucaauguuuggcuuagcugguacagacagaagccggggcagauuccccagcugcucaucuauaaagccucccaucugcacacgggagugccugaucgguucucuggcagcggguccggaaccgacuuuacacuucgcauuagcagaguggaagcggaugacgcuggcgucuacuauugucaacaggggcagucuuggccccugaccuucggacagggcacaaagguggagaucaaacggaacgaugcccaaccugccguuuaccucuuucagcccuccccugaccagcugcauaccggcagcgcuucuguggucugccugcucaauuccuucuauccgaaggauaucaacgugaaauggaagguugacggggugauucaggauacaggaauccaagaaagcgucaccgagcaggacucuaaggauuccacguacagccuguccucuacccuuacaaugagcuccaccgaauaucugagccacgagcucuacucuugugagauuacacauaaaucccugcccagcacccuuaucaagucuuuucagcgcagcgaaugccaaagaguggac

SEQ ID NO: 39223 - RNA, 1344 nt, Artificial Sequence; identical to SEQ ID NO: 38506
  derived and/or modified sequence opt5 from Ifabotuzumab_HeavyChain

SEQ ID NO: 39224 - RNA, 642 nt, Artificial Sequence; identical to SEQ ID NO: 38507
  derived and/or modified sequence opt5 from Ifabotuzumab_LightChain

SEQ ID NO: 39225 - RNA, 1323 nt, Artificial Sequence
  derived and/or modified sequence opt5 from Iratumumab_HeavyChain
caggugcaacugcagcaguggggcgccgggcuccugaagcccagcgagacccuuucccugacaugcgcugucuacggaggcucuuucagcgccuauuacugguccuggaucagacagccuccggggaaaggacucgaauggauuggcgacaucaaccacgggggaggcacgaauuauaaccccucucugaagucucggguuaccauuuccguggauacaucuaaaaaucaauuuagccuuaagcugaacuccgugaccgcggcugacacagccgucuacuauugugccagccucaccgcuuacuggggccaggggucucuggugacaguuuccagcgccucuaccaaaggaccuuccguguucccccuggcuccuagcucuaaguccacgagcggcgggaccgccgcgcucggaugccuggucaaggauuauuuucccgagccugugacaguuuccuggaacucuggcgcccuuaccagcggggugcauacauucccggcuguccugcaguccagcggacucuacucucuguccagcguggugaccguccccucuagcucccuuggcacgcagacauacaucuguaauguuaaucacaaaccuucuaacaccaagguggacaaaaagguggaacccaaaagcugcgauaagacacauaccuguccucccugcccggccccugagcugcucggcgggcccuccgucuuucuguucccucccaagcccaaagacacccugaugauuagccgcacaccugaagugacguguguuguggucgaugugucucacgaggacccggagguuaaguuuaauugguauguggauggagucgaagugcauaacgcuaaaaccaagcccagagaggaacaauacaauuccacauaucgggucgugagcguucucaccgugcugcaccaggacuggcuuaacggcaaagaguacaagugcaaagucucuaauaaggcccugccugcgcccaucgagaagacaaucuccaaagccaaggggcagccucgcgaaccccagguguauacccucccgccuagcagagaugagcugacgaaaaaccaaguuucccuuacaugucuggugaagggauucuaccccucugacauugcugucgaaugggagagcaauggccagccugaaaacaacuauaaaaccacacccccugugcucgauuccgacgggagcuuuuuccuguacagcaagcugaccguggacaagucccgguggcagcaaggaaauguuuuuagcugcucugucaugcacgaggcccuccauaaccacacccagaaaucccugagccuuucucccggcaag

SEQ ID NO: 39226 - RNA, 642 nt, Artificial Sequence
  derived and/or modified sequence opt5 from Iratumumab_LightChain
gacauccagaugacccaaagccccacaucccugucugccagcgugggcgauagagucacgauuaccugccgggcuucccaggggaucucuagcuggcucacaugguaccagcagaagccugagaaagccccgaagucccugauuuaugcggcuucuagccuucaauccggaguucccagccgcuucucuggcuccgggagcggaaccgacuuuacacugaccaucucuucccuccagccugaagauuucgccacauacuauugucagcaguacgacagcuaucccauuaccuuuggccaagggacgagacuggagaucaaacggaccguggccgcuccuucuguguucaucuuucccccuuccgaugaacagcuuaagagcggaacagccuccgucgugugccugcucaacaauuucuacccgcgcgaggcuaaaguucaguggaagguggacaacgcccugcagucuggcaauagccaagaauccgucaccgagcaggauagcaaggacucuacauauucccugagcucuacccucacgcugagcaaagcggauuacgagaagcacaaaguguacgccugugaaguuacacaucagggccuuuccucucccgugaccaagagcuuuaacagaggggagugc

SEQ ID NO: 39227 - RNA, 1344 nt, Artificial Sequence
  derived and/or modified sequence opt5 from Lacnotuzumab_HeavyChain
caggugcagcugcaggagagcggccccgggcucgucaagccuucccagacccugucucuuacaugcacgguuagcgacuacuccaucaccucugauuaugccuggaacuggauuagacaguucccgggaaaaggccuggaauggaugggguacaucagcuauuccggaucuacaagcuacaaucccucccucaagagccggauuaccaucucucgcgacacauccaaaaaccaauuuagccugcagcuuaauucugugaccgcugccgauacagcgguguauuacugugcuuccuucgacuaugcccacgccauggauuacuggggccaggggaccacggucaccgugagcucugcuuccacaaagggaccuagcguuuuuccccuggccccuuccucuaaaagcaccuccggcggcacagcugcccucgggugccuggugaaggacuacuuccccgagccugucaccgugagcuggaacucuggagcgcugacguccggcguucauacauuuccggccgugcuccagagcucugggcuguauagccuuuccucugucgugaccgugcccagcuccagccugggaacacaaaccuacauuuguaaugucaaccacaagccuucuaauaccaaaguugauaagagaguggaacccaaauccugcgacaagacacauacguguccucccugcccggcuccugagcuccugggcgggcccagcguguuccuuuuuccucccaaacccaaggauacccugaugaucucucggacaccugaagucaccugugugguuguggacgucucccacgaggauccggaggugaaguucaacugguauguugacggaguggaaguccauaaugccaaaacaaagccccgcgaggaacaguacaacagcaccuauagaguggucuccgugcucacgguucugcaccaggauuggcugaauggcaaagaguacaagugcaaagugucuaacaaggcucucccugcccccaucgagaaaacaauuagcaaggcgaagggccagccucgggaaccccaagucuauacccugccgccuucccgcgaggaaaugaccaaaaaucaggugucucuuacaugucugguuaagggguuuuaccccagcgacaucgccguggagugggaauccaacggacagccugagaauaacuacaaaaccacacccccuguccucgacagcgauggcucuuucuuucuguauuccaaacuuacgguggacaagagcagauggcaacaggggaacguguucucuugcuccguuaugcacgaggcucugcauaaucacuacacccaaaagagccucucucugagccccggaaag

SEQ ID NO: 39228 - RNA, 642 nt, Artificial Sequence
  derived and/or modified sequence opt5 from Lacnotuzumab_LightChain
gacaucgugcugacccagagccccgccuuccucuccgucacaccuggcgagaagguuacguuuaccugccaagcuagccagagcauugggacauccauccacugguaccagcagaaaaccgaucaagccccgaagcugcuuauuaaauaugcgucugaaagcaucuccggcauucccucuagauucagcggauccgggagcggaacagacuuuacccugacaaucucuuccguggaggcugaagaugccgccgacuacuauugucagcagaucaacagcuggccuaccacguucggcgggggaaccaagcucgagauuaaacggacaguggcugcccccucugucuuuaucuucccucccuccgaugaacagcugaagucuggcaccgcuucugugguuugccuucugaauaacuuuuacccucgcgaggccaaggugcaauggaaagucgacaaugcgcuccaguccggcaacagccaggaguccgugacagaacaggauucuaaggacagcaccuauucccugagcucuacgcugacacucuccaaagccgauuacgagaagcauaaaguuuaugcuugugaagugacccaccaagggcugagcucuccggucacaaagagcuucaauagaggagagugc

SEQ ID NO: 39229 - RNA, 1347 nt, Artificial Sequence
  derived and/or modified sequence opt5 from Larcaviximab_HeavyChain
gaggugcagcugcaagaaagcggccccgagcucgaaaugccuggggccuccgucaagaucucuugcaaagcuagcggauccucuuucaccggcuuuagcaugaacuggguuaagcaguccaaugggaaaucucuggaguggauuggaaacaucgacacauacuauggcgggacgaccuacaaucagaaguucaaaggaaaggccacacuuaccguggauaagagcuccagcacagcguauaugcagcugaaaucucucaccuccgaagacagcgcuguguacuauugugccagaucugccuacuauggcuccacauuugcuuacuggggccaagggacccuggucacggugagcgccgcuucuaccaagggaccguccguuuucccccuugccccuagcuccaaaucuacaagcggcgggaccgcggcccugggaugccucgugaaggauuacuuucccgagccugucacaguguccuggaacagcggcgcucugaccucugggguucacacguuccccgccgugcugcaguccagcggacucuauucucugagcuccgucgugacagugccuucuagcucccuuggcacccagacauacauuuguaaugucaaccauaaaccgagcaauaccaagguugacaagcggguggagcccaaaucuugcgauaagacccacacauguccucccugcccugcucccgaacugcucggcgggccguccguguuucuguucccucccaaaccuaaggacacgcuuaugaucagccgcacccccgaggucacaugugugguuguggaugucucucaugaagaccccgaggugaaauuuaacugguauguugauggaguggagguccacaaugccaagaccaaaccuagagaggaacaguacaacuccacauaucggguggucagcgugcugaccguucuccaucaagacuggcugaauggcaaggaauacaagugcaaaguguccaacaaggcgcugccggcccccauugagaaaacgaucucuaaggcuaaagggcagccucgcgaaccccaggucuauacacucccucccagcagagaugagcugaccaagaaucaggugucccuuaccugucugguuaagggauucuacccgucugacaucgccguggagugggaaagcaacggccaaccugagaauaacuacaaaacaacacccccuguccucgauuccgacgggagcuuuuuccuguauucuaaacuuaccguggacaagucccgguggcagcagggaaacguguuuagcugcucuguuaugcacgaagcucugcacaaucauuacacgcaaaagucccucagccugucucccggcaaa

SEQ ID NO: 39230 - RNA, 642 nt, Artificial Sequence
  derived and/or modified sequence opt5 from Larcaviximab_LightChain
gacauccagaugacccaaagccccgccagccugucugcuagcgugggcgagacagucacgauuaccugcagagccuccgaaaacaucuacucuuaucucgcgugguaccagcagaagcaggggaaaagcccucaacugcuuguuuauaaugcuaagacacugauugagggagugccgucccgguucucuggcagcggguccggaacccaguuuagccucaaaaucaacucucugcagcccgaagauuucggcuccuacuuuugucagcaccauuucgggacaccuuuuaccuucggaagcggcacagagcuugaaauuaagcgcaccguggccgcccccucugucuuuaucuucccucccuccgacgagcaacugaaaagcggcacggcuucugugguuugccuccugaauaacuuuuauccuagagaggccaaggugcaguggaaggucgauaaugcucugcaguccgggaacagccaggaauccgugaccgagcaagacucuaaagauagcacauacucccucagcucuacccugacacuuuccaaggccgacuaugaaaaacacaagguuuacgcgugugaggugacccaucagggacugagcucuccggucacgaaauccuucaaucggggcgagugc

SEQ ID NO: 39231 - RNA, 1338 nt, Artificial Sequence
  derived and/or modified sequence opt5 from Lendalizumab_HeavyChain
caggugcagcugguccagagcggcgccgagguuaagaaacccggggcuuccgugaaggugucuugcaaagccagcggauacaccuucacagacuauuccauggauugggucagacaggcgccuggccaggggcucgaauggaugggagcuauccaccugaacacgggcuacaccaauuauaaccaaaaguuuaaagggcgggugacaaugacccgcgacacaucuaccagcacaguuuacauggagcuuuccucucugagaagcgaagauaccgccguguauuacugugcccggggauucuaugacggcuacuccccgauggauuacuggggccaggggacgaccgucacagugagcucugcuuccaccaagggacccagcguuuuuccucucgcccccugcucucgcuccacaagcgagucuaccgcugcccugggcugucuugugaaggacuauuucccugaacccgucacgguguccuggaauagcggggcgcugacauccggagugcauaccuuuccugccguccuccagucuagcggccuguacucccugagcucuguugugacagugccguccagcaacuucgggacccagaccuauacaugcaaugucgaucacaaacccucuaacacgaagguggacaaaaccguugagagaaaguguugcguggaguguccucccugcccugcucccccggucgccggaccuagcguguuucucuuucccccuaaacccaaggauacacugaugauuucccggacccccgaaguuacauguguggucguggacgucucucaagaggauccugaagugcaguucaauugguacguugacggcguggagguccauaacgcuaagaccaaaccgcgcgaggaacaguucaauagcacguauagagugguuuccgugcuuacaguccugcaccaggauuggcucaacggcaaggaguacaaaugcaaggugagcaauaaagggcugcccucuuccaucgaaaagaccauuagcaaagccaagggacaaccucgggagccccagguguauacccuuccucccucucaggaagagaugacaaagaaccaaguuucccugaccugucucgucaaaggcuuuuacccgagcgacaucgcgguggagugggaauccaaugggcagccugagaacaauuacaagacaacgcccccugugcuggacucugauggcagcuucuuucuguauucccgccucaccgucgacaaaucuagauggcaggaaggaaacguguucagcugcuccguuaugcaugaggcccugcacaaccacuacacacaaaagagccuuucucugucccucgggaaa

SEQ ID NO: 39232 - RNA, 654 nt, Artificial Sequence
  derived and/or modified sequence opt5 from Lendalizumab_LightChain
gacauccagaugacccaaagccccagcucucugagcgccuccgugggcgauagagucacaauuacgugccgggcuucugagagcguugacuccuacgggaacucuuucaugcacugguaucagcagaagccuggaaaagccccgaagcuccugaucuaccgcgcgagcaaucuugaauccggcgugcccagcagauuuucuggguccggaagcggcaccgauuucacacugaccauuucuucccuccagccugaggacuuugcuacauauuacugucaacagagcaacgaagaucccuauaccuucgggggaggcacaaaaguggagaucaagcggaccgucgccgccccuucuguguuuauuuuucccccuuccgacgaacagcugaaaagcggcacggcuuccguugugugccuucugaauaacuucuacccgcgcgaggccaagguccaguggaagguggauaaugcucuccaaucugggaacagccaggaguccguuaccgaacaggacagcaaagauucuacauauucccugagcucuacccugacacucagcaaggccgacuacgagaaacauaagguguacgcgugugaagucacccaccagggacuguccucucccgugacgaaauccuucaauagaggcgagugc

SEQ ID NO: 39233 - RNA, 1359 nt, Artificial Sequence
  derived and/or modified sequence opt5 from Lesofavumab_HeavyChain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggagagcgaaacaauuuacucccccucuuuucagggacaagucacgaucagcgcugacaacuccauuagcaccgccuaucuucaguggucuucccugaaagcgagcgauacagcuaucuacuauugugccucuggcccuggcuacuccggguaucacuacggaugguucgacaccuggggccaggggacacucgugaccguuagcucugccuccacaaagggacccagcguguuuccucuggcucccuccucuaagagcaccuccggcgggacggccgcucuuggaugccuggucaaagauuacuucccugagccggugaccguuagcuggaauagcggcgcccucacauccggcgugcauaccuuucccgcgguccugcagagcucugggcuguauagccucuccucuguggugacagucccuagcuccagccugggaacccaaacguacaucuguaacguuaaucacaagcccucuaacacaaaaguggacaagaaaguggagccuaaguccugcgauaagacccauacaugucccccgugcccugcccccgaacuucugggcgggccuagcgucuuccucuuuccucccaaacccaaggacacccugaugauuucucggaccccggaggugacauguguuguggucgaugugucccacgaagaccccgagguuaaauucaauugguauguggauggagucgaggugcauaacgcuaagacgaaaccucgcgaggaacaguacaauagcaccuauagagucguguccguucuuacagugcugcaccaggacuggcucaacggcaaggaauacaaaugcaaggucucuaauaaggcccugcccgcuccuaucgagaaaaccauuagcaaggccaaagggcagccccgggaaccgcaaguguauacacugccucccucccgcgaggagaugaccaagaaccagguuucucucacgugucuggugaaaggauuuuacccuagcgauaucgcggucgaaugggaguccaauggccagcccgaaaacaauuacaagacaaccccucccgugcuugacagcgauggcucuuucuuucuguauuccaagcucaccguggacaaaagcagauggcaacaggggaacguuuucucuugcuccgucaugcacgaggcccugcauaaucacuacacacagaagucucuuucucugagcccgggaaaa

SEQ ID NO: 39234 - RNA, 657 nt, Artificial Sequence
  derived and/or modified sequence opt5 from Lesofavumab_LightChain
gacaucgugaugacccagagcccccugucccucccugucacaccgggcgagcccgccucuauuagcugccgguccucucaaagccugcuucgguccaacggguacaauuaucuggauugguaccuccagaagccuggacagucuccccagcugcuuaucuaucugggcagcaaccgcgcuuccgggguuccugacagauucagcggaucuggcuccgggacggauuuuacccucaaaauuagccggguggaagccgaggacgugggagucuacuauuguaugcaagcgcugcagacacccuacaccuucggccagggcacaaagcuggaaaucaaacgcaccguggcugccccuucuguuuuuauuuucccgcccuccgaugagcagcucaagagcgggacagccucuguggucugccugcuuaauaacuuuuauccuagagaagcuaaagugcaauggaagguugacaaugcccugcaguccggaaacagccaggaguccgugaccgagcaggauucuaaggacagcacguacucccucagcucuacccugacacuuuccaaagcugauuacgaaaagcacaaagucuaugccugugaggugacccaucaaggccugagcucucccgugacaaagagcuucaauagaggggaaugc

SEQ ID NO: 39235 - RNA, 1059 nt, Artificial Sequence
  derived and/or modified sequence opt5 from Letolizumab_HeavyChain
gaggugcagcugcucgaaagcggcgggggacugguccaacccggcgggucccuuagacugucuugcgccgcuagcggauucaccuuuaacugggagcucaugggcugggcccggcaggcgccugggaagggacuggaauggguuuccggcaucgagggcccgggggacgugacauacuaugcugauucugugaaaggacgcuucacgauuagcagagacaauuccaagaacacccuuuaccugcagaugaacucucuccgggccgaagauacagccgucuauuacugugugaaaguuggcaaggacgcuaaaagcgauuaucgcgggcagggaacccuggugacagucuccagcgccucuaccgagcccaaguccagcgacaagacacacaccucuccucccuccccugcucccgagcugcucggcgggagcucuguguuucuguucccuccgaaacccaaggauacgcuuaugaucuccagaaccccugaaguuacaugcguggucguggacgugagccaugaggaucccgaagucaaauuuaauugguacguugacggaguggaggugcacaaugccaagaccaaaccucgggaggaacaauauaacuccacauaccgcgucgugucuguucugaccgugcuccaucaggauuggcugaauggcaaggaguacaaguguaaagucagcaacaaggcgcuucccgccccgauugaaaagacgaucuccaaggcuaaaggccagccuagagagccccagguguauacacugccucccagccgggacgaacucaccaagaaucaaguuucucugacaugccuggugaaaggguucuaccccuccgauauugccgucgagugggagagcaacggacagccugaaaauaacuauaagaccaccccgcccgugcucgacucugacggcagcuuuuuccuguacuccaaacuuacagucgauaaaucucgcuggcagcaggggaauguguuuagcuguuccguuaugcacgaggcucugcauaaccacuauacgcaaaagagccucucucuguccccuggaaaa

SEQ ID NO: 39236 - RNA, 1338 nt, Artificial Sequence
  derived and/or modified sequence opt5 from Losatuxizumab_HeavyChain
gaggugcagcugcaagaaagcggccccgggcucgucaagccuucccagacccugucucuuacaugcacgguuagcggauacuccaucucuagagacuucgccuggaacuggauucggcagccgcccggcaaagggcuggaguggaugggauauaucagcuacaauggcaacacccgcuaucagccuucccucaagucuagaauuacaaucagccgggauaccuccaaaaaucaauuuuuccugaaacuuaacagcgugacagcugccgacaccgcgacauacuauugugugaccgcuucucgcggguuucccuacuggggacagggcacgcuggucaccguguccagcgccucuacaaagggcccuuccguuuucccccucgccccuagcucuaaguccaccagcgggggaacagcugcccugggcugccuggugaaggauuauuuuccggaacccgucaccguguccuggaacucuggggcucucacgagcggaguucacacauucccugccgugcugcaguccagcggccuuuacucucuguccagcgucgugaccgugcccucuagcucccucgggacacagaccuacauuuguaaugucaaucauaaaccuucuaacaccaagguugacaaaaagguggagcccaaaagcugcgauaagacacacacguguccgccuugccccgcgccugaacugcuuggaggccccuccguguuucuguuucccccuaagccgaaagacacccucaugaucagcagaacacccgaggucaccugugugguuguggaugucucucaugaggacccugaagugaaguuuaauugguauguugauggcguggagguccacaacgccaaaacaaagccccgggaggaacaauacaauuccaccuaucgcguggucagcgugcugacgguucugcaucaggacuggcucaacgggaaagaguacaagugcaaagugucuaauaaggcucugccugcccccaucgaaaagacaauuuccaaagcuaagggacagccgagagagccucaggucuauacccuucccccuagccgggaagagaugaccaaaaaccaagugucccugacaugucucguuaagggcuucuaccccucugauaucgccguggaaugggagagcaaugggcagccugagaacaacuauaaaaccacacccccgguccuggacuccgauggaucuuucuuccuuuacagcaagcugacgguggacaagucccgcuggcagcaaggcaauguguuuagcugcucuguuaugcacgaagcgcuccacaaccauuacacccagaaaucccugagccugucuccugggaag

SEQ ID NO: 39237 - RNA, 642 nt, Artificial Sequence; identical to SEQ ID NO: 38415
  derived and/or modified sequence opt5 from Losatuxizumab_LightChain

SEQ ID NO: 39238 - RNA, 1338 nt, Artificial Sequence
  derived and/or modified sequence opt5 from Lupartumab_HeavyChain
gaggugcagcugcucgaaagcggcgggggacugguccaacccggcgggucccuuagacugucuugcgccgcuagcggauucaccuuuuccaacgccuggaugucuuggguucggcaggcgccuggcaaggggcucgagugggugagcuacaucuccucuagcggauccacaauuuauuacgcugacagcgugaaaggccgcuucacgaucucuagagauaauuccaagaacacccuguaucuucagaugaauagccugcgggccgaagacacagccgucuacuauugugcucgcgagggccucugggccuuugauuacugggggcagggaacccuggugacaguuucuuccgcuagcaccaaaggcccgucuguguucccccuggccccuuccagcaaguccacaucugggggaaccgcggcccucggcugccuggucaaagacuauuuucccgaaccugugacgguuagcuggaacuccggggcucuuaccagcggagugcacacauuccccgccguccugcaaucuuccggccucuacagccugucuagcguggugaccgucccuuccucuagccuuggcacacagaccuacauuuguaauguuaaccauaagccguccaauacgaagguggauaaaaagguggagcccaaaagcugcgacaagacacacaccuguccucccugcccugcucccgagcugcucgggggaccgucugucuuucuguucccucccaaaccuaaggauacacugaugaucuccagaacccccgaagugaccuguguuguggucgacgugagccaugaggaucccgaaguuaaguuuaacugguauguggacggcgucgaggugcacaaugccaaaacaaagccucgggaggaacaguacaacucuacguaucgcgucguguccguucucaccgugcugcaucaggauuggcuuaaugggaaagaguacaagugcaaagucagcaacaaggcgcugccggcccccauugagaaaacaaucuccaaggcuaagggacaaccuagagaaccccagguguauacccucccucccucucgggacgaacugaccaaaaaucagguuagccuuacaugucuggugaagggcuucuacccguccgauaucgccgucgagugggagucuaacgggcagccugaaaauaacuauaaaacgacacccccugugcucgacagcgacggauccuuuuuccuguacagcaagcugaccguggauaaaucucgcuggcaacagggcaacgucuuuuccugcagcguuaugcacgaggcucuccacaaucauuacacccagaagucucugucccuuagccccggc

SEQ ID NO: 39239 - RNA, 651 nt, Artificial Sequence
  derived and/or modified sequence opt5 from Lupartumab_LightChain
gagagcgugcugacccagcccccuuccgucucuggcgccccggggcaaagaguuacaaucagcugcacgggauccucuagcaacauuggcgcuggguacguggugcacugguaucagcagcuccccggaaccgccccuaagcugcuuaucuacgacaauaacaaacggcccuccggcgucccugaucgcuucucugggagcaaguccggaacaagcgcgucucuggcuauuuccggccucagaagcgaagacgaggccgauuauuacugugccgcuugggacgaucggcugaauggccccguguuugggggaggcaccaaacuuacaguucuggggcagccuaaggccgcuccgucugugacccucuuucccccuuccagcgaggaacugcaagccaacaaagcgacacuggucugccucaucucugacuucuaucccggagccgugaccguugcuuggaaggccgauuccagcccugugaaggcuggcgucgaaacgaccacacccuccaaacagucuaauaacaaguacgccgcgagcuccuaucugagccuuaccccggagcaguggaaaucucaucgcuccuacagcugucaggugacacacgaggggucuaccguggaaaagacggucgccccuacagagugcagc

SEQ ID NO: 39240 - RNA, 1731 nt, Artificial Sequence
  derived and/or modified sequence opt5 from Lutikizumab_HeavyChain
gaggugcagcuggucgaaagcggcgggggaguugugcaacccggcagaucccuccggcugucuugcagcgccuccggguucaucuuuucucgcuacgacaugagcugggugagacaggcuccuggaaagggccuugagugggucgccuauauuucccacgggggagcgggcaccuacuauccggauucugugaaaggccgguucacaaucagccgcgacaacuccaagaauacgcuguuucuccagauggauagccugagacccgaagacaccgggguuuacuucugugcucggggaggcgugacaaaaggguauuuugaugucuggggacagggcaccccugugacaguuucuuccgccagcaccaaggggccccaagugcagcuugucgagucuggaggcggcguggugcagccugggcgcucccugagacucagcugcacagccucuggauucaccuuuuccauguucggcguccauuggguucggcaggcucccgggaaaggacuggaauggguggccgcugugagcuacgacggcuccaacaaguauuacgccgagucugucaaggggcgcuuuacgauuagcagagauaauuccaaaaacauccuguuccuccaaauggacagccugcggcuugaggauaccgcgguguacuauugugcccgcggaagaccuaagguugugauuccggcuccccuggcccacuggggccagggcacacucgucaccuuuucuuccgcuagcacaaaagggccuucuguguucccccuggccccuagcuccaagucuaccagcggaggcacggcggcccuugggugccugguuaaagacuacuuucccgaaccggugacagucuccuggaauagcggagcucucaccucuggcgugcauacauucccugccguccugcaguccagcgggcuguauucucucuccagcgugguuaccgugcccuccucuagccugggcacccagacauacaucuguaacgucaaucacaagccuuccaacacgaagguggauaaaaagguugagcccaaaucuugcgacaagacccauacaugucccccuugcccggcucccgaagccgccggaggcccuagcguguuccuuuuucccccuaaacccaaggauacccugaugaucucccggacaccggaggucaccuguguggugguugacgucagccacgaggacccugaagugaaauucaauugguauguggauggggucgaggugcacaacgcuaagacgaagccccgcgaggaacaauacaauucuacauauagaguuguguccguccucaccgugcugcaucaggacuggcuuaacggaaaagaauacaagugcaaaguuagcaauaaggcgcugccugcccccauugagaaaaccaucucuaaggcuaagggccagccucgggagccccaaguguacacacucccgccuuccagagaagagaugaccaaaaaccaggucagccugacaugucuggugaagggguuuuaucccucugauauugccguugaaugggagagcaauggacagcccgaaaacaacuacaaaacgaccccuccggugcucgacuccgauggcagcuucuuucuguauucuaaacuuacagucgacaagucccgcuggcagcaagggaauguguucagcugcuccgugaugcacgaggcccugcauaaccacuacacccagaagucucucagccugucccccggcaag

SEQ ID NO: 39241 - RNA, 981 nt, Artificial Sequence
  derived and/or modified sequence opt5 from Lutikizumab_LightChain
gacauccagaugacccaaagccccuccucucugagcgccuccgugggcgauagagucacaauuacgugccgggcuucugggaacauccacaauuaccucaccugguaucagcagacaccuggaaaggccccgaaacugcuuauuuacaacgcgaagacccuggcugacggcguucccagccgcuucuccgggucuggaagcggcacagauuauaccuuuacaaucuccagccuccagccugaggacauugccaccuacuauugucaacauuucuggucuauccccuacacguuugggcagggaaccaaacugcagaucacaagaaccguggccgcuccugauauucagaugacacaaucccccagcucuguguccgccagcgucggcgaccgggugaccaucacgugccgcgcuucucagggcauuuccagcuggcuugccugguaucagcagaagccugggaaagcgccgaagcugcucaucuacgaagccuccaaucuggagacaggaguucccucuagauucagcggcuccgggagcggaucugauuuuacccugacaauuuccagccuccaaccugaagacuucgcuaccuacuauugucagcagaccucuagcuuucugcuuuccuucggcgggggaacaaagguggagcacaaacggacggucgccgcucccucuguguuuaucuucccucccagcgaugaacaacugaaguccggcaccgccagcguugugugccuccugaacaauuuuuacccgcgcgaggcgaaaguccaguggaagguggacaacgcccuucagucuggcaauucccaggagagcgugacagaacaagauucuaaagacuccaccuauagccuguccucuacacucacccugagcaaggcugauuacgagaagcauaaagucuaugccugugaaguuacgcaccaggggcuguccucuccugugacaaagagcuucaacagaggagagugc

SEQ ID NO: 39242 - RNA, 1341 nt, Artificial Sequence
  derived and/or modified sequence opt5 from Oleclumab_HeavyChain
gaggugcagcugcucgaaagcggcgggggacugguccaacccggcgggucccuuagacugucuugcgccgcuagcggauucaccuuuuccucuuacgccuauagcuggguucggcaggcgccuggcaaggggcucgaguggguguccgcuaucucuggaagcggcggccgcacauacuaugccgacuccgugaaagggagauucacgauuagccgggauaacucuaagaauacccuguaccuucagaugaacucccugcgcgccgaagacacagcugucuauuacugugccagacucggauauggccggguggaugagugggggcgcggaacccugguuacagugagcucugcuuccaccaaaggcccgagcgucuuuccccuggccccuucuuccaagagcacauccgggggaaccgcggcccucggcugccuggugaaagacuacuuccccgaaccuguuacggugucuuggaauagcggcgcucuuaccuccgggguccacacauuucccgccgugcugcagagcucuggacucuacucccugagcucuguggucaccguuccuagcuccucucuuggcacacaaaccuauaucuguaacgugaaucauaagccgagcaacacgaagguggauaaaagagucgagcccaaguccugcgacaaaacacacaccuguccucccugcccugcucccgaguucgaagggggaccgagcguguuucuguucccucccaagccuaaagauacacucaugauuucucggacccccgagguuaccuguguggucguggacguuucccaugaagaucccgaggugaaguuuaauugguacgucgacggcguggagguccacaacgccaagacaaaaccucgcgaggaacaguauaauagcacguacagagugguuucugugcugaccguccugcaucaggauuggcucaacgggaaggaauauaaaugcaagguguccaauaaagcgcugccggccagcaucgagaagacaauuuccaaagcuaagggacagccccgggaaccucaaguuuacacccuucccccuucucgcgaggagaugacaaagaaccaggugagccugaccugucucgucaaaggcuucuaucccuccgacaucgccguggaaugggagucuaauggccagccggaaaacaauuacaagacgacaccucccgugcuggauagcgacggguccuuuuuccuuuacagcaaacugaccguugacaagucuagauggcagcaaggaaacgucuuuuccugcagcgugaugcacgaggcucuccacaaccauuauacccagaaaucucugucccugagcccuggcaag

SEQ ID NO: 39243 - RNA, 648 nt, Artificial Sequence
  derived and/or modified sequence opt5 from Oleclumab_LightChain
cagagcgugcugacccaacccccuuccgccucuggcacaccggggcagagagucacgaucagcugcuccggaucucucagcaacauuggccggaaucccguuaacugguaccagcagcugccugggaccgcucccaaacuucugaucuaucucgacaaucugcgccuuuccggagugccugauagauucucuggcagcaaguccgggacaagcgccucucuggcgauuuccggacuccaaagcgaggacgaagcugauuacuauugugccaccugggacgauucucaccccggcuggacauuuggcgggggaaccaagcugacagugcugggccagccuaaagccgcuccguccgucacccucuuucccccuagcucugaggaacugcaggccaacaaggcuacgcuugugugccugaucuccgacuucuaccccggggccguuaccguggcguggaaagccgauagcuccccugucaaggcuggaguggagacaaccacacccucuaagcagagcaauaacaaauaugccgcuuccagcuaccucucucugaccccggaacaauggaagucccaucggagcuauucuugucagguuacgcacgagggcagcacaguggagaaaaccgucgccccuacagaaugcucc

SEQ ID NO: 39244 - RNA, 1449 nt, Artificial Sequence; identical to SEQ ID NO: 38859
  derived and/or modified sequence opt5 from Otlertuzumab_HeavyChain

SEQ ID NO: 39245 - RNA, 339 nt, Artificial Sequence
  derived and/or modified sequence opt5 from Ozoralizumab_HeavyChain
gaggugcagcuggucgaaagcggcgggggacucguucaacccggcgggucccugagacuuucuugcgccgcuagcggauucaccuuuuccgacuacuggauguauugggugcggcaggccccuggcaaggggcuggagugggugucugaaaucaacacaaauggacucauuacgaaauacccggauagcgucaagggccgcuucaccaucuccagagacaacgcgaaaaauacacuguaucuucagaugaacucucugcggcccgaggauaccgcuguguacuauugugcccgcagcccuuccggcuuuaauagagggcagggaacacucguuaccgug

SEQ ID NO: 39246 - RNA, 1089 nt, Artificial Sequence; identical to SEQ ID NO: 38864
  derived and/or modified sequence opt5 from Ozoralizumab_HeavyChain_HeavyChain_HeavyChain

SEQ ID NO: 39247 - RNA, 1494 nt, Artificial Sequence
  derived and/or modified sequence opt5 from Pasotuxizumab_HeavyChain_LightChain_HeavyChain_LightChain
caggugcaacuggucgagagcggcgggggacucguuaagcccggcgaaucccugagacuuucuugcgccgcuagcggguucaccuuuuccgacuacuauauguacugggugcggcaggccccuggaaaaggccuggaguggguggcgaucauuucugaugggggauauuacacauauuacagcgacaucauuaagggccgcuucacgaucuccagagauaacgcuaaaaauucucucuaucugcagaugaacagccuuaaggccgaagacaccgccgucuacuacugugcucggggcuuuccgcugcuccgccacggggccauggauuauuggggacagggcacacuggugaccguuuccagcgggggaggcgggucuggaggcggcggguccggaggcgggggaagcgacauucaaaugacacagucucccuccagccugucugcuuccgugggcgauagagucaccaucacaugcaaagccagccagaauguggacaccaacguugcgugguaccagcaaaagccugggcaggcccccaagucccucaucuauucugcuagcuaccgguauuccgaugugccuagccgcuucucuggauccgccagcggcacggacuuuacccugacaauuucuagcguccaguccgaggauuucgcuaccuacuauugucagcaauacgacucuuaccccuauacauuuggcgggggaaccaaacuugaaaucaagagcggcgggggaggcuccgaggugcagcugguggagagcgggggcggacucguccagccuggcgggucucugaaacuuuccugcgccgcgagcggauucacguuuaauaaguacgccaugaacuggguuagacaagcuccgggcaaagggcuggaauggguggcccggauucgcucuaaguauaauaacuacgcuacauauuacgccgauuccgugaaggacagauucaccaucagccgggacgauuccaaaaauacagccuaucuccagaugaacaaucugaagaccgaggacaccgcugucuacuacugugugcgccauggaaacuuuggcaauucuuauauuagcuacugggcguauugggggcagggcacacugguuacgguguccucuggaggcgggggaagcggcgggggaggcuccgggggcggaggcagccagaccgucgugacacaagaacccucucucaccguuuccccugggggaacagugacccugacgugcggcagcucuacaggggccgucaccuccggaaacuaccccaauugggugcagcagaaaccuggccaggcucccagagggcuuaucggcggaaccaaguuccuggccccgggcaccccugcccgguuuagcgggucucuccugggaggcaaagcugcccuuacacugagcgggguccaacccgaggaugaggcggaauauuacugugugcucugguauuccaaccgcuggguuuucggaggcggcacaaagcugacggugcug

SEQ ID NO: 39248 - RNA, 357 nt, Artificial Sequence
  derived and/or modified sequence opt5 from Pasotuxizumab_HeavyChain1
caggugcaacuggucgagagcggcgggggacucguuaagcccggcgaaucccugagacuuucuugcgccgcuagcggguucaccuuuuccgacuacuauauguacugggugcggcaggccccuggaaaaggccuggaguggguggcgaucauuucugaugggggauauuacacauauuacagcgacaucauuaagggccgcuucacgaucuccagagauaacgcuaaaaauucucucuaucugcagaugaacagccuuaaggccgaagacaccgccgucuacuacugugcucggggcuuuccgcugcuccgccacggggccauggauuauuggggacagggcacacuggugaccguu

SEQ ID NO: 39249 - RNA, 369 nt, Artificial Sequence
  derived and/or modified sequence opt5 from Pasotuxizumab_HeavyChain2
gaggugcagcuggucgaaagcggcgggggacucguucaacccggcgggucccugaaacuuucuugcgccgcuagcggauucaccuuuaacaaguacgccaugaauugggugagacaggcgccuggcaaggggcuggaguggguggcucggauccgcuccaaauauaacaauuacgccacauauuacgccgacucugucaaggauagauucacgauuagccgggacgauuccaaaaacaccgcuuaucuccagaugaauaaccugaagacagaagacaccgccguguacuauuguguucgccacggaaauuuuggcaacucuuacaucagcuacugggcuuauuggggccaggggacacuugugaccguc

SEQ ID NO: 39250 - RNA, 321 nt, Artificial Sequence
  derived and/or modified sequence opt5 from Pasotuxizumab_LightChain1
gacauccagaugacccaaagccccuccucucugagcgccuccgugggcgauagagucacaauuacgugcaaggcuucucagaacguugacaccaauguggccugguaccagcagaaaccugggcaagcgcccaagagccucaucuauuccgcuucuuaccgguauagcgaugugccgucccgcuucagcggaucugccuccggcacagacuuuacccugacaauuagcucuguccaguccgaggauuucgccaccuacuauugucagcaguacgacagcuauccuuacacauuugggggaggcaccaaacuugaaaucaag

SEQ ID NO: 39251 - RNA, 327 nt, Artificial Sequence
  derived and/or modified sequence opt5 from Pasotuxizumab_LightChain2
cagaccguggucacacaagagcccagccugacgguuuccccuggcgggaccgugacacugaccugcggaucuagcacaggcgccgugaccuccgggaacuacccgaauuggguccagcagaagcccggacaggcuccuagaggccucaucgggggaacaaaauuccuugcccccggcaccccugcgcgguuuucuggcagccugcucgggggaaaggcugcccugacgcuuuccggcgugcaacccgaagacgaggccgaauauuacuguguucugugguauucuaaccgcuggguguucgggggaggcaccaaacucacaguccug

SEQ ID NO: 39252 - RNA, 1023 nt, Artificial Sequence; identical to SEQ ID NO: 38908
  derived and/or modified sequence opt5 from Placulumab_HeavyChain

SEQ ID NO: 39253 - RNA, 1353 nt, Artificial Sequence
  derived and/or modified sequence opt5 from Porgaviximab_HeavyChain
gaggugcagcugcaagaaagcggcgggggacucaugcagcccggcggguccaugaagcugucuugcgucgccagcggauucaccuuuuccaacuacuggaugaauuggguuagacagucuccugagaaaggccuugaauggguggcugagauccggcugaaguccaacaauuaugccacacacuacgcggaauccgugaaagggcgcuucacgauuucuagagacgauagcaagcgguccgucuaucuccagaugaacacccugcgcgcugaggacacaggaaucuacuauuguaccagaggcaauggcaacuaccgggccauggauuauugggggcaaggaacaagcgugaccguuucuuccgccagcacaaaaggcccgucuguguuuccccuugcuccuuccagcaagucuaccuccgggggaacggccgcucugggcugccucgucaaggacuacuuccccgagccugugaccguuagcuggaauagcggggcccugacaucuggagugcauaccuuucccgcgguccugcagagcuccggccucuacagccugucuuccguggugacagucccuagcucuagccuuggcacccagacguauauuuguaacguuaaucacaaaccguccaacacaaagguggauaaacgcguggaacccaagucuugcgacaaaacccauacauguccucccugcccugcccccgagcugcucgggggaccgagcgucuuccuguuuccucccaagccuaaggauacccuuaugaucuccagaacccccgaagugacauguguuguggucgacgugagccacgaggaucccgagguuaaauucaauugguacguggacggcgucgaagugcauaacgcuaagacgaaaccucgggaggaacaguauaauucuaccuaccgcgucguguccguucugacagugcuccaccaagauuggcugaacgggaaggaguauaaaugcaaggucagcaauaaagcccugccggcucccauugaaaagaccaucucuaaggccaaaggacagccuagagagccccagguguacacacucccucccucccgggacgagcugaccaagaaccagguuagccuuacgugucuggugaaaggcuuuuauccguccgauaucgcggucgaaugggagucuaacgggcaaccugaaaauaacuacaagacaacacccccugugcucgacagcgacggauccuucuuucuguacucuaaacuuaccguggauaagagccgcuggcagcagggcaauguuuucuccugcagcgucaugcacgaggcccugcauaaccacuauacccaaaagucucucucccugagccccggcaaa

SEQ ID NO: 39254 - RNA, 642 nt, Artificial Sequence
  derived and/or modified sequence opt5 from Porgaviximab_LightChain
gacauccagaugacccaaagccccgccucccugucugugagcgucggcgagacaguuuccauuacgugccgggcuucugaaaacaucuacagcucccucgccugguaucagcagaagcaggggaaaucuccucaacugcuuguguacagcgcgaccauucuggcugauggagugccgucccgguucagcggcucuggguccggaacacaguauagccucaagaucaauucucugcaguccgaggacuuuggcaccuacuauugucagcacuucugggggacacccuacaccuuuggaggcggcacaaaacuugaaauuaagcgcaccgucgccgccccuagcguguucaucuuucccccuucugaugagcaacugaaauccgggacggcuagcguugugugccuccugaacaauuucuaucccagagaagccaagguccaguggaagguggacaacgcucugcaguccggaaauucucaggagagcguuaccgagcaagauuccaaagacagcacauacucucucuccagcacccugacacuuucuaaggccgauuacgaaaaacauaagguguaugcgugugaggucacccaccagggccugagcuccccugugacgaaaucuuuuaacagaggggaaugc

SEQ ID NO: 39255 - RNA, 1341 nt, Artificial Sequence
  derived and/or modified sequence opt5 from Prezalumab_HeavyChain
gaggugcagcuggucgaaagcggcgggggacucguucaacccggcgggucccugagacuuucuugcgccgcuagcggauucaccuuuuccucuuacuggaugagcugggugcggcaggccccuggcaaggggcuggaguggguggcguauaucaaacaggacggaaacgaaaaguacuaugucgauuccgugaaaggccgcuucacaauuucuagagacaaugcuaagaacagccucuaccugcagaugaacucccuucgggccgaggauacggccguuuauuacugugcucgcgaaggcauccugugguuuggggaccucccgaccuucuggggacaaggcacacuggugaccgucagcucugccuccacaaaagggcccagcguguuuccucuggcucccugcucuagauccaccagcgagucuacagccgcgcucggaugucugguuaaggauuauuucccugagcccgugaccgucuccuggaauagcggcgcccuuacguccggggugcacaccuuuccugcugugcugcagucuagcggacucuacucccugagcucugucguuacagugccguccagcaauuucggcacccagacauauaccugcaacguggaccauaagcccucuaauacgaaagucgauaagacaguggaacggaaauguugcguugaguguccucccugcccugcucccccgguggcuggcccuagcgucuuucuuuuucccccuaagcccaaagacacccugaugauuucccgcacacccgaagugaccuguguuguggucgaugugucucacgaggacccugagguccaguucaacugguacguggaugggguugaagugcauaaugccaagaccaagccgagagaggaacaauucaacagcacauuucgggucguguccguucucacggugguccaccaggacuggcugaauggaaaagaguacaagugcaaagugagcaacaagggccugcccgcgccuaucgaaaagaccauuucuaagacaaaagggcagccccgcgagccucagguguauacccugcccccguccagagaggaaaugacaaagaaucaaguuagccucaccugucuugucaagggauucuacccuucugauaucgccguggagugggaauccaacggccagcccgagaauaacuauaaaacgacaccucccaugcuggacagcgacggguccuucuuucucuacucuaagcugaccguggauaaaagccgguggcagcaaggaaacgucuucuccugcucugugaugcaugaagcccuucacaaucacuauacccagaaaagccugucccucagcccuggcaaa

SEQ ID NO: 39256 - RNA, 642 nt, Artificial Sequence
  derived and/or modified sequence opt5 from Prezalumab_LightChain
gacauccagaugacccaaagccccagcucucugagcgccuccgugggcgauagagucacaauuacgugccgggcuucucaggggaucagcaacuggcucgccugguaccagcagaagccugagaaagcgccgaagucccugauuuaugcugccucuagccuucaauccggaguucccagccgcuucucuggcuccgggagcggaaccgacuuuacacugaccaucucuucccuccagccugaagauuucgccacauacuauugucagcaguacgacagcuaucccagaaccuuuggccaagggacaaaaguggagauuaagcggaccguggcugccccuucugucuucaucuuucccccuuccgaugaacagcugaaaagcggaacggcuuccgugguuugccuucugaauaacuucuacccgcgcgaggccaaggugcaguggaaggucgacaaugcgcuccagucuggcaacagccaagaauccgugaccgagcaggauagcaaagacucuacauauucccugagcucuacccugacacucagcaaggccgauuacgagaaacacaagguuuacgcuugugaagugacccaucagggccuguccucucccgucacgaaauccuuuaauagaggggagugc

SEQ ID NO: 39257 - RNA, 342 nt, Artificial Sequence
  derived and/or modified sequence opt5 from Radretumab_HeavyChain
gaggugcagcugcucgaaagcggcgggggacugguccaacccggcgggucccuuagacugucuugcgccgcuagcggauucaccuuuuccucuuucagcauguccuggguucggcaggccccuggcaaggggcucgagugggugucuagcaucuccggaagcucuggcacaacguacuaugcggacuccgugaaaggccgcuuuaccauuagcagagauaacucuaagaauacacuguaccuucagaugaacucccugcgggcugaagacaccgccgucuauuacugugccaaaccguuccccuauuuugauuacugggggcagggaacacucgugaccguu

SEQ ID NO: 39258 - RNA, 1071 nt, Artificial Sequence; identical to SEQ ID NO: 38927
  derived and/or modified sequence opt5 from Radretumab_HeavyChain_LightChain

SEQ ID NO: 39259 - RNA, 693 nt, Artificial Sequence
  derived and/or modified sequence opt5 from Radretumab_LightChain
gccagcgagaucgugcugacccagucccccggcacacucucucugagcccuggggaaagagcuacgcuuuccugccgggccucucaaagcgucuccucuagcuuccuggcgugguaccagcagaagccgggacaggcuccccgccuccugauuuauuacgccuccagcagagccaccggcaucccugaccgguuuucuggguccggaagcggcacagauuucacccuuacaauuucucgccuggagcccgaagacuuugcuguuuauuacugucaacagaccgggagaaucccucccacauucggacagggcaccaaaguggagauuaaguccggcgggagcggaggcccucgggccgcuccggaaguguaugccuuugcgacgcccgaguggccugggucucgcgauaaaagaacccucgccugccugauccagaacuucaugcccgaggacaucuccguccaauggcugcacaaugaagugcagcucccugaugcucggcauagcacaacccagccccgcaagacaaaaggauccggcuuuuucguguuuucuagacuggagguuacccgggccgaaugggagcagaaggacgaguucauuugucgcgcuguccacgaagccgcgagcccgucccaaacggugcagagagccguuagcgugaacccugagucuucccggcgcgggggaugc

SEQ ID NO: 39260 - RNA, 1359 nt, Artificial Sequence
  derived and/or modified sequence opt5 from Ranevetmab_HeavyChain1
gaggugcagcuggucgaaagcggcgggggacucguucaacccggcgggucccugagacuuucuugcguggccagcggauucucccugaccaacaauaacgugaauuggguccggcaggcuccuggcaaggggcucgagugggugggaggcguuugggccggcggggcgacagacuacaacucugcucugaaaagccgcuuuacgaucuccagagauaaugccaagaacaccguguuccuucagaugcacucucugcggagcgaagacacagccgucuauuacugugcucgcgauggaggcuauuccagcucuacccucuacgccauggacgcuugggggcagggaacauccgugaccguuagcucugccuccacaaccgcgccgagcguguuuccccuggccccuucuugcggcuccacgagcggguccaccgucgcucuggccugucucgugucuggauauuuccccgagccugugacagucagcuggaacuccggcagccugaccucuggcguucauacauuucccuccgugcuucaaagcucugggcugcacagccucuccucuauggugaccgucccuagcuccagauggccgagcgaaacguucacaugcaaugugguucaucccgcuucuaauaccaaaguggauaagccugucuuuaacgagugucggugcacagacacacccccuugucccgugccggagccucugggaggccccuccguucuuauuuucccucccaaacccaaggauauccugcgcauuaccagaaccccugaagugacgugcgucgugcucgaccuggggcgggaggauccggaaguccagaucagcugguuuguggacggaaaggagguuauuaccgccaaaacacagucucgcgagcagcaauucaauggcaccuaccagguggucuccgugcugcccaucgaacaccaggauuggcucacagggaaggaguuuaaauguagaguuaaccauaucgaccugccuagccccauugaacggaccaucuccaaggcgcgcggcagagcccacaaaccuucuguguauguccuucccccgagcccuaaggagcuguccucuagcgauacgguguccauuacaugccucaucaaggacuucuaucccccugacauugauguggaauggcagagcguuggacaacaggagcccgagcggaaacaccgcaugaccccuccccagcuggacgaagauggcucuuacuuucuuuacuccaagcugagcgucgacaaaucuagauggcaacagggggauccguucaccugugcugugaugcaugagacacuccagaaucacuacaccgaccugucccugagccauucuccuggaaag

SEQ ID NO: 39261 - RNA, 1359 nt, Artificial Sequence
  derived and/or modified sequence opt5 from Ranevetmab_HeavyChain2
gaggugcagcuggucgaaagcggcgggggacucguucaacccggcgggucccugagacuuucuugcguggccagcggauucucccugaccaacaauaacgugaauuggguccggcaggcuccuggcaaggggcucgagugggugggaggcguuugggccggcggggcgacagacuacaacucugcucugaaaagccgcuuuacgaucuccagagauaaugccaagaacaccguguuccuucagaugcacucucugcggagcgaagacacagccgucuauuacugugcucgcgauggaggcuauuccagcucuacccucuacgccauggacgcuugggggcagggaacauccgugaccguuagcucugccuccacaaccgcgccgagcguguuuccccuggccccuucuugcggcuccacgagcggguccaccgucgcucuggccugucucgugucuggauauuuccccgagccugugacagucagcuggaacuccggcagccugaccucuggcguucauacauuucccuccgugcuucaaagcucugggcugcacagccucuccucuauggugaccgucccuagcuccagauggccgagcgaaacguucacaugcaaugugguucaucccgcuucuaauaccaaaguggauaagccugucuuuaacgagugucggugcacagacacacccccuugucccgugccggagccucugggaggccccuccguucuuauuuucccucccaaacccaaggauauccugcgcauuaccagaaccccugaagugacgugcgucgugcucgaccuggggcgggaggauccggaaguccagaucagcugguuuguggacggaaaggagguucugaccgccaaaacacagucucgcgagcagcaauucaauggcaccuaccagguggucuccgugcuccccauugaacaccaggauuggcugacagggaaggaguuuaaauguagaguuaaccauaucgaccuuccuagccccaucgaacggaccauuuccaaggcgcgcggcagagcccacaaaccuucuguguauguccugcccccgagcccuaaggagcucuccucuagcgauacgguguccaucacaugccugauuaaggacuucuaucccccugacaucgauguggaauggcagagcguuggacaacaggagcccgagcggaaacaccgcaugaccccuccccagcuugacgaagauggcucuuacuuucuguacuccaagcucagcgucgacaaaucuagauggcaacagggggauccguucaccugugcugugaugcaugagacacugcagaaucacuacaccgaccugucccucagccauucuccuggaaag

SEQ ID NO: 39262 - RNA, 651 nt, Artificial Sequence
  derived and/or modified sequence opt5 from Ranevetmab_LightChain
gacaucgugaugacccagagccccgccucccugucucucagccaaggcgagacagucacgauuaccugcagagcuuccgaagauaucuacaacgcccuggcgugguaucagcagaagccugggcaggcuccgaaacuucugauuuacaauacagacacccuccacacaggaguucccucucgguucagcggcuccgggucuggaaccgauuuuagccugacaaucuccagccuugagccugaagacguggccguguauuacugucaacauuauuuccacuacccccgcaccuuuggccaggggacgaaggucgagcugaaaagaaacgaugcccagccugcuguguaucucuuccagcccucuccugaccaacugcauaccggauccgccagcguugugugccugcucaauucuuuuuacccgaaggauauuaacgucaaauggaagguggacggcguuauccaggauacaggcauccaggaauccgugaccgagcaggacaaggauagcacauacucucuguccagcacccuuacgauguccucuacagaguaucugagccacgaacucuacuccugugagauuacccauaaaagccugcccucuacacuuaucaaguccuuccaacggagcgaaugccagcgcgucgac

SEQ ID NO: 39263 - RNA, 1761 nt, Artificial Sequence
  derived and/or modified sequence opt5 from Remtolumab_HeavyChain
gaggugcagcuggucgaaagcggcgggggacucguucaacccggcagaucccugcggcuuucuugcgccgcuagcggguucaccuuugacgauuacgccaugcacugggugcgccaggcgccuggaaagggccuggaguggguguccgcuaucacauggaacucugggcauauugacuaugccgauagcgucgaaggaagauucacgaucucccgggacaaugccaaaaacucucucuaccugcagaugaauagccuucgcgcugaggauaccgccguguauuacugugcuaagguuuccuaucugagcacagccucuucccucgacuacuggggccagggcacccuggugacagucagcucugggggaggcggguccggaggcgggggaagcgaagugcaacugguucagucuggcgcggaggugaaaaagccgggcuccagcgucaaaguguccugcaaggccucugggggcagcuuuggaggguauggaauuggcugggugagacaggcucccgggcagggacucgaguggaugggcggcaucaccccuuucuuuggguucgccgauuacgcucaaaaguuucagggacgggucacaauuaccgccgacgaauccacgaccacagcguacauggagcugagcggccuuaccucugaugacacagccguuuauuacugugcucgcgaucccaacgaguucuggaauggguauuacuccacccacgacuuugauagcuggggacagggcacgacagugaccgugucuagcgccuccacaaaagggccuucugucuucccccuggcuccuagcuccaagagcaccucuggcggaaccgccgcccucggcugccuggugaaagacuauuuuccggaacccguuacaguguccuggaacagcggggcucuuacgucuggaguccauaccuucccugcggugcugcaguccagcggccucuacucccugucuagcguugugacaguccccuccucuagccuggggacccaaacauauaucuguaaugugaaccacaagccuuccaauaccaaagucgacaagaagguggagcccaaaagcugcgauaagacgcauacauguccgccuugccccgccccugaacuccugggaggccccucuguuuuucuuuuucccccuaaaccgaaggacacccugaugaucuccagaacccccgaggugacaugugucgugguugaugugagccacgaagacccugaggucaaauucaacugguacguggaugggguggaaguucacaaugcuaagaccaaaccccgggaggagcaguacaacucuacauaucgcgucguguccgugcucacgguccugcaucaggacuggcuuaauggcaaggaauacaagugcaaagugagcaacaaggcccugccugcccccauugagaaaaccaucucuaaggcuaaaggacaaccgagagaaccucagguuuauacacugcccccuagccgggaugagcucaccaagaaucaggugucccugacaugucucgucaagggcuucuaccccagcgacauugccguggaaugggagucuaacgggcagccugagaacaauuauaaaaccacgcccccgguucuggauuccgacggcagcuucuuucuuuacuccaagcugaccguggauaaaucucgcuggcaacagggaaacgucuucagcugcuccgugaugcacgaagcgcuccauaaucacuauacacagaagucucugagccuuuccccugggaaa

SEQ ID NO: 39264 - RNA, 993 nt, Artificial Sequence
  derived and/or modified sequence opt5 from Remtolumab_LightChain
gacauccagaugacccaaagccccuccucucugagcgccuccgugggcgauagagucacaauuacgugccgggcuucucaggggauccgcaacuaccucgccugguaucagcagaagccuggaaaagcgccgaagcugcuuauuuacgcugccagcacccugcaauccggcguucccucuagauucagcggguccggaagcggcacagacuuuacccucacaaucucuucccugcagccugaggauguggccaccuauuacugucagcgguauaaucgcgcucccuacacauucgggcagggaaccaaaguggaaauuaagagaggcggcagcgggggaggcgggucuggagagaucguccuuacgcaauccccugacuuucagagcgugacccccaaagaaaagguuacaauuaccugccgggccucucaggauaucggcuccgagcugcacugguaucagcaaaagccugaccagccgcccaaacuccugaucaaguacgcuagccauuccacaucuggggugccuagccgcuucuccggaagcggcucuggcaccgauuuuacgcugacaauuaacgggcucgaagccgaggacgcgggaaccuacuauugucaccagacagauucccugcccuacaccuucggcccugggaccaaagucgacaucaagagaacaguggccgcucccagcguuuuuauuuucccgccuucugaugagcaacuuaaaagcggaacggccuccguggucugccugcucaauaacuuuuauccccgggaagcuaaggugcaguggaagguggacaaugcccugcagucuggcaacagccaggaguccgucaccgaacaagauagcaaagacucuacauacucccuuagcucuacccugacacucuccaaggcggacuaugagaaacauaagguuuacgccugugaggugacccaccaggggcugagcuccccugugacgaaaucuuucaaucgcggagaaugc

SEQ ID NO: 39265 - RNA, 1341 nt, Artificial Sequence
  derived and/or modified sequence opt5 from Rosmantuzumab_HeavyChain
caggugcaacugguccagagcggcgccgagguuaagaaacccggggcuuccgugaaggugucuugcaaagccagcggauacaccuucacagacuauuccauccacugggucagacaggcgccuggccaggggcucgaauggauuggauacaucuauccgucuaacggcgauagcggguacaaucaaaaguuuaaaaaccgggugacgaugacccgcgacacauccaccucuacagcuuauauggagcugagcagacuucgguccgaagauaccgccguuuacuauugugccacauacuucgcuaauaacuuugacuacuggggacagggcaccacgcugaccgugagcucugccuccacaaagggccccagcgucuucccucucgcucccucuuccaagagcaccucugggggaacagccgcgcugggcugccuugugaaagauuauuuuccugagcccguuaccguguccuggaauagcggggcccugacguccggaguccauacauucccugcugugcuccagucuagcggccuguacucccugagcucuguggucaccguuccguccagcucucucgggacacagaccuauauuuguaacgugaaucacaagcccagcaacaccaaaguggacaagcgcgucgaaccuaaauccugcgauaagacacauacgugucccccuugccccgccccggagcugcuuggaggcccuucuguguuucuguuucccccuaagcccaaagacacccucaugaucagcagaacacccgagguuaccuguguggucguggauguuucccacgaagacccugaggugaaguucaauugguacgucgauggcguggaaguccauaacgcuaaaacaaagccgcgggaggagcaauauaauagcaccuaccgcgugguuucugugcugacgguccuucaccaggacuggcugaacgggaaagaauauaagugcaaaguguccaauaaggcccuccccgcgccuauugagaagacaaucagcaaagccaagggacagcccagagaaccucagguuuacacccugcccccgucucgggaggaaaugaccaaaaaccaagugucccugacaugucucgucaagggcuucuacccuagcgauaucgcuguggagugggaguccaaugggcagcccgaaaacaacuauaaaaccacaccucccgugcuggacucugacggcagcuuuuuccuuuacuccaagcugacgguugauaagucucgcuggcagcaaggaaaugucuuuagcugcuccgugaugcacgaggcccuccauaaccacuauacccagaaaagccugucucuuuccccugggaag

SEQ ID NO: 39266 - RNA, 654 nt, Artificial Sequence
  derived and/or modified sequence opt5 from Rosmantuzumab_LightChain
gacauccagaugacccaaagccccuccucucugagcgccuccgugggcgauagagucacaauuacgugcaaggcuucucagagcguugacuacgauggggacuccuauaugaacugguaccagcagaaaccuggaaaggccccgaaacuccugaucuaugcggcuucuaaucuugagagcggcgugcccucccgguucagcgggucuggauccggcaccgauuuuacacugaccauuagcccugugcaagccgaagacuucgccacauacuauugucagcagucuaacgaggauccccucaccuuuggggcuggaacaaagcuggaacuuaaacgcaccgucgccgcuccuuccguguucaucuuucccccuagcgacgagcagcugaagucuggcacggccuccguugugugccuccugaauaacuucuacccgagagaagcgaagguccaauggaaaguggauaaugcccugcagagcggcaacucccaggagucuguuaccgagcaggacagcaaggauuccacauauagccucucuuccacccugacacuuagcaaagcugacuacgaaaagcacaaaguguacgccugugaggucacccaucaagggcugucuagccccgugacgaaguccuuuaaucggggagaaugc

SEQ ID NO: 39267 - RNA, 1332 nt, Artificial Sequence
  derived and/or modified sequence opt5 from Rozanolixizumab_HeavyChain
gaggugccccuggucgaaagcggcgggggacucguucagccuggcgggucccugagacuuucuugcgccgugagcggauucaccuuuuccaacuacggcaugguguggguccggcaagcuccggggaagggacuggaguggguggccuauaucgacucugauggcgacaauacauacuaucgcgauagcguuaaaggcagauucacgauuucccgggacaacgcgaagucuagccucuaccugcagaugaacucccuucgcgcugaagauaccgccguguauuacuguacaaccgggaucgucagacccuuucuguauuggggacagggcacacucgugaccguuagcucugccuccacaaaagggccuagcguguucccccuggcuccuugcucucgguccaccagcgagucuacggccgcucugggaugucucgucaaggacuacuuucccgaaccugugaccguguccuggaauagcggcgcccugacauccgggguccacaccuucccggcgguucuucagucuagcggacuguacucccucagcucuguggugacaguccccuccagcucucugggcaccaaaacguauacaugcaauguggaucauaagccuagcaacaccaagguugacaaacgcguggaguccaaguacgggcccccuugucccccgugcccugcccccgaguuucuuggcggaccuucugucuuccuguuuccucccaaacccaaggauacacucaugauuagcagaaccccggaagugaccuguguuguggucgacgugucccaagaggaucccgaaguccaguucaauugguauguggacggcguugaggugcacaacgcuaaaacaaagccucgggaggaacaguuuaauagcacguaccgcgucgugucuguucugaccgugcugcaucaggauuggcucaacgggaaggaguauaaaugcaaggucuccaauaaaggacugcccagcucuaucgaaaagacaauuuccaaagccaagggccaaccuagagagccccagguguacacccuuccgccuagccaggaagagaugaccaaaaaccaggugucccugacaugucucguuaagggguucuaucccucugacaucgcugucgagugggaaagcaauggacaaccugagaacaauuacaagacgacacccccugugcuggacuccgauggcagcuuuuuccuuuacucucggcugaccguggacaaaucccgcuggcaggaaggcaacgucuucagcugcucugugaugcacgaggcccuccauaaccacuauacccagaagucccugagccugucucucgggaaa

SEQ ID NO: 39268 - RNA, 657 nt, Artificial Sequence
  derived and/or modified sequence opt5 from Rozanolixizumab_LightChain
gacauccagaugacccaaagccccuccucucugagcgccuccgugggcgauagagucacaauuacgugcaagucuagccagucccucguuggggcuucuggaaaaaccuaccuguauuggcuuuuccagaagccuggcaaagccccgaagcggcugaucuaccucgugagcacacuggacuccgggauucccagccgcuuuucuggauccggcagcgggaccgaguucacacuuaccaucucuucccugcagccugaagauuuugcgacauauuacugucuccaaggaacccacuucccccauacguuuggccagggcaccaaacuggagauuaagagaacaguggcugccccuagcgucuucaucuuucccccuucugacgaacagcugaaguccgggaccgccagcgugguuugccuccugaacaauuucuauccgcgggaggcuaaagugcaguggaaggucgauaacgcccuucaauccggaaauucucaggaaagcgugacagagcaggacuccaaagauagcaccuacucucuguccagcacgcucacacugucuaaggcugacuaugagaaacacaagguuuacgccugugaagugacccaucagggccuuagcucccccgucacaaagucuuuuaaccgcggggagugc

SEQ ID NO: 39269 - RNA, 1329 nt, Artificial Sequence
  derived and/or modified sequence opt5 from Sapelizumab_HeavyChain
caggugcaacugcaggagagcggccccgggcucgucaagccuuccgaaacccugucucuuacaugcgccguuagcggacacuccaucucucaugaccacgcuuggagcugggugagacagccgcccggcgaggggcuggaauggauuggauucaucuccuacucuggcauuacgaacuauaauccuagccuccaggggcgggugaccaucucccgcgauaacagcaaaaauacacuguaccuucaaaugaacucucugagagccgaggacaccgcggucuauuacugugcucggucccucgcccgcacaaccgccauggauuauuggggagaaggcacacuggugaccguuagcucugcuuccacgaagggccccagcguguuuccucuggcccccucuuccaaaagcaccuccgggggaacagcugcccucggcugccuggucaaggacuacuucccugagccggugaccguuucuuggaauagcggggcgcuuacauccggagugcauaccuuucccgccguccugcagagcucuggccucuauucccugagcucuguggugacggucccuagcuccaacuucgggacacagaccuacacauguaauguugaucacaaacccucuaacaccaagguggacaagaccguggagagaaaaagcugcgucgaauguccucccugcccggcuccucccguggccggaccuuccguuuuucuuuucccucccaagcccaaagauacacugaugauuagccggacgccggaggugaccugugucgugguugacgugucucaggaagaucccgagguccaauuuaauugguacguggacggcgucgaggugcauaacgcuaagacaaaaccucgcgaggaacaguucaauuccaccuuuagaguugugagcguccucacagugguucaccaggauuggcugaacggcaaggaauauaagugcaaagugucuaauaaggggcugcccgccccuaucgagaaaaccaucuccaagacgaaaggacagccccgggaaccgcaagucuacacacucccucccagccaggaggagaugaccaagaaccaggugucccugaccugucuugugaaaggcuucuauccuucugacauugcgguugaaugggagagcaaugggcaacccgaaaacaacuacaagacaaccccucccaugcuggauuccgacggaucuuucuuucucuauagcaagcugacagucgacaaaucccgcuggcaggagggcaauguguuuagcugcucugugaugcacgaagcccuucaugcucacuacacgcagaagucccugagccucucuccg

SEQ ID NO: 39270 - RNA, 642 nt, Artificial Sequence
  derived and/or modified sequence opt5 from Sapelizumab_LightChain
gacauccagaugacccaaagccccuccucucugagcgccuccgugggcgauucugucacaauuacgugccaggcuagcaccgacaucuccucucaccucaacugguaccagcagaagccugggaaagccccggagcugcuuauuuauuacggaagccaucugcucuccggcguucccagccgguucucuggguccggaagcggcacagauuuuaccuucacaaucucuucccuggaagcggaggacgcugccaccuauuacugugggcaaggaaaucggcuuccuuauacauuuggccagggcaccaagguggaaauugagcgcacgguggccgcucccagcgucuucaucuuuccucccucugaugaacagcugaaauccgggaccgccagcgugguuugccuccugaacaauuucuacccuagagaggcuaaggugcaguggaaagucgacaacgcccugcaauccggaaauucucaggagagcgugacagaacaggauuccaaggacagcaccuauucucucuccagcacacugacccuuucuaaggcggauuacgagaaacacaagguuuacgccugugaagugacgcaucagggccugagcuccccggucacaaaaucuuuuaacagaggggagugc

SEQ ID NO: 39271 - RNA, 1356 nt, Artificial Sequence
  derived and/or modified sequence opt5 from Selicrelumab_HeavyChain
caggugcaacugguccagagcggcgccgagguuaagaaacccggggcuuccgugaaggugucuugcaaagccagcggauacaccuucacaggcuauuacaugcacugggucagacaggcgccugggcagggacucgaauggaugggcuggaucaacccggacuccgggggaacgaauuaugcucaaaaguuucagggccgggugaccaugacacgcgauaccucuauuagcacagccuacauggagcugaacagacuucgguccgacgauaccgccguuuauuacugugcucgcgaccagccccugggcuauugcacaaaugggguguguucuuacuucgauuacuggggacagggcacccucgucacggugagcuccgccagcaccaaagggccuucuguuuuuccccuggcuccuugcuccagaagcacaucugaauccaccgccgcgcuuggaugucuggugaaggacuauuuccccgagccugucacagugagcuggaacucuggcgcccucaccuccggggugcauacguuuccggcuguccugcaaagcuccggacuguacucucucagcuccguugugacagugcccagcucuaauuucggcacccagacauauaccugcaacgucgaucacaagccuuccaauaccaaaguggacaagacaguugaacggaaauguugcguggagugucccccuugccccgccccgccugucgcuggccccagcguguuucuguucccucccaagcccaaagauacgcuuaugaucucucgcaccccugagguuacauguguggucguggacgucagccaugaagauccggaggugcaguuuaacugguacguugacgggguggaaguccacaaugccaagaccaagcccagagaggagcaguucaacuccacauuucgggugguuucugugcugaccgucgugcaucaagauuggcucaauggaaaagaauauaagugcaaagugagcaacaagggccugccugcgcccauugagaaaacgaucuccaagacaaaagggcagccucgcgaaccccagguuuacacccuuccgccuagcagagaggaaaugaccaagaaucaagucucucugacaugccucgugaagggauucuaucccuccgacauugccguggagugggagagcaacggccagccugaaaauaacuacaaaaccacacccccuaugcuggacucugauggguccuuuuuccuguacagcaagcucacggucgacaaaucccgguggcagcagggaaacguguucucuuguagcguuaugcacgaggcucugcacaaucauuauacccaaaagucccuuucucugagccccggcaaa

SEQ ID NO: 39272 - RNA, 642 nt, Artificial Sequence
  derived and/or modified sequence opt5 from Selicrelumab_LightChain
gacauccagaugacccaaagccccuccucugugagcgccuccgucggcgauagaguuacaauuacgugccgggcuucucaggggaucuacagcuggcuggccugguaucagcagaagccuggaaaagcgccgaaccuccugauuuacaccgcuuccacacuucaaucuggcgugcccagccgcuucuccgggagcggaucuggcaccgacuuuacacugaccaucuccagccuccagccugaggauuucgccacauauuacugucagcaggccaauauuuuuccccugaccuucgggggaggcacgaagguggaaaucaaaagaaccgucgcugccccuucuguguuuaucuuucccccuuccgacgagcaacuuaagagcggcacagcuucuguugugugccugcucaacaauuucuauccgcgggaagccaaaguccaguggaagguggauaacgcgcugcaguccgggaauagccaggaguccguuaccgaacaagacucuaaggauagcacauacucccugagcucuacccucacgcuguccaaagccgacuaugagaagcacaaaguguacgcuugugaggucacacaucagggacuuagcucucccgugaccaagagcuucaaccgcggcgaaugc

SEQ ID NO: 39273 - RNA, 354 nt, Artificial Sequence
  derived and/or modified sequence opt5 from Solitomab_HeavyChain1
gaggugcagcugcucgaacaaagcggcgccgagcuggucagacccgggaccuccguuaagaucucuugcaaagcuagcggauacgccuucacaaacuauuggcuuggcugggugaagcagcggccugggcacggacuggaauggauuggcgacaucuuuccgggguccggaaauauucauuacaacgagaaauucaagggcaaagcgacgcucaccgcugauaagucuagcuccacagccuauaugcagcugucuagccuuaccuuugaagacuccgccguguacuucugugcucgccugagaaauugggaugagcccauggacuauuggggccaggggacaaccgucacagug

SEQ ID NO: 39274 - RNA, 375 nt, Artificial Sequence
  derived and/or modified sequence opt5 from Solitomab_HeavyChain2
gacgugcagcugguccaaagcggcgccgagguuaagaaacccggggcuuccgugaaggugucuugcaaagccagcggauacaccuucacaagauauacgaugcacuggguccggcaggcgccuggccaggggcucgaauggaucggauacauuaacccgucccgcggcuauaccaauuacgcugauucugugaaggggagauuuacaaucaccacagacaaaagcaccuccacagccuauauggagcugucuagccuucgguccgaagauaccgccacguacuauugugcucgcuacuacgacgaucauuauugccuggacuacuggggacagggcaccacaguuaccgugagcucuggcgaggggacauccacc

SEQ ID NO: 39275 - RNA, 1488 nt, Artificial Sequence
  derived and/or modified sequence opt5 from Solitomab_LightChain_HeavyChain_HeavyChain_LightChain
gagcuggugaugacccagagccccuccucucucacagucacggccggcgaaaagguuaccaugagcugcaaauccucucaaagccugcuuaacuccgggaaucagaagaacuaccugacaugguaucagcagaaaccuggacaaccgcccaagcuccugaucuacugggcuucuaccagagagagcggcgugccugaccgguucacaggguccggaagcggcaccgauuuuacacuuaccauuucuuccgugcaggccgaagaccuggcggucuauuacugucagaaugauuauagcuacccccucacguucggggcuggaaccaaacuggagaucaagggcggcgggggaucuggcgggggaggcuccgggggaggcggcagcgaagugcagcugcucgagcaaucuggggccgagcugguucgcccuggaacauccgugaagauuagcugcaaagccuccggcuaugcuuuuaccaacuacuggcuugggugggucaagcagagacccggacacggccuggaauggaucggggacauuuucccuggaucuggcaauauccauuacaacgagaaauuuaagggcaaagccacacucaccgcugauaagagcuccagcacggccuauaugcagcugucuucccuuacauucgaagacagcgcgguguacuuuugugcccggcugcgcaauugggaugagccgauggacuauugggggcagggaaccacaguuaccgugucuagcggcgggggaggcuccgauguccaacucgugcagucuggggcugaggugaagaaacccggcgccagcgucaagguuuccugcaaagcuagcggauacaccuucacaagauauacgaugcacugggugcggcaggccccuggccaagggcuggaauggaucggauacauuaaccccucucgcggcuauaccaauuacgcggacuccgugaaggggagauuuacaaucaccacagauaaaagcaccucuacggccuacauggagcuguccagccuccgguccgaagacacagcuaccuauuacugugcccgcuauuacgaugaccauuauugccuggacuacuggggacagggcaccacagucaccgugucuagcggggagggcacauccacgggaucuggcgggagcggaggcuccgggggagcugaugacauuguucuuacccagagcccugccacacugucucucucccccggcgaaagagccacccugagcugucgggcuucucaguccgugagcuauaugaacugguaccaacagaagccggggaaagcgccuaagcgcuggaucuacgauacaucuaaggucgccagcggcgugcccgcuagauucuccggaagcggcucugggaccgacuauucccuuacgauuaauagccuggaggccgaggaugccgcuaccuacuauugccagcagugguccucuaacccucucacauuuggaggcgggaccaaaguugaaaucaag

SEQ ID NO: 39276 - RNA, 339 nt, Artificial Sequence
  derived and/or modified sequence opt5 from Solitomab_LightChain1
gagcuggugaugacccagagccccuccucucucacagucacggccggcgaaaagguuaccaugagcugcaaauccucucaaagccugcuuaacuccgggaaucagaagaacuaccugacaugguaucagcagaaaccuggacaaccgcccaagcuccugaucuacugggcuucuaccagagagagcggcgugccugaccgguucacaggguccggaagcggcaccgauuuuacacuuaccauuucuuccgugcaggccgaagaccuggcggucuauuacugucagaaugauuauagcuacccccucacguucggggcuggaaccaaacuggagaucaag

SEQ ID NO: 39277 - RNA, 324 nt, Artificial Sequence
  derived and/or modified sequence opt5 from Solitomab_LightChain2
gccgacgauaucgugcugacccagagccccgcuacacucucccugucuccuggcgagagagccacgcuuagcugccgggcgucccaaucugucagcuacaugaacugguaucagcagaagccggggaaagcucccaagcgcuggauuuacgacaccuccaaaguugccucuggagugccugccagauucagcggcuccgggagcggaacagauuauucucugaccaucaauucccucgaagcugaggacgccgcuacauacuauugucagcaauggagcucuaacccccugaccuuuggcgggggaacaaagguggaaauuaaa

SEQ ID NO: 39278 - RNA, 1359 nt, Artificial Sequence
  derived and/or modified sequence opt5 from Suptavumab_HeavyChain2
gaggugcagcuggucgaaagcggcggggaccucguucaacccggaagaucccugcggcuuucuugcguggccagcggcuucaccuuugaugacuacgcuaugcacugggugcgccaggccccugggaagggacuggagugggucuccggcgugucuuggagcggguccacaguuggauaugcggauucugugaaaggcagauucacggucagccgggacaacgcucagaagucccucuaccugcagaugaauagccuucgcgccgaagauaccgcccuguauuacugugugaaagacgcuuauaaguuuaacuacuauuacuacggccucgauguuugggggcaaggaacaaccgugacagucucuuccgccagcaccaaaggcccgucuguguucccccuggcuccuuccagcaagucuacauccgggggaaccgccgcgcugggcugccucgugaaggacuauuuucccgagccugucacgguuagcuggaacuccggggcccugaccucuggagugcauacauuccccgcugugcuucagagcuccggccuguacagccucucuuccgucgugaccguuccuagcucuagccugggcacacagaccuauaucuguaaugugaaucacaaaccguccaacacgaaggucgauaaaaagguggaacccaaaucuugcgacaagacacauaccuguccucccugcccugcccccgagcuucucgggggaccgagcguuuuucuguucccucccaagccuaaagauacacugaugauuuccagaacccccgaggugaccugugucguggucgacgugagccacgaagaucccgagguuaaguuuaauugguacguggacggcgucgaagugcauaacgcuaaaacaaagccucgggaggagcaguauaauucuacguaccgcguuguguccguccugaccgugcuccaccaagacuggcugaacgggaaagaauauaagugcaaagugagcaauaaggcccuuccggcgcccaucgagaagacaauuucuaaagccaagggacagccuagagaaccccagguuuacacccugccucccucccgggaugagcucaccaaaaaccaggucagccugacaugucuugugaagggcuucuacccguccgacaucgcuguggaaugggagucuaaugggcaaccugagaacaauuauaaaacgacacccccuguccuggauagcgacggauccuuuuuccucuacucuaagcugaccguggauaagagccgcuggcagcagggcaacguguuuuccugcagcguuaugcacgaagcccugcauaaccacuauacccaaaaaucucucucccugagccccggcaag

SEQ ID NO: 39279 - RNA, 1356 nt, Artificial Sequence
  derived and/or modified sequence opt5 from Suvratoxumab_HeavyChain
gaggugcagcuggucgaaagcggcgggggacucguucaacccggcgggucccugagacuuucuugcgccgcuagcggauucaccuuuuccucucacgacaugcauugggugcggcaggccacaggcaaggggcuggagugggugagcggaaucggcacggcgggcgauaccuacuauccugacuccgucaaagggcgcuucacaauuucuagagaaaacgcuaagaauagccucuaccugcagaugaacucccuucgggccggagauaccgccguguauuacugugcucgcgacagauauagcccgacaggccacuacuaugggauggauguuuggggacagggcaccacagugaccgucucuuccgccagcacgaaagggcccucuguguuuccucuggcucccuccagcaagucuaccuccggaggcacagccgcgcucggcugccugguuaaagacuacuucccugagcccgugaccgucagcuggaauagcggggcccugacaucuggagugcauaccuuuccugcugugcuccaaagcuccggccuguacagccuuucuuccgucguuacggugccgagcucuagccuggggacacagaccuauaucuguaacgugaaucacaagcccuccaacacaaaggucgauaaacggguggaaccuaagucuugcgacaaaacccauaccugucccccuugccccgccccggagcuccugggaggcccuagcguuuuccuuuuucccccuaagcccaaagauacacuguacauuacgcgcgagcccgaagugaccugugucgugguugacgugucccacgaggauccugaagucaaguucaauugguauguggacggggucgaggugcacaacgcuaagacaaaaccgagagaggaacaguacaauagcaccuaucggguugugucuguccucacagugcugcaucaggauuggcugaacggaaaggaguacaaaugcaagguuuccaauaaagcccuccccgcgccuaucgaaaagaccauuagcaaagccaagggccaaccccgcgagccucagguguauacgcugcccccgucuagagaagagaugacaaagaaccaggucucccuuaccugucuggugaaaggcuuuuacccuagcgacaucgcuguggagugggaauccaaugggcagcccgagaacaauuacaagaccacaccucccguucucgacucugauggauccuucuuucuguauuccaaacuuaccgucgacaagucucgguggcaacagggcaacguguucagcugcuccgugaugcacgaagcccugcauaaccacuacacacagaaaagccucucucuguccccugggaag

SEQ ID NO: 39280 - RNA, 639 nt, Artificial Sequence
  derived and/or modified sequence opt5 from Suvratoxumab_LightChain
gacauccagaugacccaaagccccuccacacugucugccagcgugggcgauagagucacgauuaccugccgggcuucccagucuaucagcuccuggcucgccugguaccagcagaagccugggaaagcgccgaagcugcuuauuuauaaggcuucuagccuggaguccggaguucccagccgcuucucuggcuccgggagcggaacagaauuuacccucacaaucucuucccugcaaccugacgauuucgccaccuacuauuguaaacaguacgccgacuauuggacauuuggccaggggaccaaaguggagauuaagagaacgguggcugcccccagcgucuucaucuuuccucccucugaugaacagcuuaaguccggaaccgcuagcgugguuugccugcucaacaauuucuacccucgggaggccaaagugcaauggaaggucgacaacgcgcugcaguccggcaauucucaggaaagcgugacagagcaggauuccaaagacagcaccuauucucuguccagcacacucacccugucuaaggccgauuacgagaaacacaagguuuacgcuugugaagugacgcaucaaggccuuagcuccccggucacaaagucuuuuaaccgcggggagugc

SEQ ID NO: 39281 - RNA, 642 nt, Artificial Sequence
  derived and/or modified sequence opt5 from Tadocizumab_LightChain
gacauccagaugacccaaacacccagcacgcuguccgccucugugggcgauagagucaccauuagcugccgggcuucccaggacaucaacaauuaccucaacugguaucagcagaaaccugggaaagccccgaagcugcuuauuuacuauacaucuacccugcacagcggaguucccucccgcuucucuggcagcggguccggaacagauuacacccucacaaucagcucucugcaaccugacgauuuugcgaccuauuucugucagcagggcaauacgcuucccuggaccuuugggcagggaacaaaaguggaggugaagagaaccgucgcugccccuuccguguucauuuuucccccuagcgacgaacaacugaaaucuggcacagccuccguugugugccuccugaacaauuucuacccgcgggaggcuaagguccaguggaagguggauaacgcccugcagagcggcaauucucaggaauccguuaccgagcaagacagcaaagauuccacguauucucucagcuccacacugacccuuagcaaggcugacuacgaaaaacauaagguguacgccugugaggucacacaccaggggcugucuucccccgugaccaagagcuuuaaccgcggagagugc

SEQ ID NO: 39282 - RNA, 1341 nt, Artificial Sequence
  derived and/or modified sequence opt5 from Tanezumab_HeavyChain
caggugcaacugcaggagagcggccccgggcucgucaagccuuccgaaacccugucucuuacaugcacgguuagcggauucucccugaucggcuacgaccucaacuggauuagacagccgcccgggaaaggacuggaguggaucggcauuaucuggggagaugggaccacagacuauaauucugccgugaagucucgggugaccauuuccaaagauacaucuaagaaccaguuuagccuuaaacuguccagcgucaccgcugccgacacagcgguguacuauugugcucgcggcggcuacugguaugccaccucuuacuauuucgauuacugggggcaaggaacgcucguuaccguguccagcgccucuacaaagggcccuuccgucuuuccccuggcuccuugcagcagaucuaccuccgaaagcacagccgcucuggggugucucgugaaggacuacuuccccgagccuguuaccguguccuggaacucuggagcccugacgagcggcguccacacauuuccggcggugcuucaguccagcgggcuguauucucucuccagcguggucaccguucccucuagcaauuucggaacacagaccuauaccugcaauguggaucauaaaccuuccaacacaaagguggacaaaacggucgaacggaaguguugcguggagugucccccuugccccgccccgccuguugcuggccccucuguguuucuguucccucccaaacccaaggauacccuuaugaucagccgcacaccugaggucaccugugugguuguggacgucucccacgaagauccggaggugcaguuuaauugguacgucgacggcguggaaguucauaacgccaagacaaaacccagagaggagcaauucaauagcaccuuucggguggucucugugcugacgguugugcaccaggauuggcucaacgggaaggaauacaaaugcaaggucuccaauaaaggacugccuagcucuaucgagaagacaauuuccaaaaccaagggccagccccgcgaaccucagguguauacccugcccccgagcagagaggaaaugacaaagaaccaagugucccucaccugucugguuaaaggguucuacccuucugacaucgcugucgagugggagagcaauggacagcccgaaaacaauuauaagacaacgccucccaugcuugacuccgauggcagcuuuuuccuguacagcaaacucaccguggacaagucccgguggcagcaagggaacguguucagcugcucugucaugcaugaggcccugcacaaccacuacacacagaaaucccuuagccugucuccuggaaag

SEQ ID NO: 39283 - RNA, 642 nt, Artificial Sequence
  derived and/or modified sequence opt5 from Tanezumab_LightChain
gacauccagaugacccaaagccccuccucucugagcgccuccgugggcgauagagucacaauuacgugccgggcuucucagagcaucuccaacaaucucaacugguaccagcagaagccugggaaagccccgaagcugcuuauuuauuacaccucucgcuuccacagcggaguucccuccagauuuagcggcucuggguccggaacagacuucaccuuuacaaucagcucucugcaaccugaggauauugcgaccuauuacugucagcaggaacauacacuccccuauaccuucggccaggggacgaaacuggagaucaagcggaccguggcugccccuuccguguuuaucuuucccccuagcgacgaacaacuuaaaucuggaacagccuccgucgugugccugcucaauaacuucuacccgcgcgaggcuaagguucaguggaagguggauaaugcccugcagagcggcaacucccaggaaucugucaccgagcaagacagcaaagauuccacauauagccugucuuccacccucacgcugagcaaggcugacuacgagaaacacaagguguacgccugugaaguuacacaucagggccuuucuagccccgugaccaaauccuucaauagaggggagugc

SEQ ID NO: 39284 - RNA, 1353 nt, Artificial Sequence
  derived and/or modified sequence opt5 from Tavolixizumab_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaaucgcgacacaagcaagaaccaguacucccugcaacuuaauagcgugaccccugaggauacagcuguguauuacugugccagauacaaauaugacuacgauggcggccacgcgauggacuauugggggcagggaacccuggucacagugucuuccgcuagcaccaagggccccucuguuuuuccucucgcccccuccagcaagucuacguccgggggaaccgccgcucugggcugccuggugaaagauuacuucccugaaccggucacagugagcuggaacuccggggcccucaccucuggaguucauacauuucccgcugugcugcagagcuccggccuuuauagccugucuuccgucgugaccgugccuagcucuagccucggcacgcagacauacaucuguaaugucaaccacaagcccuccaauaccaaaguugacaagcggguggagccuaaaucuugcgauaagacacauaccugucccccgugcccugcccccgaacugcuugggggaccuagcguguuccuguuuccucccaagcccaaagacacccucaugaucucccgcacaccggaggucacgugugugguuguggaugucagccacgaggaccccgaagugaaguucaacugguauguugauggcguggagguccacaaugcgaaaaccaagccucaagaggaacaguacaacucuacauacagaguggucuccgugcugaccguucugcaucaggacuggcucaaugggaaagaguauaagugcaaagugagcaacaaggcccugcccgcuccuauugaaaagacaaucucuaaagccaagggacagccccgggagccgcaagucuacacccuuccucccucccgcgaagagaugacgaaaaaucaggugagccugacaugucucguuaagggcuuuuauccuuccgauauugcuguggaaugggagucuaacgggcagcccgagaacaauuacaaaaccaccccucccguccuggacagcgacggauccuucuuucuuuauucuaagcugacaguggauaagagcagauggcaacagggcaacguguucuccugcagcguuaugcacgaagcccuccauaaucacuacacccagaaaucucugucccugagcccgggcaag

SEQ ID NO: 39285 - RNA, 642 nt, Artificial Sequence
  derived and/or modified sequence opt5 from Tavolixizumab_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccuccaaacugcacucuggaguucccagccgcuucuccggcagcgggucuggaacagauuacacccucacaaucuccagccugcaaccugaggacuuugcgaccuauuacugucagcagggcucugcccuucccuggacauucgggcagggaaccaagguggaaauuaaaagaacgguggcugccccuuccgucuuuaucuuucccccuagcgaugagcaacugaagucuggcaccgcuuccgugguuugccuccugaacaauuucuauccgcgggaagccaaggugcaguggaaagucgacaacgcucugcagagcggcaauucccaggagucugugacagaacaagauagcaaggacuccaccuacagccucucuuccacacugacccuuagcaaagccgauuacgagaagcauaaaguuuaugcgugugaggugacgcaccaggggcugucuagccccgucacaaaguccuucaaccgcggagaaugc

SEQ ID NO: 39286 - RNA, 1335 nt, Artificial Sequence
  derived and/or modified sequence opt5 from Telisotuzumab_HeavyChain
caggugcagcugguccagagcggcgccgagguuaagaaacccggggcuuccgugaaggugucuugcaaagccagcggauacaucuucaccgcguauacaaugcacugggucagacaggcuccuggccaggggcucgaauggaugggauggauuaagccgaacaauggccuggccaacuacgcccaaaaauuucaggggcgggugacgaugacccgcgacacauccaucucuaccgcuuauauggagcuuagcagacugcgguccgaugacacagccguuuacuauugugcucgcucugaaauuaccacagaguucgauuacuggggacagggcacccucgugacggucagcuccgccagcaccaagggccccucuguguuuccucuggcgcccuccagcaagucuacauccgggggaaccgccgcucuuggcugccugguuaaagacuauuucccugaacccgugacagucagcuggaauagcggggcccucaccuccggagugcauacguuuccugcugugcugcagagcuccggccuguacucucucagcuccgucguuacagugccgucuucuucccuggggacccaaacauacaucuguaacgugaaucacaagcccagcaacaccaaagucgauaagagaguggagccuaaaucuugcgacugucauugucccccuugccccgccccggagcuucugggaggcccuagcguuuuccucuuucccccuaagcccaaggauacccugaugauuucccggacacccgaagugacgugcgucgugguugacgugucucacgaggauccugaagucaaauucaauugguauguggacggcgucgaggugcauaacgcgaagaccaaaccgcgcgaggaacaguacaauagcacauauagaguuguguccguccuuaccgugcugcaccaggauuggcucaacgggaaggaguacaaauguaagguuagcaauaaagcccugcccgcuccuaucgaaaagacaaucucuaaggccaaaggacagccccgggagccucaaguguauacccugcccccgucccgcgaagagaugacgaagaaccaggucagccucacaugccuggugaaaggcuuuuacccuucugacauugcuguggagugggaauccaaugggcagcccgagaacaauuauaagaccaccccucccguucuugauagcgacggauccuucuuucuguacucuaaacucacagucgacaagagcagauggcaacagggcaacguguucuccuguucugugaugcacgaagcccugcauaaccacuacacccaaaagagccuuucccugagcccuggg

SEQ ID NO: 39287 - RNA, 654 nt, Artificial Sequence
  derived and/or modified sequence opt5 from Telisotuzumab_LightChain
gacaucgugaugacccagagccccgauucccuggccgucucucucggcgagagagcuacaauuaacugcaagagcuccgaaucuguugacagcuacgccaauuccuuccugcacugguaucaacagaaaccugggcagccgcccaaacuucugaucuaccgggcgucuacgcgcgagagcggagugccugauagauuuuccggcagcgggucuggaaccgacuucacacucaccauuuccagccugcaggcugaagauguggccgucuauuacugucaacagucuaaggaggacccccuuacauuuggcgggggaaccaagguggaaaucaaacggacaguugccgcuccuuccguguucauuuuucccccuagcgaugagcagcugaagucuggcaccgccuccgucgugugccuccugaacaauuucuauccgcgcgaggcuaagguucaguggaaaguggacaacgcccugcaaagcggcaauucccaggaaucugucacggagcaggauagcaaggacuccaccuacagccucucuuccacacugacccuuagcaaagcggauuaugaaaagcauaaaguguacgccugugaggugacacaccaggggcugucuagccccgucaccaaguccuuuaacagaggagagugc

SEQ ID NO: 39288 - RNA, 1335 nt, Artificial Sequence; identical to SEQ ID NO: 39286
  derived and/or modified sequence opt5 from Telisotuzumab_vedotin_HeavyChain

SEQ ID NO: 39289 - RNA, 654 nt, Artificial Sequence; identical to SEQ ID NO: 39287
  derived and/or modified sequence opt5 from Telisotuzumab_vedotin_LightChain

SEQ ID NO: 39290 - RNA, 1350 nt, Artificial Sequence
  derived and/or modified sequence opt5 from Timigutuzumab_HeavyChain
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccuaagucuugcgacaaaacacauaccugucccccuugccccgccccggagcuccugggcgggccuagcguguuccuuuuucccccuaagcccaaggauacccugaugauuucccggacacccgagguuacguguguggucguggacguuucucacgaagauccugaggugaaauucaacugguaugucgacggaguggaaguccauaaugcgaagaccaaaccgcgcgaggagcaguacaacagcacauauagagugguuuccgugcucaccguccugcaccaggauuggcugaauggcaaggaauacaaaugcaaggugagcaacaaagcccuccccgcuccuaucgagaagacaaucucuaaggccaaagggcaaccccgggaaccucagguuuauacccugcccccgucccgcgacgagcuuacgaagaaucaggugagccugacaugucucgucaaaggauuuuacccuucugacauugcuguggaaugggaguccaacggccagcccgagaauaacuacaagaccaccccucccgugcuggauagcgacggcuccuucuuucuuuauucuaaacugacaguugauaagagcagauggcaacaggggaacgucuucuccugcucugugaugcacgaaggacuccauaaucacuacacccaaaagagccugucccugagcccuggcaaa

SEQ ID NO: 39291 - RNA, 642 nt, Artificial Sequence; identical to SEQ ID NO: 38952
  derived and/or modified sequence opt5 from Timigutuzumab_LightChain

SEQ ID NO: 39292 - RNA, 1332 nt, Artificial Sequence; identical to SEQ ID NO: 38336
  derived and/or modified sequence opt5 from Timolumab_HeavyChain

SEQ ID NO: 39293 - RNA, 642 nt, Artificial Sequence; identical to SEQ ID NO: 38337
  derived and/or modified sequence opt5 from Timolumab_LightChain

SEQ ID NO: 39294 - RNA, 1347 nt, Artificial Sequence
  derived and/or modified sequence opt5 from Tomuzotuximab_HeavyChain
caggugcaacugaagcagagcggccccgggcucguccagccuucccagucucugagcauuaccugcacaguuuccggauucucucuuacgaacuacggcgugcacugggugagacaaagcccggggaaaggacuggaguggcucggcgucaucugguccgggggaaauaccgacuauaacacacccuuuaccucucggcugagcaucaauaaggauaacuccaaaagccagguguucuuuaagaugaacucucuucaguccaaugacacagccauuuacuauugugcucgcgcccugaccuacuaugauuacgaguucgcguauuggggccagggcacacucguuaccgugagcacggcuucuaccaaagggccuuccgucuuuccccuggccccuagcucuaaguccacaagcggaggcaccgccgcucuggggugccucgugaaggacuacuuccccgaaccuguuacaguguccuggaacucuggagcccugaccagcggcguccauacguuuccggcugugcuucaauccagcgggcuguacucucucuccagcguggucacaguucccucuagcucccugggaacccagacauauaucuguaaugugaaucacaaaccuucuaacaccaagguggauaaaaaggucgaacccaaaagcugcgacaagacccauacauguccucccugcccggccccugagcuucugggcggccccuccguguuccucuuuccucccaagcccaaagauacgcugaugauuagcagaaccccugaaguuacauguguggucguggacguuucucacgaggauccggaggugaaguucaauugguacgucgacgggguggaaguccauaacgcgaaaaccaagccccgggaggaacaguauaauuccacauaccgcgugguuagcgugcugaccguccuccaccaggauuggcugaacggaaaagaguauaagugcaaagugucuaauaaggcccuuccugcucccaucgagaagacgaucuccaaagccaagggccaaccuagagaaccccagguuuacacacugccgccuagccgggacgagcucaccaaaaaccaggugucccugaccugucuugucaagggguuuuaucccucugauauugcuguggaaugggagagcaacggacaaccugaaaauaacuacaaaacaacacccccugugcuggacuccgacggcucuuucuuucucuacagcaagcugaccguugauaagucccgcuggcagcaggggaaugucuucagcugcucugugaugcacgagggacugcauaaccacuauacgcagaaaucccucagccugucucccggcaag

SEQ ID NO: 39295 - RNA, 642 nt, Artificial Sequence; identical to SEQ ID NO: 38367
  derived and/or modified sequence opt5 from Tomuzotuximab_LightChain

SEQ ID NO: 39296 - RNA, 1347 nt, Artificial Sequence; identical to SEQ ID NO: 39095
  derived and/or modified sequence opt5 from Trastuzumab_duocarmazine_HeavyChain

SEQ ID NO: 39297 - RNA, 642 nt, Artificial Sequence; identical to SEQ ID NO: 38952
  derived and/or modified sequence opt5 from Trastuzumab_duocarmazine_LightChain

SEQ ID NO: 39298 - RNA, 1368 nt, Artificial Sequence
  derived and/or modified sequence opt5 from Varisacumab_HeavyChain
caggugcaacugguccagagcggcgccgagguuaagaaacccggggcuuccgugaaggugucuugcaaagccagcggaggcaccuucuccucuuacgcgaucagcugggucagacaggcuccugggcagggacucgaauggaugggcggguuugacccggaggauggagaaacaauuuaugcccaaaaguuccagggccgggugacgaugaccgaggacacauccaccgauacagccuacauggaacugucuagccuucgcuccgaggacaccgcuguuuauuacugugccacaggcagaagcauggugcgcggggucaucauucccuuuaacggaauggauguguggggccaggggaccacgguuaccgugucuuccgcuagcacaaaaggaccuucugucuucccccuggccccuuccagcaagucuaccuccggcgggacagcggcccucggaugccuggugaaggacuauuuucccgagccugugaccgucagcuggaacuccggcgcucuuacgucuggcguucacacauucccggccgugcugcagagcuccgggcucuacagccugucuuccguggucaccgugcccagcucuagccugggaacacaaaccuauaucuguaauguuaaucauaaaccuuccaacaccaagguggauaaaaaggucgaacccaaaucuugcgacaagacacacacguguccucccugcccggcuccugagcuccugggcgggcccagcguguuucuuuucccucccaagcccaaagauacccugaugauuucccggacaccugaaguuaccuguguggucguggacgucagccaugaggauccggaggugaaguuuaauugguacguugacggaguggaaguccacaacgccaaaacaaagcccagagaggaacaguacaauucuaccuaucgggugguuuccgugcucacgguccugcaucaggauuggcuuaacggcaaagaguacaagugcaaagugagcaauaaggcgcugccugcccccaucgaaaagacaaucucuaaagcuaaggggcagccucgcgagccccaaguguauacccucccgccuuccagagacgagcugaccaaaaaccagguuagccugacaugucucgucaagggauucuaccccuccgacauugccguggaaugggagucuaauggccagccugaaaacaauuauaaaaccacacccccugugcuggauagcgacggcuccuuuuuccuuuacucuaagcugacggucgauaagagccgguggcaacaggggaacguguuuuccugcagcguuaugcacgaggcucuccacaaucauuauacccagaaaucucugucccuuagccccggaaag

SEQ ID NO: 39299 - RNA, 642 nt, Artificial Sequence
  derived and/or modified sequence opt5 from Varisacumab_LightChain
gacaucagaaugacccagagccccuccucucugagcgccuccgugggcgaucgggucacaauuacgugccgcgcuucucaaagcaucuccucuuaccucaacugguaucagcagaaaccugggaaagccccgaagcugcuuauuuacgcggcuagcucccugcagagcggaguucccucuagauucuccggcagcgggucuggaaccgacuuuacacucaccaucuccagccugcaaccugaggauuucgccacauauuacugucagcagucuuauuccacaccccuuaccuuuggcgggggaaccaaaguggaaauuaagcggacgguggccgcuccuagcgucuucaucuuucccccuuccgacgagcagcugaaaucuggcaccgccagcgugguuugccuccugaauaacuucuacccgcgcgaagcuaaggugcaauggaaggucgauaaugcccugcaguccggcaacagccaggagucugugacagaacaggacuccaaagauagcaccuauucucucagcuccacacugacccuuucuaaggcggacuacgagaaacacaagguuuacgccugugaggugacgcaucaagggcugagcucccccgucacaaagagcuuuaauagaggagaaugc

SEQ ID NO: 39300 - RNA, 1359 nt, Artificial Sequence
  derived and/or modified sequence opt5 from Vunakizumab_HeavyChain
gaggugcaacugguccaaagcggcgccgaaguuaagaaacccggggcuuccgugaaggugucuugcaaagccagcggauacaccuucacagacuaugagguccacugggugagacaggcgccuggccaggggcucgaauggaugggaguuaucgauccgggcacgggaggaguggcuuacaaccagaaguuugagggccgggucaccaugacagccgacaccuccacaucuaccgccuauauggaacugcgcagccuuagauccgaugacacagcuguguacuauuguacccgguacucucuguucuauggcagcucccccuacgccauggauuacugggggcaaggaacgcucguuaccgugagcucugcuuccacaaaaggcccuagcgucuuuccccuggccccuucuuccaagagcaccucugggggaacagcggcccuuggcugccuggugaaggacuauuuccccgagccugugaccgucuccuggaauagcggggcucucacguccggaguucauacauuuccggccgugcugcagucuagcggccuguacucccucagcucuguggucaccgugcccuccagcucucugggcacacagaccuauauuuguaacguuaaucacaaaccuagcaacaccaagguggauaaaaaggucgagcccaaauccugcgacaagacacauacguguccucccugcccggcuccugaacuucucgggggacccucuguguuccuguuuccucccaagcccaaagauacccugaugaucagccgcacaccugagguuaccuguguggucguggacgucucccacgaagauccggaggugaaguucaauugguacguugacggcguggagguccauaacgccaaaacaaagcccagagaggaacaguauaauagcaccuaccgggugguuucugugcuuacgguccugcaccaagauuggcucaacgggaaagaauauaagugcaaaguguccaauaaggcgcugccugcccccauugagaagacaaucagcaaagcuaagggacagccucgcgaaccccagguguacacccugccgccuucuagagaggagaugaccaaaaaccagguuucccucacaugucuggucaagggcuuuuaccccagcgacauugccguggaaugggaguccaaugggcaaccugaaaacaauuauaaaaccacacccccugugcuugacucugaugggagcuucuuucuguacuccaagcucacggucgacaagucucgguggcagcagggcaacguguucagcugcuccguuaugcacgaggcucugcauaaucacuauacccagaaaagccuuucucugucccccggcaag

SEQ ID NO: 39301 - RNA, 639 nt, Artificial Sequence
  derived and/or modified sequence opt5 from Vunakizumab_LightChain
gagaucgugcugacccagagccccgacuuccaauccgucacaccuaaggaaaaaguuacgauuaccugcucugccagcuccucugugaacuacaugcacugguuucagcagaagccggaucagagccccaaacucuggaucuauagaacauccaaucuggcuucuggcgugccuagccgguucuccgggagcggaucuggcaccgacuacacacuuaccauuaacucccuggaggccgaagaugcggcuacauauuacugucaacagcgcagcucuuaucccuggaccuuugggcagggaacgaagcucgagaucaaaagaaccgucgccgccccuuccguguucauuuuucccccuagcgacgaacagcugaagucuggcacagcuuccguugugugccuucugaauaacuucuacccgcgggaggccaagguccaauggaaaguggauaaugcucuccagagcgggaacucccaggagucuguuaccgaacaggacagcaaggauuccacauauagccugucuuccacccugacgcucagcaaagccgacuacgagaagcauaaaguguacgcgugugaagucacacaccaaggacugucuagccccgugaccaaguccuuuaaucgcggcgagugc

SEQ ID NO: 39302 - RNA, 1341 nt, Artificial Sequence; identical to SEQ ID NO: 39205
  derived and/or modified sequence opt5 from Xentuzumab_HeavyChain

SEQ ID NO: 39303 - RNA, 648 nt, Artificial Sequence; identical to SEQ ID NO: 39206
  derived and/or modified sequence opt5 from Xentuzumab_LightChain

SEQ ID NO: 39304 - RNA, 726 nt, Artificial Sequence
  derived and/or modified sequence opt5 from anti-rabies_SO57_LightChain
augagcgugcccaccauggccugggcucugcuccugcuuucccugcucacacagggcacggggucuugggcccaaagcgcgcugacccagccuagauccgucucuggaagcccgggccaguccguuacaaucucuugcaccgggacaagcuccgacauuggaggcuacaacuucgugagcugguaucagcaacaccccgggaaggcuccuaaacuuaugaucuacgaugccaccaagcggcccucuggagugccugaccgcuuuuccggcagcaaaucuggcaauacagccucccugaccauuagcgggcuccaggcugaggaugaagccgacuauuacuguugcucuuaugcuggagauuacacgcccggcgucguguucgggggaggcaccaagcugacaguucuggggcagccuaaagccgcgccguccgugacccucuuucccccuagcuccgaggaacugcaggccaacaaggcuacacuugucugucugaucucugacuucuaucccggagccgugaccguugcuuggaaggccgauagcuccccugugaaagcgggcgucgagacgacaacccccagcaagcaaucuaauaacaaauacgccgcuuccagcuaccucucucugacaccggaacaguggaaaagccauagauccuauucuugccaggugacccacgagggcagcaccguggagaagacagucgccccuacggaauguucc

SEQ ID NO: 39305 - RNA, 1428 nt, Artificial Sequence
  derived and/or modified sequence opt5 from anti-rabies_SO57_HeavyChain
auggacuggaccuggagauuccuguuuguggucgccgcugccacaggcguucagagccaagugcagcucgugcaguccggggcggaggucaagaaacccggaucuagcgugaagguuuccugcaaggcuucuggcgggacguucaaccgguacaccgugaauuggguccgccaggccccuggacaaggccuggaauggaugggagggaucauuccgaucuuuggcacagccaacuaugcucagagauuccagggccggcuuaccauuacagccgaugagagcaccuccacagcuuacauggaacugucuagccuccgcuccgacgauaccgccguguauuuuugugcgagagagaaucuggacaacagcgggacguacuauuacuucucuggaugguuugaucccuggggccaggggacccuuguuacaguguccagcgccucuaccaagggaccuuccgucuucccccuggcuccuagcucuaaauccacaagcggcgggaccgccgcucucggaugccuggugaaggacuauuuucccgaaccugugacggucuccuggaacucuggcgcccugacaagcggcguucacaccuucccggcggugcuccaauccagcgggcuguacucucuuuccagcguggucacagugcccucuagcucccugggaacccagaccuacaucuguaauguuaaucauaagccuucuaacacaaaaguggauaagcgggucgagcccaaaagcugcgacaagacgcacaccuguccucccugcccggccccugagcuccugggcgggcccuccguguuucuuuucccucccaaacccaaggauacacugaugauuagccgcaccccugaaguuacauguguggucguggacgucucucaugaggauccggaagugaaguuuaauugguauguugacggaguggagguccacaacgcuaaaaccaagcccagagaggaacaguacaauuccacguaucgggugguuagcgugcucacaguccugcaucaggauuggcugaacggcaaagaguacaagugcaaagugucuaauaaggcccucccugcucccaucgagaaaaccaucuccaaggccaaggggcaaccucgcgaaccccagguguauacccugccgccuagcagagaagagaugaccaaaaaccagguuucccuuacaugucuggucaagggauucuaccccucugacauugccguggagugggaaagcaauggccaaccugagaacaacuauaaaacaacgcccccugugcucgacuccgauggcucuuucuuucuguacagcaaacuuaccgucgacaaaucccgguggcagcaggggaauguguucagcugcucuguuaugcacgaagcucugcacaaccauuacacacagaagucccucagccugucucccggaaag

SEQ ID NO: 39306 - RNA, 696 nt, Artificial Sequence
  derived and/or modified sequence opt5 from anti-rabies_SOJB_LightChain
auggccuggaccgugcugcuccugggccuucugagccacugcacaggguccgucacgucuuacguucucacccagcccccuagcguguccguggcuccgggaaagacagccagaaucaacuguggcgggaauaacauugaguaucggucuguccauugguaccaacagaaaagcggacaggcgcccguggcuguuaucuaugacaauuccgaucgcccuucuggcauucccgaaagauucagcggguccaagagcggaaacaccgccacacugaccaucucucggguggaggccggcgacgaagcugauuacuauugccaggucugggacauuuccagcgaugugguuuuuggcgggggaacaaaacuuaccgugcugggccaaccuaaggccgcucccucugucacccucuucccuccguccagcgaggaacugcaggccaauaaagcgacgcuggugugucucaucucugacuuuuaccccggggccgugacagucgcuuggaaggccgauuccagcccuguuaaggcuggaguggagaccacaacccccuccaaacagucuaacaauaaguaugccgcgagcuccuaccugagccuuacgccugagcaguggaaaucucaccgcuccuacagcugccaagugacacaugaaggcucuaccgucgagaagacaguggcccccaccgaauguagc

SEQ ID NO: 39307 - RNA, 1554 nt, Artificial Sequence
  derived and/or modified sequence opt5 from anti-rabies_SOJB_HeavyChain
auggacacccugugcagcacacuccugcuucugacgauccccuccugggugcucucucagauuacccugaaggagacaggcccuacccuugucaaaccgacacaaacccugacacucaccuguacguucagcggguuuucccugucuaccagcggaguuggcgugggguggaucagacagcccccuggaaaggcccuggaaugggugacacucauuuacugggaugacgauaaacgguauucccccucucuggagaaccgcgucaccaucagaaaggacacaagcaaaaaucagguggcucuuaccaugacgaacauggauccucuggacacaggcaccuacuauugcgcccaccggcagcauauuuccagcuuccccugguuugauucuugggggcaaggaacacucguuaccguguccagcgcgucuaccaagggcccuuccgucuucccgcuggcucccuguagccgcucuacauccggcgggacggccgcccuuggaugccuggugaaggacuacuuuccugaacccguuaccgugagcuggaacuccggcgcucucacaucugggguccacaccuucccugccgugcugcagagcuccggacuguauagccucucuuccguggucacaguucccagcucuagccugggcacccagacguacacauguaaugugaaucauaaaccguccaacaccaagguggauaaaagagucgagcuuaagaccccucugggggacacaacccacacaugcccccgguguccugaacccaaaucuugcgauacgcccccuccguguccccgcugcccugagcccaagagcugugacaccccucccccgugcccuagaugccccgagccuaaguccugugauacacccccucccugcccgcgguguccugcucccgaacuccugggaggccccagcguguuucuuuucccuccgaaacccaaggacacccugaugaucucucgcacaccugagguuaccugcguggucguggacguuucccaugaagaucccgaggugcaguuuaaaugguaugucgacggcguggagguccacaaugccaagacgaaaccuagagaggaacaauucaacagcaccuuucgggugguuucugugcucacaguccugcaccaggauuggcugaaugggaaggaauacaaauguaagguguccaacaaggcgcuccccgccccuaucgagaaaaccauuagcaagacaaaaggacagccccgcgaaccgcagguuuacacccugccucccuccagagaggagaugacgaagaaucaagugucucuuacaugccuggucaaaggcuucuauccuagcgacaucgcuguggaaugggaguccucugggcagcccgaaaacaauuacaacaccacaccgccuaugcucgauagcgacggauccuuuuuccuguauagcaaacuuaccguggauaagucucgguggcagcaaggcaauauuuucuccuguagcguuaugcaugaggcccugcacaaccgcuuuacccagaagucucucucccugagccccgggaag

SEQ ID NO: 39308 - RNA, 702 nt, Artificial Sequence
  derived and/or modified sequence opt5 from anti-rabies_SOJA_LightChain
auggaggcccccgcucagcuccuguuccugcuucugcucuggcugccugacaccacaggcgaaaucgugcuuacgcaaagcccggccacccugucccucucucccggggagagagcgacacuggcuugccgggccagccagaccgccucccgcuaccuggcuugguaucagcagaagccuggacaagcccccagacuccugauuuacgauacaucuaaccgggcuaccggcaucccugcccgcuuuagcggguccggaucuggcacagacuucacccuuagcauuuccagccuggaacccgaggauuuugcggucuauuacugucagcagagauucaauuggccuuggacguuugggcagggaaccaaaguugaguucaagcggacaguggccgcuccgucuguguuuaucuuucccccuuccgacgaacaacucaaaagcggcaccgccucugucgugugccugcuuaacaauuucuauccccgcgaggcuaagguucaguggaaaguggauaacgcccugcaguccggcaauagccaggaaucugucacagagcaagacuccaaggauagcaccuacucccucucuagcacgcugacacuguccaaggcggacuaugaaaaacacaagguguacgccugugagguuacccaucaggggcucagcucuccugugacaaaauccuucaacagaggagagugc

SEQ ID NO: 39309 - RNA, 1422 nt, Artificial Sequence
  derived and/or modified sequence opt5 from anti-rabies_SOJA_HeavyChain
auggaguucggccugagcuggcucuuucugguggccauccuuaaggggguccagugcgaaguucaacugcucgaguccggaggcgggcuggugcagcccggaggcucucuuagacugagcugugcugccuccggguucaccuuuucuaacuacgcgaugagcugggugcggcaggcuccuggaaaaggccucgaaugggucuccgccauuucugccagcggccacuccacauaucuggcugacagcgugaaggggcgcuucacgaucucuagagauaauuccaaaaacacccuguaccuccagaugaauagccugcgggccgaggacacagcuguuuauuacugcgccaaggaucgcgaagugaccaugauugucgugcuuaacggaggcuuugacuauugggggcaaggaacaagaguuaccgugucuuccgcgagcacaaaaggcccgucugucuucccccuggccccuuccagcaaguccaccucugggggaacggcugcccucggcugucuggugaaggauuacuuucccgagccugugaccgucagcuggaacuccggcgcucuuacaagcgggguucauaccuuccccgccgugcugcagucuuccggacucuauagccugucuagcguggucacagugccuuccucuagccugggcacccagacguacaucugcaauguuaaucacaaaccguccaacacaaagguggacaaacgggucgagcccaagagcugugauaaaacccauacaugcccucccuguccugcgcccgaacuccuugggggaccgucuguguuucuguucccucccaagccuaaggacacccugaugauuucccgcacccccgagguuacaugcguggucguggaugucagccacgaagaccccgaggugaaauuuaauugguacguugauggcguggagguccauaacgccaagacgaaaccuagagaggaacaguauaauucuaccuaccgggugguuuccgugcucacaguccugcaccaagacuggcuuaacgggaaggaauauaaauguaaggugagcaauaaagcucugccggcccccaucgagaagaccaucuccaaggcuaaaggacagccucgcgaaccccagguguacacacucccucccucuagagaggagaugaccaagaaccagguuagccugacgugccuggucaaaggcuucuauccguccgauauugccguggaaugggagucuaauggccaaccugaaaacaacuacaagacaacacccccugugcucgacagcgacggguccuuuuuccuguauagcaaacuuaccgucgauaagucucgguggcagcagggaaauguguucuccuguagcguuaugcacgaggcccugcauaaccacuacacccaaaagucucucucccugagccccggcaaa

SEQ ID NO: 39310 - RNA, 321 nt, Artificial Sequence
  derived and/or modified sequence opt5 from anti-rabies_LightChain
gugaugacccagagccccgccacacugucccucucuccuggcgagagagcuacgcugagcugccgggccucccaaucuguccgcaacuaccuugcgugguaucagcagaagccggggcaggcucccagacugcucaucuacggagccagcaaucgggccaccggcauuccugcucgcuucuccgggucuggaagcggcacagacuuuacccugacaaucuccagccuugaacccgaggauuucgccguuuauuacugucaacagagaucugacuggccucuguccuuugggcagggaaccaaacucgaaauuaagcggaca

SEQ ID NO: 39311 - RNA, 333 nt, Artificial Sequence
  derived and/or modified sequence opt5 from anti-rabies_HeavyChain
ggccccgccugggaggugccugaaacccugccgguccagccccucgacagcccuuccguugcuauggccugcacaggggugagacaagcgcccggaaagggccuggaguggguggcugucaucucuuacgaugggagcaacaaauauuacgccgacuccgugaagggacgguucacgauuucucgcgauaauagcaaaaacacccuuuaucugcagaugaacucccucagagccgaagacacagcuguuuacuauugugccaaggauucuaauagcggcuccuacuaugcucacgaccugggguacuggggacagggcacccuugugacaguc

SEQ ID NO: 39312 - RNA, 342 nt, Artificial Sequence
  derived and/or modified sequence opt5 from anti-rabies_LightChain
gagcuggugaugacccagagcccccucucccugccugucacacuuggccaaccggccucuaucagcugcagauccucucagagccugauucacuccaacgggaauacguaccucaacugguuccagcagcggcccggacaaucuccucgcagacugaucuauaagguuagcgaccgggauuccggcgugcccgaccgcuuuagcgggucuggauccggcaccgauuucacacuuaaaauuagcagaguggaagcugaggacgucgggguguacuauugucugcagggaacccauuggccucggacauuuggccagggcaccaagcucgaaaucaaacgcaca

SEQ ID NO: 39313 - RNA, 351 nt, Artificial Sequence
  derived and/or modified sequence opt5 from anti-rabies_HeavyChain
gugguccagcccggcagaagccugcggcucuccugcgccgcuucuggguucaccuuuagcuccuacgccaugcacuggguucgccaagcgccuggaaagggccuggaguggguggcugugaucucuuaugacgggagcaauaaauacuaugccgauuccgucaagggaagauucacaauuucucgggacaauagcaaaaacacgcuuuaccugcagaugaacucccuccgcgccgaagauaccgcuguguauuacugugccagagacaaggcucuggccgcgcggcgcggcuauuacuacuauuacgggacagauguuuggggacagggcacccuugugacagucagcucu

SEQ ID NO: 39314 - RNA, 648 nt, Artificial Sequence
  derived and/or modified sequence opt5 from anti-RSV_5ITB_LightChain
agcgacauccagaugacccaaucccccucuacacugagcgccuccgugggcgauagagucacgauuaccugccgggcuucucagagcaucuccucuuggcucgccugguaccagcagaagccugggaaagcgccgaagcugcuuauuuaugacgcuagcucccuggagagcggaguucccucucgcuucuccggcagcgggucuggaacagaauuuacccucacaaucuccagccugcaaccugaugacuucgccaccuacuauugucagcaguacaacacauauucuugguggaccuuuggccaggggacgaaaguggauauuaagagaaccguggccgcucccuccgucuucaucuuuccucccagcgacgagcaacuuaaauccggaacagccucugugguuugccugcucaauaacuucuacccucgggaagcuaaggugcaguggaaggucgauaaugcccugcagagcggcaacucccaggagagcgugaccgaacaagacucuaaagauuccacauauagccugucuagcacccucacgcuguccaaggcggacuacgagaaacacaagguuuacgccugugaggugacacaucagggccuuucuagcccggucaccaaauccuuuaaucgcggggaaugc

SEQ ID NO: 39315 - RNA, 660 nt, Artificial Sequence
  derived and/or modified sequence opt5 from anti-RSV_5ITB_HeavyChain
guggagagcggcgggggacugauccagcccggcgggucccucagacugucuugcgccgucagcggauucaccguuuccucuaaguacaugacaugggugcggcaagcuccuggcaaagggcuugaaugggugagcgucauuuauggaggcggcuccacguacuaugccgacucugugguugggcgcuuuaccaucagcagagauaacuccaagaauacacuguaccuccagaugaacagccugcgggcggaggacaccgcuguguauuacugugccucucgccuuggagucagagccacaaccggcgaucuggacuauugggggcagggaacacucgugaccguuuccagcgcuucuacgaaaggcccguccguguucccccuggccccuagcucuaaguccaccagcgggggaacagcugcccugggcugccucgucaaagauuacuuucccgaaccugugaccguguccuggaacucuggcgcgcugacaagcgggguccacaccuuccccgccguucuucaguccagcggacuguacucucucuccagcguggugacggucccuucuagcucccugggcacacaaaccuauauuuguaaugugaaucauaagccgucuaacacaaagguugacaaacggguggagcccaagagcugc

SEQ ID NO: 39316 - RNA, 639 nt, Artificial Sequence; identical to SEQ ID NO: 39280
  derived and/or modified sequence opt5 from anti-alpha-toxin_4U6V_LightChain

SEQ ID NO: 39317 - RNA, 675 nt, Artificial Sequence
  derived and/or modified sequence opt5 from anti-alpha-toxin_4U6V_HeavyChain
gaggugcagcuggucgaaagcggcgggggacucguucaacccggcgggucccugagacuuucuugcgccgcuagcggauucaccuuuuccucucacgacaugcauugggugcggcaggccacaggcaaggggcuggagugggugagcggaaucggcacggcgggcgauaccuacuauccugacuccgucaaagggcgcuucacaauuucuagagaaaacgcuaagaauagccucuaccugcagaugaacucccuucgggccggagauaccgccguguauuacugugcucgcgacagauauagcccgacaggccacuacuaugggauggauguuuggggacagggcaccacagugaccgucucuuccgccagcacgaaagggcccucuguguuuccucuggcucccuccagcaagucuaccuccggaggcacagccgcgcucggcugccugguuaaagacuacuucccugagcccgugaccgucagcuggaacuccggggcccugacaucuggagugcauaccuuuccugcugugcuccaaagcuccggccuguacagccuuucuuccgucguuacggugccgagcucuagccuggggacacagaccuauaucuguaaugugaaucacaagcccuccaacacaaaggucgauaaacggguggaaccuaagucuugc

SEQ ID NO: 39318 - RNA, 879 nt, Artificial Sequence
  derived and/or modified sequence opt5 from anti-alpha-toxin_4U6V_Chain-A
gccgacagcgauaucaacauuaagaccggcacaacggacaucggguccaauaccacagugaaaaccggagaucuggucacauacgacaaggagaacggcaugcacaaaaagguuuucuauucuuuuauugaugacaaaaaucauaacaagaagcuccuggugaucagaaccaaagggacaauugcuggacaguaccggguguauagcgaagagggcgccaauaaguccgggcuugcguggcccucugcuuucaaaguccaacugcagcucccugauaacgaaguggcccagaucagcgacuacuauccgcgcaauuccaucgauaccaaggaguacaugucuacgcugaccuauggauuuaacggcaauguuacaggcgacgauaccgggaaaauuggaggccuuaucggggccaacgugagcauuggacacacacugaaguacguccagcccgacuucaagaccauccucgaauccccuacggauaaaaaggugggcuggaaaguuauuuuuaauaacauggugaaucaaaacugggggcccuacgacagagacagcuggaauccugucuauggaaaccagcuguucaugaagacacggaacggcucuaugaaagcugccgauaauuuucuggaccccaacaaggcuuccagccuccugucuuccggcuucagcccugauuuugccaccgugaucacaauggaccgcaaagcgucuaagcagcagaccaauauugaugugaucuacgagagaguccgggacgauuaucaacuucauuggaccuccacaaacuggaaggggacgaauaccaaagacaaguggaucgaucgcagcuccgagagauacaaaauugacugggaaaaggaggaaaugacaaac

SEQ ID NO: 39319 - RNA, 879 nt, Artificial Sequence; identical to SEQ ID NO: 39318
  derived and/or modified sequence opt5 from anti-alpha-toxin_4U6V_Chain-B

SEQ ID NO: 39320 - RNA, 642 nt, Artificial Sequence
  derived and/or modified sequence opt5 from anti-IsdB_5D1Q_Chain-A
gacauccagcugacccaaagccccuccucugugagcgccuccgucggcgauagaauuacaaucacgugccgggcuucucaggacauuagcaacuggguugccugguaccagcagaagccugggaaagcgccgaagcuccugaucuauuccgcuucuagccuucaauccggagugcccagccgcuucucuggcuccgggagcggaaccgauuuuacacugaccauuucuucccuccagccugaggacuucgccacauacuauugucagcaggccaauaccuuucccuggacauucggccaagggaccaaaguggaaaucaagagaacggucgcugccccuagcguguuuaucuuucccccuucugaugagcagcugaaauccggaaccgcuagcguugugugccuucugaacaauuucuacccgcgggaagccaagguccaguggaagguggacaacgcgcuccaguccggcaauucucaagagagcguuacagaacaggauuccaaagacagcaccuauucucuguccagcacacugacccucucuaaggccgauuacgagaaacacaagguguaugcuugugaggucacgcaucagggccugagcucccccgugacaaaaucuuucaaccgcggggaaugc

SEQ ID NO: 39321 - RNA, 783 nt, Artificial Sequence
  derived and/or modified sequence opt5 from anti-IsdB_5D1Q_Chain-B
caggugcaacugguccagagcggcgccgagguuaagaaacccgcuuccucugugaaggugagcugccaggccuccgggggaucuuucagcacccgcacaaucuccuggcuccggcaggcgccuggccaagggcuggaauggaugggaggcauuucuccgaucuuuggggcugccaacuacgcccagcgcuuccagggaagagucacgauuaccgcugacaaaagcacauccaccgccuauauggagcuuacaagccugaccucugaagauacagcuguguacuauugugcccgggacagacccccuggcgcgcaguuugauaccuggggccaagggacgcucguuaccguguccagcgccucuacaaagggacccuccgucuucccucuggcucccagcucuaaauccaccagcggcgggacagccgcucuuggaugccuggugaaggacuacuuuccugagccgguuaccguguccuggaacucuggcgcccucacgagcgggguccacacauuccccgcggugcugcaguccagcggacuguauucucucuccagcguggucaccguuccuucuagcucccugggcacacagaccuacaucuguaaugugaaucauaagcccucuaacaccaaaguggauaagaaagucgaaccuaagagcugcggcgggggauccggccaccaucaccaucaccaccaucaccaucacgggggagacuauaaagaucacgacggcgauuacaaggaccaugauauugacuacaaggaugacgacgauaaa

SEQ ID NO: 39322 - RNA, 822 nt, Artificial Sequence
  derived and/or modified sequence opt5 from anti-IsdB_5D1Q_Chain-C
gaggugcagcuggucgaaagcggcgggggacucguucaacccggcgggucccugacccuuucuugcgccgcuagcggacugaucuucuccgacucuacaaugcacugggugagacaggccagcggccgggggcucgaguggguggcgcgcauuagauccaaggcuaacaauuacgccacgucuagcgauaaauccgccaccgcuuaucuggccagcgucaagggacgguuuacaaucucucgcgacgauuccaaagacaccacauuccuugaaaugagcucucugaagauugaggauaccgcuguguacuauuguaucgccuccagcacaaccggcugguacguuagagaagacuuugauuauuggggccaugggacgcucgugaccgucucuuccgcgagcacaaaaggaccuuccguguucccgcuggcccccucuagcaaguccaccagcggcgggacagcugcccugggaugccucguuaaggacuacuuuccugagcccgugaccgucucuuggaacuccggcgcucugacgagcggggugcacacauucccugccgugcuucagucuagcggacuguauucccucucuagcgucguuaccgugcccuccagcucucugggcacacagaccuacauuuguaaugugaaccauaaaccuuccaauaccaaggucgauaaaaagguggagccgaaaagcugcggcgggggaucuggccaccaucaccaccaucaccaucaccaccaugggggagacuacaaggaucacgacggcgauuauaaggaccaugacaucgauuacaaagacgaugacgauaag

SEQ ID NO: 39323 - RNA, 648 nt, Artificial Sequence
  derived and/or modified sequence opt5 from anti-IsdB_5D1Q_Chain-D
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuagcauuucucgccuggagcccgaagacuucgccguuuauuacugucuccacuauggaacauccccuauguacaccuuuggccaaggcacaaaacuggagaucaagagaaccguggcugcccccagcguguucauuuuuccuccgucugaugaacagcugaaauccgggacggcuagcgucgugugccuccugaacaauuucuauccccgggaggccaagguucaguggaaaguggacaacgcgcuucaguccggaaauucucaagagagcgucaccgaacaggauuccaaggacagcacauacucucuguccagcacccucacacugucuaaggccgauuacgagaaacauaagguguaugcuugugaaguuacccaccagggccuuagcuccccugugacgaaaucuuuuaaccgcggggagugc

SEQ ID NO: 39324 - RNA, 360 nt, Artificial Sequence
  derived and/or modified sequence opt5 from anti-IsdB_5D1Q_Chain-E
cccggcaagaugaccgaccugcaggauacaaaauacguggucuaugagagcguugaaaacaaugaguccaugauggacacguucgugaagcacccuaucaaaaccgggaugcucaacggaaagaaauacauggugauggaaacaaccaaugaugacuauuggaaggauuuuauggucgagggccaaagagugcggacaauuucuaaggacgccaaaaacaauacccgcacaaucauuuucccguacguugaagggaagacccuguaugaugcuaucgugaaaguccaugugaagacgauugacuacgauggacaguaucacguuagaaucguggacaaagaggccuuuaccaaggcgaac

SEQ ID NO: 39325 - RNA, 657 nt, Artificial Sequence
  derived and/or modified sequence opt5 from anti-IsdB_5D1X_Chain-A
gacaucgugaugacccagagcccccugucccucccugucacacugggccaaccggccucuauuagcugcuccucugcucagagccuuguucacuccgauggggacucuuaccugacgugguuccaucagagacccggacagagcccucggcgccucaucuauaagguguccauuagagaugccggcgugcccgaccgguuuagcgggucuggauccggcaccgauuucacacugaaaaucagccgcgucgaggcggaagacguggggguuuacuauuguaugcaagcuacccacuggccuuacacauuuggacagggcaccaagcuggagauuaaaagaacaguggccgcccccucugucuucaucuuuccuccguccgaugaacagcuuaagagcggcaccgcuucugugguuugccuccugaacaauuucuauccccgggaggccaaagugcaguggaaggucgacaacgcucugcaauccgggaauagccaggaauccgugacggagcaggauucuaaggacagcaccuacucccucagcucuacacugacccuuuccaaagccgauuaugagaagcauaaaguguacgcgugugaagucacacaccagggacugagcucuccuguuaccaagagcuuuaaccgcggcgagugc

SEQ ID NO: 39326 - RNA, 777 nt, Artificial Sequence
  derived and/or modified sequence opt5 from anti-IsdB_5D1X_Chain-B
caggugcaacugguccagagcggcuccgagguuaagaaacccgggucuagcgugacccucuccugcaaggccucuggagacacauucaacacgcacaccuacagcugggugagacaggcuccuggccagcggcuggaauggaucgggggaauuaugccgaucuuugccgcguccaaaucugcuccccaucuucaagaucgccugacaauuaccgccaauaaggccacaagaaccgcuuauauggagcucacaagccugaccuccgacgauagcggcgucuacuauugugcccgggacgggcgcggagcccuucaguacuggggccagggcacgcuggugaccguuucuuccgcuagcacaaaagggccuucuguguucccccucgcgccuuccagcaagucuaccuccggaggcacagccgcucuggggugccuggucaaggauuauuuucccgaaccugugaccguuagcuggaacuccggagcccucacgucuggcgugcacacauucccggcuguccugcagagcuccgggcuuuacagccugucuuccguggugaccguccccagcucuagccucggaacacaaaccuauaucuguaauguuaaccauaaaccuuccaauaccaagguggacaaaaagguggagcccaaaucuugcggcggcgggagcggacaccaucaccaccaucaccaucaccaccauggcggggauuacaaggaccacgauggagacuacaaggaucaugacauugauuauaaagacgacgaugacaag

SEQ ID NO: 39327 - RNA, 822 nt, Artificial Sequence; identical to SEQ ID NO: 39322
  derived and/or modified sequence opt5 from anti-IsdB_5D1X_Chain-C

SEQ ID NO: 39328 - RNA, 648 nt, Artificial Sequence
  derived and/or modified sequence opt5 from anti-IsdB_5D1X_Chain-D
gagaucgugcugacccagacacccgccacgcucagccugaccccuggcgaaagagcuacacuuaccugccgggccucccaaucugucagcuccucuuaccuggcgugguaucagcagaagccggggcaggcuccccgccuccugauuuacggagccagcuccagagccacaggcaucccugaccgguucucugggagcggauccggcaccgauuuuacacuuagcauuucucgccuggagcccgaagacuucgcuguuuauuacugucuccacuaugggaccuccccuauguacuuuuucggaagaggcacggugcuggauaucaaacggaccguggccgcucccagcgucuuuauuuucccuccgucugacgagcaacugaaguccggcacagccagcgugguuugccuccugaacaauuuuuauccccgcgaagcgaaagugcaguggaaggucgauaacgcccuucagucuggaaauucccaggagagcgugaccgagcaagacuccaaagauucuacauacagccuguccagcacccucacgcugucuaaggcugacuacgaaaagcauaaaguuuaugccugugaggugacacaccaggggcuuuccagcccugucaccaagucuuucaacagaggcgaaugc

SEQ ID NO: 39329 - RNA, 354 nt, Artificial Sequence
  derived and/or modified sequence opt5 from anti-IsdB_5D1X_Chain-E
aagaugaccgaccugcaggauacaaaauacguggucuaugagagcguugaaaacaaugaguccaugauggacacguucgugaagcaccccaucaaaaccggcaugcucaacgggaagaaauacauggugauggaaacaaccaaugaugacuauuggaaggauuuuauggucgagggacaaagagugcggacaauuucuaaggacgccaaaaacaauacccgcacaaucauuuucccuuacguugaaggcaagacccuguaugaugcuaucgugaaaguccaugugaagacgauugacuacgaugggcaguaucacguuagaaucguggacaaagaggccuuuaccaaggcgaac

SEQ ID NO: 39330 - RNA, 792 nt, Artificial Sequence
  derived and/or modified sequence opt5 from anti-IsdB_5D1Z_Chain-B
gccgaggugcagcuggucgaaagcggcgggggaguugugcaacccggcgggucccucagacugucuugcgcugccagcggauucaccuuuaacaaguucuggaugaauugggugcggcaggcgccuggcaaagggcuugagugggucgcugacauccagguggauggauccgaaaagaacuacguugacucugugaaaggccgcuuuacaauuagcagagauaauggcaagaacucccuguaucuccagaugaacucucugcgggccgaggacacgggggucuacuauugugcccgcggaagauacgauuauuggagcggcuaccuuuccccgugggggcaaggaacccuggugacaguuagcucugcuuccaccaaaggccccagcguguucccucucgcccccucuuccaagagcacaucugggggaaccgcugcccugggcugccuggucaaggacuauuuuccugaacccgugacaguguccuggaauagcggcgcgcucaccuccgggguccacacguucccugccguucugcagucuagcggacuuuacucccugagcucuguggugaccgucccguccagcucucucggcacacagaccuacaucuguaaugugaaccauaaacccagcaauacaaagguugauaaaaagguggagccuaaauccugcgggggaggcucugggcaccaucaccaucaccaccaucaccaucacggaggcgacuauaaggaucacgacggcgauuacaaggaccaugauauugacuauaaagacgaugacgauaag

SEQ ID NO: 39331 - RNA, 642 nt, Artificial Sequence
  derived and/or modified sequence opt5 from anti-IsdB_5D1Z_Chain-C
gacauccagcugacccaaagccccuccuuccucucugccagcguggcugauagagucacaauuacgugccgggccucccaggcgguucgcucuagccuggcuugguaccagcagaagccuggcaaagccccgcaacuucugaucuauuccgccucuacccucgagaacggggugagcuccagauuuagcggaucuggccccgggacagaguucacccugacaauuuccagccuucagccugaagacgugggaaccuacuauugucagcagcugaauacauaccccuuuaccuucggcccugggacgaaggucgaaaucaaacggaccguggcugcccccucuguuuuuauuuucccuccguccgaugagcaacucaagagcggaacagcuucuguggucugccugcugaacaauuuuuauccccgcgaagccaaagugcaguggaagguugacaacgcgcuccaguccggcaauagccaggaguccgugaccgagcaagauucuaaggacagcacauacucccugagcucuacccuuacgcuguccaaagccgauuaugaaaagcacaaagucuacgcuugugaggugacacaucagggccucagcucuccugugaccaagagcuucaacagaggggaaugc

SEQ ID NO: 39332 - RNA, 810 nt, Artificial Sequence
  derived and/or modified sequence opt5 from anti-IsdB_5D1Z_Chain-D
caggugcaacugcaggagagcggccccgggcucgucaagccuuccgaaacccugucucuuaucugcacaguuagcggaggcuccauuucuagcuccucuuacuauuggggguggauccggcagacgccggagcggaaccuggaauggauuggaaucauuuacuucagcggcaccacauauuacaaucccucccuccagagccgcgugucuaugucccuggacagaagcaccaaccgguuuucucuucgccuguccagcgugacagccgcugauaccgccaucuauuacugugcgaaaccuaagucuagagacagagggggacccggcgaugacuauuucggcauggaugucugggggcaaggaaucauggugacaguuuccagcgcuuccaccaaaggcccuucuguguuuccccucgccccuagcuccaagagcacgucugggggaaccgccgcucugggcugccuggucaaagacuacuucccggagcccgugacaguuuccuggaauagcggggcccucaccucuggagugcacacauuuccugcuguccugcagagcuccggccuuuacucucugagcuccguggugaccguccccucuagcucccucggcacgcagacauauauuuguaacguuaaucauaagccuagcaacaccaagguggauaaaaagguggaacccaaaucuugcgggggaggcuccgggcaccaucaccaucaccaccaucaccaucacggaggcgacuacaaggaucacgacggggauuauaaagaccaugauaucgacuacaaggacgaugacgauaag

SEQ ID NO: 39333 - RNA, 810 nt, Artificial Sequence; identical to SEQ ID NO: 39332
  derived and/or modified sequence opt5 from anti-IsdB_5D1Z_Chain-F

SEQ ID NO: 39334 - RNA, 792 nt, Artificial Sequence; identical to SEQ ID NO: 39330
  derived and/or modified sequence opt5 from anti-IsdB_5D1Z_Chain-G

SEQ ID NO: 39335 - RNA, 642 nt, Artificial Sequence
  derived and/or modified sequence opt5 from anti-IsdB_5D1Z_HeavyChain
gacauccagaugacccaaagccccuccuuccugucugccagcgugggcgauagagucacaauuacgugccgggcuucccaggggaucaccacauaccucggaugguaucagcagcgcccuggcaaggccccgcaacugcuuauuuacgcggcuucuagccugcaguccgggguucccccuagauuuucuggaagcggcuccgggaccgaguucacacucaccaucagcucucugcagcccgaagacuuugccacauauuacugucagcaacuuaacaccuauccuuacacguucggacccggcacccggcuggagauuaaacgcacaguggccgcuccuuccguguuuaucuucccgcccagcgaugaacagcucaagucuggcaccgccuccgucgugugccugcugaauaacuuuuauccuagagaggcuaaaguucaguggaagguggacaaugcccuccagagcgggaacucucaagaauccgucacagagcaggauagcaaagacuccaccuacucucugagcuccacgcuuacacugagcaaggcggauuacgagaagcacaaaguguaugccugugaaguuacccaucagggacucucuucccccgugacaaagagcuucaaucggggcgagugc

SEQ ID NO: 39336 - RNA, 471 nt, Artificial Sequence
  derived and/or modified sequence opt5 from anti-IsdB_5D1Z_Chain-I
ggccccgccaaggcuaccaacaauacauacccuauccugaaccaggagcucagagaagccauuaaaaauccggcgaucaaggacaaagaucacagcgcucccaacucccggccuauugacuucgagaugaagaaaaaggaugggacgcaacaguuuuaucauuacgccucuagcgugaagcccgcccgcgucaucuucaccgacuccaaaccugaaauugagcugggacuucagucuggccaguuuuggagaaaguucgaaguuuaugagggggauaaaaagcugcccaucaaacucgugagcuacgacacagugaaggauuaugcuuacauccgguuuuccgucucuaauggaaccaaggccgugaaaauuguuagcuccacacacuucaacaauaaggaggaaaaauaugacuacacccugauggaguuugcucaaccuaucuacaacagcgccgauaaguucaaaaca

SEQ ID NO: 39337 - RNA, 324 nt, Artificial Sequence
  derived and/or modified sequence opt5 from anti-HIV_b12_LightChain
gagaucgugcugacccagagccccggcacacucucccugucuccuggggaaagagccacguucagcugccgguccucucacagcauucgcuccagacgggucgcuugguaccaacauaagccgggacaggcgccccgccuuguuauccacggcgugucuaacagagccagcgggauuuccgaccgguuuagcggaucuggcuccgggaccgauuucacacugaccaucacacgcguggagccugaagacuuugcucucuauuacugucaggucuauggagccagcucuuacaccuucggccagggcacaaaacuggagagaaag

SEQ ID NO: 39338 - RNA, 381 nt, Artificial Sequence
  derived and/or modified sequence opt5 from anti-HIV_b12_HeavyChain
caggugcaacuggagcagagcggcgccgaagucaagaaacccggggcuuccguuaaggugucuugccaggccagcggauacagauucucccacuuuaccgugcauuggguccggcaggcgccuggccaacgcuucgaguggaugggguggaucaacccguauaauggaaacaaagaauuuucugcuaaguuccaggacagagugacauuuacggccgauaccagcgccaauacagcuuacauggagcuccggucccugcgcucugccgacaccgcuguuuauuacugugccagagugggcgaaugggggugggaugacagccccuaugauaacuacuauauggacgucuggggaaaaggcacaaccgugauuguuuccagc

SEQ ID NO: 39339 - RNA, 633 nt, Artificial Sequence
  derived and/or modified sequence opt5 from anti-HIV_2G12_LightChain
guggucaugacccagagccccuccacacugucugccagcguuggcgacacgaucaccauuacaugcagagcuucccaaucuaucgagaccuggcucgccugguaccagcagaagccugggaaagcgccgaagcugcuuauuuauaaagcuagcacacugaagaccggagugcccucccgguucucuggcagcggguccggaacagaauuuacccucacgaucagcggccugcaguucgaugacuuugccaccuaccacugucaacauuaugccggguacucugcuacauucggacagggcacccgcguggagauuaaaagaacagucgccgcuccuuccguguuuaucuuucccccuagcgaugaacagcuuaagucuggcaccgccuccguugugugccugcucaacaauuucuauccccgggaggcgaagguccaguggaaaguggacaacgcccugcaaagcggaaauucucaggaauccguuacggagcaggauagcaaggacuccacauacucucugagcuccacccucacacugagcaaagcugauuaugagaagcacaaaguguacgccugugaagucacccaucaggggcuuucuuccccugugaccaagagcuucaaccgcggc

SEQ ID NO: 39340 - RNA, 672 nt, Artificial Sequence
  derived and/or modified sequence opt5 from anti-HIV_2G12_HeavyChain
gaggugcagcuggucgaaagcggcgggggacucguuaaggccggcgggucccugauccuuucuugcggagugagcaacuucagaauuuccgcucacaccaugaauugggugcggcgcguccccggcgggggacuggaguggguggccucuaucagcacauccucuacguacagagacuaugcggaugcuguuaaaggccgguuuaccgugagccgcgacgaucucgaagacuucgucuaccugcaaaugcauaagaugagaguggaggauacagccauuuauuacugugcccggaaaggcuccgaccgccuuagcgauaacgacccuuuugaugcuugggggccgggaaccguugugacagucucucccgccuccaccaagggcccuagcguguucccccuggcuccuucuuccaaaagcacaucugggggaaccgccgcgcucggcugccuggugaaggacuauuuucccgaaccugucacgguuuccuggaauagcggggcccugaccuccggagugcacacauucccggcugugcuccagucuagcggccuguacucccuuagcucugucgugaccguucccuccagcucucugggcacacagaccuauaucuguaacgugaaucauaagccuagcaacacgaaagucgauaagaaaguggagcccaag

SEQ ID NO: 39341 - RNA, 642 nt, Artificial Sequence
  derived and/or modified sequence opt5 from anti-HIV_4E10_LightChain
gagaucgugcugacccagagccccggcacacaaucccucucuccuggggaaagagccacgcugagcugccgggcuucccagucugucggaaacaauaaacuugccugguaccagcagcgcccgggccaagcgcccagacugcucauuuauggggcuagcucccggccuucuggaguugccgaccgcuucagcggcuccgggagcggaaccgauuuuacacugaccaucucuagacuugagcccgaagacuucgccguguacuauugucagcaguacggccagucccugagcacauuuggccaagggaccaaaguggaggucaagcggacaguggcugccccuucuguuuucauuuuucccccuuccgaugaacagcucaaaagcggaaccgcuucuguggucugccugcugaacaauuucuauccgcgcgaggccaaggugcaguggaaaguugacaacgcgcuccaguccggcaauagccaagaguccgugacggaacaggauucuaaggacagcaccuacucccugagcucuacacuuacccuguccaaggccgauuaugagaaacacaaggucuacgcuugugaagugacacaucaggggcucagcucucccgugaccaagagcuuuaacagaggagag

SEQ ID NO: 39342 - RNA, 684 nt, Artificial Sequence
  derived and/or modified sequence opt5 from anti-HIV_4E10_HeavyChain
caggugcaacugguccagagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcuggggguggcugggaaaacccaucggcgcuuucgcccacugggggcaaggaacccucgugacagucagcucugcguccaccaaaggcccuagcguguuuccccuggccccuucuuccaagagcacaucugggggaaccgcugcccugggcugccucguuaaagacuauuucccggaacccgugacggucuccuggaacagcggcgcucugacauccggggugcauaccuuuccugccgugcuucagucuagcggacuguacucccucagcucugucguuacagugcccuccagcucucugggcacccagaccuauauuuguaaugugaaccacaagccuagcaauacaaaggucgauaaaaagguggagcccaaa

SEQ ID NO: 39343 - RNA, 312 nt, Artificial Sequence
  derived and/or modified sequence opt5 from anti-HIV_VRC01_LightChain
gaaaucgugcugacccagagccccggcacacucucccugucuccuggggaaacggccauuaucagcugcagaaccucccaauacggaucucuugcuugguaucagcagcggccgggccaggcgccccgccuggugauuuacagcggguccacaagagccgcuggaaucccugaccgguucucuggcagccgcugggggcccgauuauaaccucaccauuuccaaucuggagagcggagacuuuggcguuuacuauugucaacaguacgaguucuuuggccaggggacaaagguccagguggauaucaaaaga

SEQ ID NO: 39344 - RNA, 363 nt, Artificial Sequence
  derived and/or modified sequence opt5 from anti-HIV_VRC01_HeavyChain
caggugcaacugguccagagcggcgggcagaugaagaaacccggagaguccaugagaaucucuugccgggccagcggcuacgaguucauugacuguacccucaacuggauccgccuggcuccugggaagagaccggaauggaugggauggcuuaaaccccggggcggggccguuaauuaugcgcgcccucugcagggaagagugacaaugacgcgggauguguacuccgacaccgcuuuucucgaacugcgcucucuuacagucgaugacaccgccguguauuucugcacaagaggcaagaacugugauuacaauugggacuuugagcacuggggccgggggacccccguuauugugagcucc

SEQ ID NO: 39345 - RNA, 330 nt, Artificial Sequence
  derived and/or modified sequence opt5 from anti-HIV_PG9_LightChain
cagagcgcccugacccaacccgcuuccgugucuggcagcccugggcaguccaucacaauuucuugcaacggaacgagcaaugacgucggcggguacgaguccguuucuugguaucagcagcacccgggaaaggcccccaaaguggugaucuacgaugucagcaagagaccuuccggcgugagcaaccgguucucuggguccaaaagcggaaauaccgcgucucucacaauuuccggccugcaagcugaagacgagggcgauuauuacuguaagagccuuaccucuacacgcagacggguuuuugggaccggaacaaaacugaccgugcuc

SEQ ID NO: 39346 - RNA, 408 nt, Artificial Sequence
  derived and/or modified sequence opt5 from anti-HIV_PG9_HeavyChain
cagagacugguggagagcggcgggggagucguucaacccggcuccucucuccggcugagcugcgccgcuuccggguucgacuuuucucgccagggaaugcacugggugagacaggccccuggccaggggcuugaauggguggcguucaucaaguacgauggaagcgagaaauaucaugcugacuccgucuggggccggcugucuauuagccgcgauaacuccaaggacacccucuaccugcaaaugaauagccuuagaguggaagauacagccacguauuuuuguguucgggaggccggcgggccggacuaccgcaacggauauaauuacuaugauuucuacgacggcuacuauaacuaccacuauauggaugugugggggaaaggaaccacagucaccgugucuucc

SEQ ID NO: 39347 - RNA, 630 nt, Artificial Sequence
  derived and/or modified sequence opt5 from anti-HIV_VRC07_LightChain
gagaucgugcugacccagagccccggcacacucucccugucuccuggggaaacggccauuaucagcugcagaaccucccaauacggaucucuugcuugguaucagcagcggccgggccaggcgccccgccuggucauuuacagcggguccacaagagccgcuggaaucccugaccgguucucuggcagccgcugggggcccgauuauacccucacaauuuccaaccuggagagcggagacuuuggcguuuacuauugucaacaguacgaguucuuuggccaggggaccaagguccagguggauaucaaaagaacaguggccgccccuucuguguucaucuuucccccuuccgacgaacaacuuaagagcggaaccgcuucuguugugugccugcucaauaacuucuauccgcgggaagccaaaguccaguggaagguggauaaugcucugcaguccggcaacagccaggagucuguuacggagcaagacuccaaagauagcaccuacucccugucuagcacacucacccuguccaaggccgacuacgaaaagcacaaaguguaugcgugugaggucacacaucaggggcuucgcagccccgugaccaagucuuuuaauagaggagaaugc

SEQ ID NO: 39348 - RNA, 375 nt, Artificial Sequence
  derived and/or modified sequence opt5 from anti-HIV_VRC07_HeavyChain
caggugcaacugguccagagcggcgggcagaugaagaaacccggagaguccaugagaaucucuugccgggccagcggcuacgaguucauugacuguacccucaacuggauccgccuggcuccugggaagagaccggaauggaugggauggcuuaaaccccggggcggggccguuaauuaugcgcgcccucugcagggaagagugacaaugacgcgggauguguacuccgacaccgcuuuucucgaacugcgcucucuuacaagcgaugacaccgccgucuauuucugcacaagaggcaaguacuguaccgcccgggauuauuacaacugggacuuugagcacuggggccaagggacacccgugauuguuuccucu

SEQ ID NO: 39349 - RNA, 315 nt, Artificial Sequence
  derived and/or modified sequence opt5 from anti-HIV_3BNC117_LightChain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcagcccgaggauaucgcgaccuacuuuugucagguguaugaguucguggucccugggacaagacuugaccugaaacggaccguggcugccccc

SEQ ID NO: 39350 - RNA, 387 nt, Artificial Sequence
  derived and/or modified sequence opt5 from anti-HIV_3BNC117_HeavyChain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaaggcccucagauccgacgauacagcuguguauuuuugugcccggcaacgcucugacuacugggauuucgacguuuggggaagcggcacccaggugacagucuccagcgcuucuaccaaaggcccc

SEQ ID NO: 39351 - RNA, 324 nt, Artificial Sequence
  derived and/or modified sequence opt5 from anti-HIV_10-1074_LightChain
agcuacgugagaccccuguccgucgcccucggcgagaccgcucggaucucuugcgggcgccaggcccugggaagcagagcgguucaaugguaucagcaccggccuggccaggcuccgauucuucugaucuacaacaaucaggaccgccccuccgggauuccugaaagauucucuggaacacccgauaucaacuuuggcacgcgggccacccucacaauuagcgggguggaggccggagacgaagcugauuauuacugucauaugugggacucccgcucuggcuucagcugguccuuuggcggggccaccagacugacagugcuu

SEQ ID NO: 39352 - RNA, 396 nt, Artificial Sequence
  derived and/or modified sequence opt5 from anti-HIV_10-1074_HeavyChain
caggugcaacugcaggagagcggccccgggcucgucaagccuuccgaaacccugucuguuacaugcagcguguccggagacucuaugaacaauuacuauuggacguggaucagacagagcccgggcaaagggcuugaguggauuggauacaucuccgaucgggaaucugccaccuauaaccccagccucaauucccgcguggucauuagcagagacacaucuaagaaccagcugucccugaaacuuaauagcgugaccccugcugauacagccguuuacuauugugcgaccgcucggcgcggccaaagaaucuacgggguggucucuuucggagaguuuuucuauuacuacuccauggacguguggggcaagggcacaaccguuacggugagcucu

SEQ ID NO: 39353 - RNA, 633 nt, Artificial Sequence
  derived and/or modified sequence opt5 from anti-HIV_PGT121_LightChain
agcgacaucuccguggcccccggcgagaccgcuagaauuucuugcggggaaaagagccugggaucccgggccguccagugguaccaacaccgcgcgggccaggcuccuucucucaucauuuauaacaaucaggauagaccgagcgggauccccgagcgguucuccggaucuccugacagccccuuuggcacaacggccacccugacaauuaccuccguugaagccggggaugaggcugacuacuauugucauaucugggauagccgcgugccuacaaaauggguguucggaggcggcaccacacuuaccguccuggggcagcccaaggccgcuccuucugugacgcucuuuccgcccuccagcgaagaacugcaagccaacaaagcgacccuuguuugccugaucucugacuucuacccuggagccgugacagucgcuuggaaggccgauuccagccccgugaaagcuggcguugagaccacaaccccuucuaagcaguccaauaacaaguaugccgcgagcuccuaccucucucugacgcccgaacaguggaaaagccacaaguccuauagcugucaggugacacaugaggggucuaccgucgagaaaacaguggccccgaccgagugcucc

SEQ ID NO: 39354 - RNA, 705 nt, Artificial Sequence
  derived and/or modified sequence opt5 from anti-HIV_PGT121_HeavyChain
cagaugcaacugcaggagagcggccccgggcucgugaagccuuccgaaacccugucucuuacaugcagcgucuccggagccucuaucagcgacuccuacuggucuuggauuagacggagcccgggcaaagggcuggaguggaucggauauguucacaaguccggcgauacgaacuacagccccucucucaaaucccgcgugaaucugagccuugacaccucuaagaaccaggugucccugagccucgucgcugccacagcggcugauucugggaaauauuacugugccagaacccugcauggacggcgcauuuauggcaucguggccuucaaugaaugguuuacauacuucuauauggacguuuggggcaacgggacccaggugacagucuccagcgcuuccaccaagggaccuucuguguuuccccuggccccuagcuccaagagcacgucuggcgggaccgcugcccucggaugccugguuaaagauuacuuccccgagccugugacagucuccuggaauagcggcgcgcuuaccucuggggugcacacauuuccggccgugcugcaaagcuccggacucuacucucugagcuccgucguuaccgugcccucuagcucccuuggcacgcagacauauauuuguaacgugaaucauaagccuagcaacaccaaagucgacaagagaguggaacccaaaucuugc

SEQ ID NO: 39355 - RNA, 657 nt, Artificial Sequence
  derived and/or modified sequence opt5 from anti-HIV_PGDM1400_LightChain
gacuucgugcugacccagagcccccacucccucucugucacaccuggcgagagcgccuccaucucuugcaagagcucccauucucugauucacggggauagaaacaauuaccuugcuugguauguucaaaaaccgggacggagcccccagcugcucaucuaccuggccuccagccgcgcgucuggcgugccugacagauuuuccgggagcggaucugauaaggacuucacgcuuaaaauuucccggguggaaaccgaggaugucggcacauauuacuguaugcaggggcgcgaaagccccuggaccuuuggacagggcacaaagguggacaucaaaagaaccguugcugccccuucuguguucauuuuucccccuuccgaugagcaacucaagagcggcacagccuccgucgugugccugcugaacaauuucuauccgcgggaagcuaagguucaguggaaaguggacaacgcccugcagucugggaauagccaggaguccgucaccgagcaagauagcaaggacucuacguacucccucagcucuacccugacacuuagcaaagcugauuaugaaaagcauaaaguguacgccugugaggugacccaccagggacuguccucucccgucacaaagagcuuuaaccgcggcgaaugc

SEQ ID NO: 39356 - RNA, 735 nt, Artificial Sequence
  derived and/or modified sequence opt5 from anti-HIV_PGDM1400_HeavyChain
caggcccaacuggugcagagcggccccgaggucagaaagccugggaccuccguuaaagugucuugcaaggcuccgggaaacacacucaaaacguacgaccugcacugggugcggagcguccccggccaggggcuucaguggaugggauggaucucccaugaaggcgauaagaaagugauuguugagcgcuucaaggccaaggugaccaucgacugggauagaucuacaaauaccgcguaucugcaacucagcgggcugacauccggagacaccgcugucuacuauugugccaaaggcucuaagcaccggcuucgcgauuacgcccuguaugacgaugacggcgcucucaacugggccguggauguugacuaccugagcaaucuggaauuuugggggcagggaacagcugugaccgucuccagcgccucuacgaaaggcccuuccguguucccccucgcgccuagcucuaaguccaccagcgggggaacagccgcucugggcugccuugugaaagauuauuuucccgagccugucaccguuucuuggaacuccggggcccugacaagcggagugcauaccuucccggcugugcuccaguccucuggccuguacagccuuuccagcgucgugacgguucccucuuccagccugggcacacagaccuacauuuguaaugugaaccacaagccuucuaauacaaaggucgacaaaaagguggaacccaaaagcugcgau

SEQ ID NO: 39357 - RNA, 630 nt, Artificial Sequence
  derived and/or modified sequence opt5 from anti-HIV_N6_LightChain
uacauccacgugacccagagccccuccucucugagcgucuccauuggcgacagaguuacaaucaacugccaaacgucucagggggugggaagcgaucuccauugguaucagcacaaaccuggccgggccccgaaacugcuuauucaucacaccuccucuguggaggacgggguccccagccgcuucuccggaagcggcuuucauacaucuuucaaucugaccaucuccgaucuccaggcugacgauauugccacauacuauugucaagugcugcaguuuuucgggagaggaagccggcuucacaucaagcgcaccguugcggcuccuucuguguuuaucuuucccccuuccgacgaacagcugaaaagcggcacagccucugucgugugccuccugaacaauuucuaccccagagaggccaagguucaguggaaaguggauaacgcucugcaauccggcaauagccaggaauccgucaccgagcaggacucuaaggauagcacguauucccucagcucuacccugacacuuuccaaggccgacuacgaaaaacacaagguguaugcuugugaggugacccaucaggggcugagcucuccugucacaaagagcuucaaccggggagagugc

SEQ ID NO: 39358 - RNA, 675 nt, Artificial Sequence
  derived and/or modified sequence opt5 from anti-HIV_N6_HeavyChain
agagcccaccuggugcagagcggcaccgcuaugaagaaacccggggccuccguccggguuucuugccaaacaagcggauacacguucaccgcgcauauccucuuuugguuccgccaggcuccuggcagagggcuggagugggugggauggauuaagccgcaguauggcgccgugaacuuugggggaggcuuccgggaccgcgucacacuuaccagagauguguaccgggaaaucgccuauauggacauucgcggccugaaacccgaugacacagcuguuuacuauugugccagagaucgguccuacggggacucuagcugggcucucgaugccuggggacagggcaccacaguggucguguccgcggccucuaccaaggggccuagcguuuuuccccuggcuccuuccagcaaaucuacguccggaggcaccgccgcucuugggugccuggugaaggacuauuuccccgagccugucacagugagcuggaacucuggagcccucaccuccggcgugcacacauuuccggcgguccugcaaagcucuggccuguacucccucagcuccguugugaccgugcccucuagcucccuggggacgcagacauacaucuguaaugucaaucauaagccuagcaacaccaaaguggauaagaaaguugaacccaagucuugc

SEQ ID NO: 39359 - RNA, 1080 nt, Artificial Sequence
  derived and/or modified sequence opt5 from anti-HIV_N6_GChain
gccugggaggacgcugauaccacacuguucugcgccagcgacgcgaaggcuuacuccacggaaaaacacaacgugugggccacccaugccuguguccccacagauccugacccgcaggagaucccccucgaaaauguuaccgagaacuuuaauauguggaagaacaauaugguggaacaaaugcacgaggauauuaucucucugugggacgagagccuuaaaccuugcgugaugcugacaggcggguccaccauuaagcaggcuugucccaaagucacauucgaaccuauccccauucauuauugcgccccugcuggauuugccauccucaaguguagagaugaggacuucaacggcaccgggccgugcaagaaugugucuacgguucaguguacccacggaaucaaacccguggucagcacacagcugcuucugaacggcucccucgcgaagggggauauugugauccggucugaaaaucugaccaacaaugccaaaguuauuaucgugcaacugaacgagccuguccagauugugugcauccgccccaauaacggaggcagcggcuccgggggagacauuagacaggcucauuguaaugugacacggggcaagugggucaacaucaccaaaaacguuaaggagcagcucuggaagaucuuuaauaaaacgacaaacauuaccuucaauaacacaaucuuuaauagcccugccgggggagaucuggaaauuaccacccacucuuucaacugcggcggggaguuuuucuacuguaauacauccgaccuuuuuaacgaaacgaaucugagcgcuaaccacaccgauacaaaugagaacaucacccuccaaugccgcauuaagcagaucgugagaauguggcagcgggugggacaggccauguaugcgcccccgaucgccggcaauauuacaugcaucucuaacauuaccggccugcuucugacgcgcgacggggucaaugacacacaugauaaagaaaacgagaccuucagaccuaccggaggcgacaugcgggauaacuggcgcuccgagcucuacaaguauaaagugaucaagcugaaa

SEQ ID NO: 39360 - RNA, 645 nt, Artificial Sequence
  derived and/or modified sequence opt5 from anti-HIV_10E8_LightChain
agcuacgagcugacccaggaaacaggcguguccgucgcccucgggagaacgguuaccaucacaugccggggagacucucugcgcagccacuaugcuuccugguaccaaaagaaacccggccaggccccuauucuucuguucuaugggaagaacaauagaccgucuggagugcccgaucgguuuagcggcuccgcgucugggaaccgcgcuagccucaccaucuccggagcccaggccgaggacgaugcugaauacuauuguagcucuagagacaaauccggcagccggcugucuguguucggcgggggaacaaaacuuaccguccugucccagccuaaggccgcucccagcgugacacucuuuccucccucuuccgaggaacugcaagccaauaaggcgacccugguuugccucauuagcgauuucuacccuggcgccgugacggucgcuuggaaggccgacuccucuccggugaaagcugggguugagaccacaacccccagcaagcaguccaacaauaaauaugccgcgagcucuuaccugucccuuacaccugagcaguggaaaagccaucgcucuuacagcugucaggugacccacgaaggauccacggucgagaagacaguggcccccaccgaaugcucu

SEQ ID NO: 39361 - RNA, 708 nt, Artificial Sequence
  derived and/or modified sequence opt5 from anti-HIV_10E8_HeavyChain
gaggugcagcuggucgaaagcggcgggggacucguuaagcccggcgggucccugagacuuucuugcagcgccuccggauucgacuuugauaacgcuuggaugaccugggugcggcaaccuccgggcaaagggcuggagugggugggacgcaucacaggccccggcgaaggguggucugucgacuacgccgcgccuguggagggaagauucacgauuagccggcucaauuccaucaacuuucuguaucuugaaaugaauaaccugcgcauggaggauucuggccucuacuucugugcuagaaccgggaaguauuacgacuuuuggagcggauaucccccuggcgaggaauacuuccaggauugggggcggggaacacugguuaccguguccagcgccucuacaaaaggccccuccgucuuuccucuggccccgagcucuaaguccaccagcggcgggacagcugcccucggaugccuggugaaagacuauuuccccgagccuguuaccgugucuuggaauagcggcgcucuuacgagcgggguccacaccuuucccgccgugcugcaguccucuggacucuacagccuguccagcguggucacaguuccuucuuccagccuuggcacccagacauacauuuguaacgugaaucauaagcccucuaacaccaagguggauaaacgcgucgaaccgaaguccugcgacaaa

SEQ ID NO: 39362 - RNA, 333 nt, Artificial Sequence
  derived and/or modified sequence opt5 from anti-HIV_12A12_LightChain
gacauccagaugacccaaagccccuccucucugagcgccuccgugggcgauagagucacaauuacgugccaggcugggcagggaaucggcucuagccuccagugguaccaacagaagccugggaaagccccgaagcugcuuguucacggagcguccaaccugcaucggggcgugcccucucgcuucagcggguccggauuucacaccacauucagccucaccauuucuggccugcagagagacgauuuugcuacauauuucugugccgugcuugaguuuuucggcccugggaccaaagucgaaaucaagcggacaguggccgcucccuccguu

SEQ ID NO: 39363 - RNA, 381 nt, Artificial Sequence
  derived and/or modified sequence opt5 from anti-HIV_12A12_HeavyChain
agccagcaccuggugcaauccggcacccaggucaagaaacccggggccucuguuagaaucagcugccaggcuuccggauacucuuucacagacuaugugcuccauugguggcggcaggccccuggccaagggcuggaguggaugggauggauuaagccgguguacggcgcgcgcaacuaugcuagacgguuucaggggcgcaucaauuucgauagagacauuuaccgggaaaucgccuuuauggaucuuagcggacugcgcuccgacgauacggcccucuauuucugugcuagagacggcucuggcgaugacaccagcuggcaccuggaucccugggggcagggaacacuugucauuguguccgccgcuagcaccaaaggc

SEQ ID NO: 39364 - RNA, 315 nt, Artificial Sequence
  derived and/or modified sequence opt5 from anti-HIV_12A21_LightChain
gacauccagaugacccaaagccccuccucucugagcgccuccgugggcgauagagucacaauuaacugccaggcugggcagggaaucggcucuagccucaauugguaccagaagaaaccugggcgggccccgaagcugcuuguucacggagcguccaaccugcaacgcggcgugcccucuagauucagcggguccggauuucauacgaccuucacacucaccauuagcucucugcagccugacgauguggcuacauauuuuugugccgucuuccagugguuuggccccggcaccaaaguggacaucaagcggaca

SEQ ID NO: 39365 - RNA, 384 nt, Artificial Sequence
  derived and/or modified sequence opt5 from anti-HIV_12A21_HeavyChain
agccagcaccuggugcaauccggcacccaggucaagaaacccggggccucuguuagagugagcugccaggcuuccggauacacauucacgaacuauauccuccauugguggcggcaggccccuggccaagggcuggaguggaugggacuuauuaagccgguguuuggcgcggucaauuacgcucgccaguuccaggggagaauccagcugacccgggacauuuaucgcgaaaucgccuuucucgaucugucuggacuuagaagcgacgauacagccguguacuauugugcucgggacgaguccggcgaugaccugaaauggcaccuccaucccuggggccaagggacccagguuauugugucuccugccagcacaaagggaccc

SEQ ID NO: 39366 - RNA, 648 nt, Artificial Sequence
  derived and/or modified sequence opt5 from anti-HIV_35022_LightChain
cagagcgugcugacccaauccgccucugucagcggcucccucgggcagucuguuacaaucagcugcacgggacccaacuccguguguugcucucacaagagcauuuccugguaccaguggccuccgggcagagcucccacccugaucauuuaugaggacaaugaacgggccccugggaucagcccccgcuucucuggauacaaauccuauuggagcgcguaccuuacaauuucugaucugagaccugaggacgaaaccacauauuacuguugcuccuauacccauaacagcggcuguguguuugggacaggaaccaaggucucugugcucggccaguccaaagcuaaucccagcguuacgcuguucccuccguccucugaggaacuucaagccaacaaggccacccuggugugccucaucagcgauuuuuaccccggcgcugucacaguggccuggaaagcugacuccagcccuguuaaggccgggguggagaccacaacccccucuaagcaguccaauaacaaauacgcggccagcucuuaucugagccugacgccugagcaguggaagucccaccggucuuacagcugucaggucacacaugaaggauccaccguggagaaaacaguggcucccaccgaaugcagc

SEQ ID NO: 39367 - RNA, 729 nt, Artificial Sequence
  derived and/or modified sequence opt5 from anti-HIV_35022_HeavyChain
gagggccagcuggugcaaagcggggccgaacucaagaaacccggagcuuccgucaagaucucuugcaaaaccagcggcuacagauucaacuuuuaucacauuaauuggauccggcagacagccgggcgcggaccugaguggaugggcuggauuuccccguacucuggggacaagaaccuggcgcccgcuuuccaggauagaguuaucaugacgaccgacacagaagugccugugaccagcuuuacauccaccggagccgccuauauggagauucggaaucuuaaauucgaugacacaggcaccuacuuuugugcuaagggccugcuccgcgaugggucuagcacguggcugcccuaucuuuggggacagggcacccugcucacagucuccagcgccucuaccaaggggccuuccguguucccccuggcuccuagcucuaaauccacaagcggaggcaccgccgcgcuggggugccucguuaaggacuacuuuccggaacccgugacggucucuuggaacuccggagcccugacaagcggcgugcauaccuucccugcuguucuucaauccucuggccuguauagccucuccagcguggucacagugcccucuuccagccuggggacccagaccuacaucuguaaugugaaccacaaaccuucuaauacaaaggucgauaaaagaguugagcccaagagcugcgacaagggacuugaggugcuguuucag

SEQ ID NO: 39368 - RNA, 648 nt, Artificial Sequence
  derived and/or modified sequence opt5 from anti-HIV_3BC176_LightChain
cagagcgugcugacccaacccgccuccgucucugcuagcccuggccaguccaucacaguuucuugcacggggagcagaaacgacgugggaggcuacgauuucguguccugguaucagcggcaccccgggggagucccgaagcucauuaucuacgagauuucuaaacgcccuagcggcaucccccagagauuuuccgggagccggucuggaaauaccgccucccugacaauuagcggccuucaagacgaugacgaagcggauuauuacuguugcucuuaugcuuccuacgaccgccugaucuucggcgggggaaccagagugagcguucuccggcagccuaaggccgcccccucugugacacuguuuccuccguccagcgaggaacuucaggcuaacaaagccacccuggucugucucaucuccgauuucuaucccggcgcugugacaguugccuggaaggcggacgggucuccugugaaagccggagucgagaccacgaagcccagcaagcaguccaauaacaaauacgcugccagcucuuaccugucccugaccccugaacaauggaaaagccaucgcucuuauagcugccaggugacacacgagggcuccaccguggagaagacagucgcucccaccgaauguucu

SEQ ID NO: 39369 - RNA, 699 nt, Artificial Sequence
  derived and/or modified sequence opt5 from anti-HIV_3BC176_HeavyChain
gaacaggugcaacugaugcagagcggcgcccagcucagagaccccggggauucccugaagaucucuugcaaagcuagcggauacaacuucauugacuaucacauccauuggguccggcuugccccuggccgcgggcuggaguggaugggauggauugauccgguuggcgggaucaccaaguacgcgggacaguuucaaggcagacucucccugacacgggacacgucuaccaauacacuuuuccuggagcucagccgccugaccgcuggcgauacagccguguauuuuugugccagauccaugcggcccguggaccacgggauugauuacucuggacuguucgucuuucauuucuggggccgcgggagcgacgugcucguuuccagcgcuucuaccaaaggaccuuccguguuuccccuggccccuagcucuaaguccacaagcggcgggaccgcugcccuuggaugccuggucaaagauuauuuccccgaaccugugacgguuucuuggaacuccggcgcgcucaccagcggcgugcacacauuuccggccguccugcaguccucugggcuuuacagccuguccagcguggugaccguccccucuuccagccucggaacacagaccuauaucuguaauguuaaccauaagccuucuaauacgaagguggacaaaaagguggagcccaaaagcugcgau

SEQ ID NO: 39370 - RNA, 621 nt, Artificial Sequence
  derived and/or modified sequence opt5 from anti-HIV_3BNC55_LightChain
gacauccagaugacccaaagccccuccucucugagcgccuccgugggcgauaaggucacaauuacgugccagaccucugcuggguaccucaacugguaucagcagagacggggacgcgccccuaaacugcuuauguacgacggcagcagacugguuacaggggugccgucccgguucucuggacgcagauggggcacccaauauaaucucacaaucgggagccugcagcccgaggauauugcgaccuacuauugucagguguacgaauuuuucggaccuggcacacggcuugaccugaagcgcaccgucgcugcccccuccguguuuaucuucccucccagcgaugagcagcucaaaucuggcacggccuccguugugugccugcugaacaauuuuuauccuagagaagcuaagguccaauggaaaguggacaacgcccuccagagcgggaauagccaggaguccguuaccgaacaggauagcaaggacucuacauacucccugagcuccacccuuacacugucuaaggcugauuacgagaaacacaagguguaugccugugaggucacccaucaaggacucagcuccccggugacgaaaucuuucaaccggggcgaaugc

SEQ ID NO: 39371 - RNA, 675 nt, Artificial Sequence
  derived and/or modified sequence opt5 from anti-HIV_3BNC55_HeavyChain
caggugcaacugguccagagcggcaccgccguuaagagacccggggcuuccgugcgggugucuugccaggccagcggauacacauucacggacuauuuuaucuacugguggcgccaggcgccuggccaagggcucgaguggcugggauggauuaacccgcuuaccucccagcccucuuauccuagcagauuccagggccggcugacacucacccgcgauacauuugacgaaaugcuguacauggaucuuagagggcugcgguccgacgauaccggaaucuauuucugugcucgcagacacucugacuacugcgauuuugacauuuggggcagcggcacacagaucauugucuccagcgccucuaccaaagggcccuccguguucccucucgcccccagcucuaaguccacgagcggaggcaccgcugcccuggggugucugguuaaagauuauuuuccugagccggugacagucucuuggaacuccggagcucucaccagcggcgugcauacauuccccgccguucugcaauccucugggcuuuacagccuguccagcguggucaccgugccuucuuccagccucggaacgcagacauacaucugcaaugugaaucacaagcccucuaacaccaaagucgacaagcggguugaaccuaagagcugugauaaaaca

SEQ ID NO: 39372 - RNA, 618 nt, Artificial Sequence
  derived and/or modified sequence opt5 from anti-HIV_3BNC60_LightChain
gacauccagaugacccaaagccccuccucucugagcgcccgggugggcgauacagucacgauuaccugccaggcuaacggguaccucaauugguaucagcagcggcgcggaaaggccccuaaacugcuuaucuacgacggcuccaagcuggagagagggguuccggcgcgguucucuggacgcagauggggccaagaauauaaccucacaauuaauaaccugcagcccgaggauguggcuaccuacuuuugucagguguaugaguucaucgucccugggacacggcuugaccugaaacgcaccguggccgcccccagcguuuuuauuuucccucccuccgaugaacagcucaagucuggaacagcuagcguggucugccugcugaauaacuuuuacccuagagaagccaaagugcaauggaagguugacaaugcucuccaguccggcaacagccaggagucugugaccgagcaggauuccaaggacagcacguauucucuguccagcacccuuacacugucuaaagccgauuacgaaaagcacaaagucuacgcgugugaggugacccaucaaggccucuccagcccggugacaaaguccuucaauagaggggaaugc

SEQ ID NO: 39373 - RNA, 687 nt, Artificial Sequence
  derived and/or modified sequence opt5 from anti-HIV_3BNC60_HeavyChain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagagucagccugacgcggcaggccuccugggauuucgacaccuauucuuuuuacauggaucuuaaagccgugcgcagcgacgauacagcuauuuauuucugugccagacaacgguccgacuuuugggauuucgacguuuggggaagcggcacccaggugacagucucuuccgcuagcaccaagggccccucuguguuuccucuggcccccuccagcaaaucuacauccgggggaaccgcggcccucggcugccugguuaaggauuacuucccugaaccggugacggucagcuggaacuccggggcucuuaccucuggagugcauacauuucccgccgugcugcagagcuccggccucuauagccugucuuccgucguuaccgugccuagcucuagccuggggacacagaccuacaucuguaaugugaaucacaagcccuccaacacgaaagucgacaagcgcguggagccuaaaucuugcgauaagaca

SEQ ID NO: 39374 - RNA, 687 nt, Artificial Sequence
  derived and/or modified sequence opt5 from anti-HIV_3BNC60_HeavyChain
gaggugcaccugagccaguccggcgccgcugucaccaagcccggggccucuguuagagugagcugcgaagcguccggauacaaaaucucugaccauuucauucacugguggcggcaagcuccuggccaggggcuccagugggugggauggaucaacccgaagacaggccagcccaauaacgcccgccaauuucaggggagagucagccugacgcggcaggccuccugggauuucgacaccuauucuuuuuacauggaucuuaaagcugugcgcagcgacgauacagccauuuauuucugugcuagacagcgguccgacuuuugggauuucgacguuuggggaagcggcacccaagugacagucucuuccgccagcaccaagggcccuucuguguuuccccuggcgccuuccagcaaaucuacauccgggggaaccgccgcucucggcugccugguuaaggauuacuuccccgagccugugacggucagcuggaacuccggggcccuuaccucuggagugcauacauuuccggcugugcugcagagcuccggccucuauagccugucuuccgucguuaccgugcccagcucuagccuggggacacagaccuacaucuguaaugugaaucacaagccuuccaacacgaaagucgacaagcgcguggaacccaaaucuugcgauaagaca

SEQ ID NO: 39375 - RNA, 648 nt, Artificial Sequence
  derived and/or modified sequence opt5 from anti-HIV_447-52D_LightChain
cagagcgugcugacccaacccccuuccgucucugccgcuccgggccagaagguuacaaucagcugcuccgggucuagcuccaacauuggaaauaacuacgugcucugguaucagcaguuccccggcacggccccuaaacugcuuaucuacgggaauaacaagagacccucuggcauuccugaccgguuuagcggauccaaaagcgggaccucugcgacacugggaaucaccggccuccaaacaggcgaugaggcugacuauuucugugccaccugggauuccgggcugagcgccgacuggguguuuggaggcgggacaaagcucaccguccugucucagcccaaagcugccccuuccgugacgcuuuucccgcccagcucugaggaacugcaggcuaauaaggccacccugguuugccucauuuccgauuuuuacccuggagcggugacagucgccuggaaggcugacagcucccccgugaaagccggcguugaaaccacaaccccuucuaagcagagcaacaauaaauaugcugccuccagcuaccugucucuuacgcccgagcaauggaagucccaccgcagcuauucuugucaggugacacaugaagggagcaccgucgagaaaacaguggcgccgaccgagugc

SEQ ID NO: 39376 - RNA, 693 nt, Artificial Sequence
  derived and/or modified sequence opt5 from anti-HIV_447-52D_HeavyChain
gaggugcagcuggucgaaagcggcgggggacucguuaagcccggcgggucccugagacuuaccugcguggccucuggauucacauuuagcgacguguggcugaacuggguccggcaagcuccuggcaaagggcucgagugggugggacgcaucaaguccagaacggauggcggcaccacagacuacgccgcgucuguuaaagggcgguucaccauuagccgcgaugacuccaagaauacacuguaucuucagaugaacucucugaaaaccgaagauacagcuguguacagcuguaccacggacggauuuaucaugauuagaggcgucuccgaggauuauuacuauuacuauauggacgugugggggaagggaaccacaguuaccgugagcucugccuccacaaagggcccgagcgucuucccccucgccccuugcucucgguccaccagcgggggaacggcugcccugggcugucuggugaaagauuacuuucccgaaccugugacagucucuuggaacuccggcgcucucaccagcgggguucacacauuccccgccgugcugcaguccucuggacuuuacagccuguccagcguggucaccgugccuucuuccagccucggcacccagacauauacgugcaauguuaaucauaagccgucuaacaccaaaguggacaagcgcgucgagcug

SEQ ID NO: 39377 - RNA, 645 nt, Artificial Sequence
  derived and/or modified sequence opt5 from anti-HIV_447-52D_LightChain
cagagcgugcugacccaacccccuuccgucucugccgcuccgggccagaagguuacaaucagcugcuccgggucuagcuccaacauuggaaauaacuacgugcucugguaucagcaguuccccggcacggccccuaaacugcuuaucuacgggaauaacaagagacccucuggcauuccugaccgguuuagcggauccaaaagcgggaccucugcgacacugggaaucaccggccuccaaacaggcgaugaggcugacuauuucugugccaccugggauuccgggcugagcgccgacuggguguuuggaggcgggacaaagcucaccguccugucucagcccaaagcugccccuuccgugacgcuuuucccgcccagcucugaggaacugcaggcuaauaaggccacccugguuugccucauuuccgauuuuuacccuggagcggugacagucgccuggaaggcugacagcucccccgugaaagccggcguugaaaccacaaccccuucuaagcagagcaacaauaaauaugcugccuccagcuaccugucucuuacgcccgagcaauggaagucccaccgcagcuauucuugucaggugacacaugaagggagcaccgucgagaaaacaguggcgccgaccgag

SEQ ID NO: 39378 - RNA, 705 nt, Artificial Sequence
  derived and/or modified sequence opt5 from anti-HIV_447-52D_HeavyChain
gaggugcagcuggucgaaagcggcgggggacucguuaagcccggcgggucccugagacuuaccugcguggccucuggauucacauuuagcgacguguggcugaacuggguccggcaagcuccuggcaaagggcucgagugggugggacgcaucaaguccagaacggauggcggcaccacagacuacgccgcgucuguuaaagggcgguucaccauuagccgcgaugacuccaagaauacacuguaucuucagaugaacucucugaaaaccgaagauacagcuguguacagcuguaccacggacggauuuaucaugauuagaggcgucuccgaggauuauuacuauuacuauauggacgugugggggaagggaaccacaguuaccgugagcucugccuccacaaagggcccgagcgucuucccccucgccccuugcucucgguccaccagcgggggaacggcugcccugggcugucuggugaaagauuacuuucccgaaccugugacagucucuuggaacuccggcgcucucaccagcgggguucacacauuccccgccgugcugcaguccucuggacuuuacagccuguccagcguggucaccgugccuucuuccagccucggcacccagacauauacgugcaauguuaaucauaagccgucuaacaccaaaguggacaagcgcgucgagcugaaaacacccacc

SEQ ID NO: 39379 - RNA, 624 nt, Artificial Sequence
  derived and/or modified sequence opt5 from anti-HIV_5H/I1-BMV-D5_LightChain
gacauccagaugacccaaagccccuccacacugucugccagcauuggcgauagagugacgauuaccugccgggcuuccgaggggaucuaccacuggcucgccugguaucagcagaagccuggaaaagcgccgaagcugcuuaucuacaaggcuucuagccuggccuccggcgcccccucucgcuucagcggguccggaagcggcacagacuuuacccucacaauuucuucccugcagccugaugacuucgcuaccuauuacugucaacaguauagcaacuacccccuuacauuugggggaggcaccaaacuggaaaucaaaagaacggucgccgcuccuucuguuuucaucuuucccccuuccgaugagcagcucaagagcggcaccgccucuguggugugccugcugaauaacuucuauccgcgggaagcgaagguccaguggaaaguggacaaugcccuccaauccgggaacagccaggaguccguuacagaacaggauucuaaggacagcaccuacucccugagcucuacacuuacccuguccaaagcugauuacgagaagcauaaaguguaugccugugaggucacgcaccagggacucagcucucccgugacaaagagc

SEQ ID NO: 39380 - RNA, 651 nt, Artificial Sequence
  derived and/or modified sequence opt5 from anti-HIV_5H/I1-BMV-D5_HeavyChain
caggugcaacugguccagagcggcgccgagguuagaaagcccggggcuuccgugaaagugucuugcaaggccagcggagacaccuucuccucuuacgcgaucagcuggguccggcaggcuccuggccaggggcucgaauggaugggaggcauuaucccgauuuuugggacagccaacuaugcccaggcuuuccaaggacgcgugacgaucaccgccaaugaguccacaucuaccgcuuacauggaacugagcucccuuagaagcgaggauacagccauuuauuacugugcgcgggacaaccccacccugcucggcucugauuauuggggcgccgggacacugguuaccguguccagcgcuucuacgaaaggaccuuccgucuuuccccuugccccuugcagccgcucuaccuccggcgggacagcugcccugggaugucucgugaaggacuacuuccccgaaccuguuaccgugagcuggaacuccggcgcgcugacaucugggguccacaccuuuccggccgugcugcagagcuccggacucuauagccugucuuccguggucacgguucccagcucuagccuuggcacacagaccuacaucugcaaugugaaucauaaaccuuccaacacaaagguggauaagagaguc

SEQ ID NO: 39381 - RNA, 657 nt, Artificial Sequence
  derived and/or modified sequence opt5 from anti-HIV_5H/I1-BMV-D5_A-Chain
augcagcugcucagcggcaucgugcaacagcagaacaaucugcuuagagccauugaggcucagcaacaccuccugcagcugaccgucugggggaucaagcagcuucaggcccggauucuggcgggaggcuccgggggacacacaacguggauggaaugggaccgcgagaucaacaauuacaccucucucauucacagccugaucgaagagucccaaaaccagcaggagaaaaaugaacaggagcugcucgaaggcucuagcgggggacaacugcuuuccggcaucguucagcagcaaaacaaucugcucagagcuauugaggcccagcagcaucugcuucagcugacaguguggggcaucaagcaacuccaggcccggauucuggcugggggaucuggcgggcacaccacauggauggaaugggaucgcgagaucaacaauuauaccagccugauucauucccucaucgaggaaagccagaaccagcaagagaaaaaugaacaggagcugcuugaaggaucuuccggcgggcagcugcucagcggaauugugcagcaacagaacaaucugcuuagagccaucgaggcucagcagcaucugcuccaacugacagucuggggcaucaagcagcugcaggcccggauucucgcgggcggg

SEQ ID NO: 39382 - RNA, 390 nt, Artificial Sequence
  derived and/or modified sequence opt5 from anti-HIV_8ANC195_LightChain
gacauccagaugacccaaagccccuccacacugucugccagcauuggcgauacggugagaaucuccugccgggcuucucagagcauuaccgggaacugggucgccugguaccagcagcgcccuggaaaggcgccgagacuccugaucuaucggggcgcugcccuucucgggggaguucccucccgcuucucuggcagcgccgcugggacagacuuuacccugacaauuggaaaucugcaagccgaggauuucggcaccuuuuacugucagcaguaugacacauacccuggcaccuucgggcagggaacgaaaguggaagugaagagaaccgucgcugcccccuccguguuuaucuucccucccagcgaugagcaacuuaaaucuggcaca

SEQ ID NO: 39383 - RNA, 423 nt, Artificial Sequence
  derived and/or modified sequence opt5 from anti-HIV_8ANC195_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagaaccugacauccgaugacaccgccgucuauuucuguacaaccacaagcaccuacgauaaauggucuggacuucaucacgacggcgugauggccuuuuccagcuggggccaagggacgcugaucucuguuuccgcugccagcaccaagggaccuuccguguuc

SEQ ID NO: 39384 - RNA, 333 nt, Artificial Sequence
  derived and/or modified sequence opt5 from anti-HIV_CAP256-VRC26.01_LightChain
cagagcgugcugacccaacccccuuccgucucugccgcuccgggccagaagguuacaaucagcugcuccgggucuagcuccacgauuggaaacaauuacgugucuugguauagacuccugcccggcaccgccccuaaacuucugaucuacaagaacgacaaucggcccagcgggauuccugaucgcuucuccggaagcaaaucuggcacauccgcgacccucgggaucagcggacugcagacaggcgacgaggcugauuauuacuguggcaccugggacacaucucuuuccgggggaggcguguuugggaccggaacgaaggucaccgugcug

SEQ ID NO: 39385 - RNA, 432 nt, Artificial Sequence
  derived and/or modified sequence opt5 from anti-HIV_CAP256-VRC26.01_HeavyChain
gaggugcaggucguugaaagcggcgggggaguggugcaacccggcagaucccugcggcucucuugcaccgccagcggguucacauuuuccaacuucgcuaugggauggguccgccaggccccuggcaaggggcuggaguggguggcguuuaucucuagcgacggauccaauaaaaacuacggcgauucuguuaagggcagauucacgauuagccgggacaauuccaaaaacaccguguuucuucagaugaauagccugcgcgucgaagauacagcucucuauuacugugccaaggacgugggggauuauaaaucugacgaguggggaaccgaauacuaugauaucuccauuagcuacccgauccaggaccccagagccaugguuggcgcuuucgaucugugggggcaaggaacaauggugaccgucucuccu

SEQ ID NO: 39386 - RNA, 324 nt, Artificial Sequence
  derived and/or modified sequence opt5 from anti-HIV_CAP256-VRC26.02_LightChain
cagagcgugcugacccaacccccuuccgucucugccgcuccgggccagaagguuacaaucagcugcuccgggucuaacagcaauauuggaaacaaagacguguccugguaccagcagauccccgccacggcgccuaagcuccugauuuaugagaauaacaaaagacccucuggcaucagcgaucgguucuccgggagcaagucuggaaccuccgcuacacuugccauuaccggccugcaaacaggggacgaagccgauuacuauugugcuaccugggacggacgcgugagcgucaucggcacaggcaccaaugugaucguucuc

SEQ ID NO: 39387 - RNA, 432 nt, Artificial Sequence
  derived and/or modified sequence opt5 from anti-HIV_CAP256-VRC26.02_HeavyChain
gaggugcagcuggucgaaagcggcgggggaguugugcaacccggcagaucccuccggcugucuugcgccgcuagccaguucuccuuugggaacuacggaaugcacugggugcgccaggccccuggcaaggggcuugagugggucgcggcuaucucuuucgccggaaccaaaacaaauuaugccgacagcgugaagggcagauuuacgauuucccgggauaacucuaaaaauaccguuuaccugcagaugaacagccuccgcgcugaagacacagcccuguauuucugugcuaaggauaucagagaguacgaaugcgaguauuggaccuccgacuacuaugauuuuggccggccgcaacccuguauugacagccgcgggguggucggaacauucgauguguggggccaggggaccaugguuacagugucuucc

SEQ ID NO: 39388 - RNA, 333 nt, Artificial Sequence
  derived and/or modified sequence opt5 from anti-HIV_CAP256-VRC26.03_LightChain
cagagcgugcugacccaacccccuuccgucucugccgcuccgggccagaagguuacaaucagcugcuccgggucuagcuccaacauuggaaauaacuucgugucuugguaccagcagagacccggcacggccccuaaaauccucauuuaugagaauaacaagcggcccagcgaaaccccugaccgcuuuuccgggagcaaaucuggaacauccgcgacccuggcuaucacaggccuucaaaccgccgaugaggccgaauacuauugugcuacauggagcgccucucuguccagcgcuagaguguucgggaccggaacgcggauuaccguccuc

SEQ ID NO: 39389 - RNA, 432 nt, Artificial Sequence
  derived and/or modified sequence opt5 from anti-HIV_CAP256-VRC26.03_HeavyChain
gaggugcagcuggucgaaagcggcgggggaguugugcaacccggcaagucccucagacugucuugcgccgcuagccgguucuccuuuaaucgcuacgggaugcacugggugagacaggccccuggaaaaggccuugagugggucgcggcuaucucuuaugacgggaccgauaaguaccaugccgacaaaguguggggacgguucacaauuagccgcgauaauuccaagaacacgcuguaucuccagaugaacucucugagagccgaagacaccgcucuuuacuauugugccaaagaucugcgggaggacgaaugcgaggagugguggagcgauuacuaugacuuuggcaagcagcucccgugucgcaaguccagaggcguugcugggaucuucgauggauggggccaagggacaauggugaccgucagcucu

SEQ ID NO: 39390 - RNA, 333 nt, Artificial Sequence
  derived and/or modified sequence opt5 from anti-HIV_CAP256-VRC26.04_LightChain
cagcccgugcugacccaaccuccgagcgucuccgccgcucccggccagaagguuacaaucucuugcagcggguccucuagcaacauuggaaauaacuucguguccugguaccagcagagaccuggcacggcccccucucuccugaucuaugagaccaauaaacggccuagcgggauucccgaccgcuuuuccggaagcaagucugcgacauccgcuacccuugccaucacaggccugcaaaccggggaugaagccgacuacuauugugcuacaugggccgcuagccucaccucugccagaguguucggaacgggcaccaaagucauugugucc

SEQ ID NO: 39391 - RNA, 432 nt, Artificial Sequence
  derived and/or modified sequence opt5 from anti-HIV_CAP256-VRC26.04_HeavyChain
gaggugcagcuggucgaaagcggcgggggaguugugcaacccggcaagucccucagacugucuugcgccgcuagccaguucuccuuuaaucgguacgggaugcacugggugcgccaggccccuggaaaaggccuugagugggucgcggcuaucucuuaugacgggaccgauaaguaccaugccgacaaaguguggggaagauucacaauuagccgggauaauuccaagaacacgcuguaucuccagaugaacucucugcgcgccgaagacaccgcucuuuacuauugugccaaagaucugagagaggacgaaugcgaggagugguggagcgauuacuaugacuuuggcaagcaacucccgugucggaagucccgcggcguugcugggaucuucgauaaauggggacagggcacaauggugauugucagcucu

SEQ ID NO: 39392 - RNA, 324 nt, Artificial Sequence
  derived and/or modified sequence opt5 from anti-HIV_CAP256-VRC26.05_LightChain
cagagcgcccugacccaacccccuuccgugucugcugccccgggccagaaggucacaaucagcugcuccgggaacauuggaaauaacuacguuucuugguaucaacaggugcccggcacggcgccuaaacuccugaucuacgagaauaacaagagacccagcgggauuccugaccgguucuccggaucuaaaagcggcaccuccgcuacacuugugaucaccgggcugcagacaggagaugaagccgacuuuuauuguggcaccuggggcgggagccuccgcacaggaggcguccuggggaccggaacgagagugaccguucuu

SEQ ID NO: 39393 - RNA, 432 nt, Artificial Sequence
  derived and/or modified sequence opt5 from anti-HIV_CAP256-VRC26.05_HeavyChain
gaggugcagcuggucgaaagcggcgggggaguugugcaacccggcagaucccuccggcugucuugcgccgcuagccacuucucccuuucuagcuacgggaugcauugggugcgccaggccccuggaaagggccuggagugggucaccgggaucuccuuugcgggaacaaaaacguauuacggcgacucugugagaggccgguucaccguuagccgcgauauuuccaagaacacacucuuucugcagaugaauagccuuagaccggacgauaccgcuauguauuacugugcccgggaccagcgcuauuacgaaugcgaggaaugggccucugauuauuacgacuucgggagagagcaacccugucuggauccucggggaguggucggcaucuuugaccucugggggcagggaacaauggugaccguuuccagc

SEQ ID NO: 39394 - RNA, 324 nt, Artificial Sequence
  derived and/or modified sequence opt5 from anti-HIV_CAP256-VRC26.06_LightChain
cagagcgugcugacccaacccccuuccgucucugccgcuccgggccagaagguuacaaucagcugcuccgggucuacgagcaaaauuggacagaacuccgugucuugguaccagcaacuccccggcaccgccccuaagcugcuuaucuaugagaaugacagacggcccagcgggacaccugaucgcuucuccggaagcaaaucuggcaccuccgcgacacuggcuauuaccgggcuccagacaggagacgaagccgaguacuauugugaaaccugggauggcagcggcgggguguuuggaacgggcaccaaggucacagugcug

SEQ ID NO: 39395 - RNA, 435 nt, Artificial Sequence
  derived and/or modified sequence opt5 from anti-HIV_CAP256-VRC26.06_HeavyChain
gaggugcagcugaucgaaagcggcgggggagucguucaacccggcagaucccuccggcugucuugcggggccagcggauucuccuuuaacaauuacggcaugcacugggugcgccaggcuccugggaagggacuugaguggguggccggcauuucuuucgcgggcaucaaaaaguauuacgggaccagcgucaaaggaagauuuacaauuucccgggacaacucuaagaauaacuucuaucugcagaugaauagccuccgcguggaagauacggcucuguacuauugugccagagaccuucgggagcuggaaugcgaggaguggacccucuacaacuauuacgauuuuggcucccgcgggccguguguugaccccagaggaguggccggcagcuucgaugucugggggcagggaacaauggugaccguuucuucc

SEQ ID NO: 39396 - RNA, 333 nt, Artificial Sequence
  derived and/or modified sequence opt5 from anti-HIV_CAP256-VRC26.07_LightChain
caggccgugcugacccaacccccuagcgucuccgcugccccgggccagaacguuacaaucucuugcagcggguccggaucuaauauuggcaacaauuucgugagcugguaccagcagagacccgggacggcgccuaagcuccugaucuaugaguccaacaaacggcccucuggcauuccugaccgcuuuagcggauccaagagcgggaccucugcuacacuugccaucaccggacugcaaacaggcgaugaagccuacuauuacugugcuaccugggccgcuagacucaauuccgcccggguguucggcacagggaccauggucacggugcug

SEQ ID NO: 39397 - RNA, 432 nt, Artificial Sequence
  derived and/or modified sequence opt5 from anti-HIV_CAP256-VRC26.07_HeavyChain
gaggugcagcuggucgaaagcggcgggggaguugugcaacccggcagaucccuccggcugucuugcguggggagccaguucuccuuuaaccgcuacggaaugcacugggucagacaggccccuggcaaggggcuugaguggguggcuggaaucucuuucgacggcaccgaucgguaucaugccgacaauguuuggggccgcuuuacaauuagcagagauaacuccaaaaauacgcuguaccuccagaugucuagccugcgggcggaagacaccgcucuuuauuacugugccaaggaucugcgcgaggacgaaugcgaggaguggugguccgauuauuacgacuucgggaaaaagcucccguguagaaaaagccggggaguggccggcgucuuugauaagugggggcaaggaacaauggugaccguuucuucc

SEQ ID NO: 39398 - RNA, 333 nt, Artificial Sequence
  derived and/or modified sequence opt5 from anti-HIV_CAP256-VRC26.08_LightChain
cagagcgcccugacccaacccccuuccgugucugcugccccgggccagaaggucacaaucagcugcuccgggaacucuagcaauauuggaaacaauuucguuuccugguaccaacaggugcccggcacggcgccuaaacuccugcuuuaugagaccuacagacggcccucugggaucccugaccgcuuuagcggauccaagagcggcacaucugcuacccuggccauuacagggcuccagaccggagaugaagccgacuauuacuguacaguguggggcgucagaaaaggcgugggggcuguuuucggaaccggcacgaaggugaccguccug

SEQ ID NO: 39399 - RNA, 438 nt, Artificial Sequence
  derived and/or modified sequence opt5 from anti-HIV_CAP256-VRC26.08_HeavyChain
gaggugcagcuggucgaaagcggcgggggaguugugcaacccggcagaucccucacccugucuugcgccgcuagccaguucacauuuuccaacuacgggaugcacugggugcggcaggccccuggaaagggccuugagugggucgcgucugugagcaaugacgggacgaaaaaguaucauggagauuccguuuggggccgcuucaccaucucuagagacaacagcaaaaauacacuguuucuccagauguccagccugcgggcugaagauaccgccguguacuucuguguccgcgaccaaagagaggaugaaugcgaggagugguggucugacuauuacgauuuuggccgggaacuuccgugucgcaaguucagagggcugggacucgccggcauuuuugacaucugggggcacggaacaauggugaccguuuccagc

SEQ ID NO: 39400 - RNA, 333 nt, Artificial Sequence
  derived and/or modified sequence opt5 from anti-HIV_CAP256-VRC26.09_LightChain
cagagcgcccugacccaacccccuuccgugucugcugccccgggccagaaggucacaaucagcugcuccgggaacucuagcaauauuggaaacaauuucguuuccugguaccagcagcuccccggcacggcgccuaaacugcuuaucuaugagaacaauagacggcccucugggauuccugaccgcuuuagcggauccaagagcggcaccucugcuacacuggccaucuccgggcuccaaaccggagaugaagccgacuacuggugugcuguguggggcgugagacggggcgccggggcugucuucggagccggcacaaaagugaccguucug

SEQ ID NO: 39401 - RNA, 438 nt, Artificial Sequence
  derived and/or modified sequence opt5 from anti-HIV_CAP256-VRC26.09_HeavyChain
gaggugcagcuggucgaaagcggcgggggaguugugcaacccggcagaucccucacccugucuugcgccgcuagccaguucaacuuugccaauuacgggaugcacugggugcggcaggcgccuggaaagggccuugagugggucgcuuccaucucuaacgacgggacgaaaaaguaucaugaagagagcguguggggacgcuucacaauuuccaaagauaauucuaagagcacccuguuucuccagaugaacucccugagaaucgaagacacagcccuuuacuucuguguuaaagaucaacgggaggacgagugcgaagagugguggagcgauuauuacgacuuuggccgcgaacugccguguagaaagucucggggccucgggcuggccggaauuuucgauauguggggccacgggaccauggugacagucuccagc

SEQ ID NO: 39402 - RNA, 333 nt, Artificial Sequence
  derived and/or modified sequence opt5 from anti-HIV_CAP256-VRC26.10_LightChain
cagagcgugcugacccaacccccuuccgucucugccgcuccgggccagaagguuacaaucagcugcuccgggucuagcuccaacauuggagacaauuacgugucuugguaucagcaccuccccggcacggccccuaaacugcuuaucuacgagaacaccagacggcccagcgggauuccugaucgcuucuccggaagcaagucuggcacauccgcgacccuggcuaucacagggcuccagaccggagacgaagccgauuauuacuguggcacaugggacgugagacccaaucggggcgccgucuuugggaccggaacgaaagugaccguucug

SEQ ID NO: 39403 - RNA, 432 nt, Artificial Sequence
  derived and/or modified sequence opt5 from anti-HIV_CAP256-VRC26.10_HeavyChain
caggccauccugguggagagcggcgggggagucguucaacccggcagaucccuccggcugucuugcgcugccagccaguucaccuuuuccgggcacggacuucauugggugcgccaggcgccuggcaaggggcuggaauggguggcuucuauuagcuucgccggaacaaaaauggacuacgccgauuccgucaagggcagauuugcuaucucucgggacaacagcaaaaauacgcucuaucugcagaugaacucccuucgcguggaggauaccgcccuguacuauugugcuaaggacaugagagaauacgagugcgaauauuggacaagcgauuacuaugacuucggccggccgcaacccuguauugaucgcagagggguugugggaaucuuugacauguggggccaggggaccauggucacagugucuacc

SEQ ID NO: 39404 - RNA, 321 nt, Artificial Sequence
  derived and/or modified sequence opt5 from anti-HIV_CAP256-VRC26.11_LightChain
cagagcgugcugacccaacccccuuccgucucugccgcuccgggccagaacguuacaaucagcugcuccgggcccccuucucacauugagaagaaugacgugagcugguaccagagacuccccggaauggccccuaaaauggugaucuaugaauccaagcggcgcccccugggcauuccugucagauucucugcgagccgguccgggagcucugcuacgcuugugaucaccggacugcagacagccgaugaggccgacuacuauuguggcaccugggaugggcgcaugaacuuuggaacaggcaccacaguuuccgugcuc

SEQ ID NO: 39405 - RNA, 429 nt, Artificial Sequence
  derived and/or modified sequence opt5 from anti-HIV_CAP256-VRC26.11_HeavyChain
gaggugcagcuggucgaaagcggcgggggaguugugcccccuggcaagucccucacccugucuugcguggccagcagauucacauuuuccgcuuucgggaugcacuggguccggcaagccccgggaaaaggccuugaguggguggcgucuaucagcuuugcugggauuaagaaauacuaugccgacuccguuaagggacgcuucucuaucagcagagauaacuccaauacgcuguuucuccagaugaacggccugcggggcgaagacaccgggcuuuaccauugugugaaagauaugcgcgagcuggaaugcgaggagugggccagcgacuauuacgauuucggaaagccccagccuugucucgacagacggggcgucucugggauuuccgcuugguggggacccggcacaauggugaccguuagcucu

SEQ ID NO: 39406 - RNA, 321 nt, Artificial Sequence
  derived and/or modified sequence opt5 from anti-HIV_CAP256-VRC26.12_LightChain
cagagcgugcugacccaacccccuuccgucucuacagccccgggccagacgguuaccgugagcugcuccgggggaacaucuaacaccggcaauaacuucgugagcugguaccagcaccuccccgggacagcuccuaagcugcuuaucuaugagaauaacaaaagaccccugggagucccugaccgguuuuccggcgccaagucugggaccagcgcgacacucgcuauuaccggacugcagacgggcgaugaaggcgacuacuauugugccaccugguccgggagccuuaauaucggaacaggcaccaaagugucuguucug

SEQ ID NO: 39407 - RNA, 432 nt, Artificial Sequence
  derived and/or modified sequence opt5 from anti-HIV_CAP256-VRC26.12_HeavyChain
gaggugcagcugguccaaagcggcgggggaguugugcagcccggcagaucccuccggcugucuugcgccgcuccuuacuucgaauuugggcgcuauggauuccacugggugagacaggccccgggcaaggggcuugagugggucgcgagcaucuccuuugcuggacgggacuacuaucauucucccagcguguggggccgcuucaccauuuccagagauaacucuaaaaauacacuguaccuccagaugaacagccugcggaucgaagacacggcccuuuauuuuugugcccgcgaucugagagaguccgaaugcgaggagugggaaagcgacuacuaugauuucggcaagaaagggccuuguguuaagccccggggaguggcuggcgggcucgaccuguggggacaaggcaccauggucauugugucuucc

SEQ ID NO: 39408 - RNA, 333 nt, Artificial Sequence
  derived and/or modified sequence opt5 from anti-HIV_CAP256-VRC26.I1_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacaagaauaacgagagacccagcgggauuccugaccgguucuccggaagcaaaucuggcaccuccgcgacacuggggaucaccggacuccaaacaggcgaugaagcugacuauuacuguggcaccugggauacaagccugucugccgggggaguguuuggcaccgggacgaaggucaccgugcuu

SEQ ID NO: 39409 - RNA, 432 nt, Artificial Sequence
  derived and/or modified sequence opt5 from anti-HIV_CAP256-VRC26.I1_HeavyChain
caggugcaacuggucgagagcggcgggggaguugugcagcccggcagaucccuccggcugucuugcgccgcuagcggguucaccuuuuccaacuacgccauggacugggugcgccaggcgccuggaaagggccuugaaugggucgcugugaucucuagcgauggguccaauaaaaacuaugccgacucuguuaagggaagauucacaauuagccgggauaauuccaaaaacacgcuguaccuccagaugaauagccugcgcgccgaggacaccgcuguguauuacugugccaaggaucuuggcgaaaacaaaaaugacgagugggcuacagauuauuacgaccugucuaucgccuauccgguccaagaucccagagcggugguuggcgccuuugacauuugggggcagggaaccauggugacagucuccagc

SEQ ID NO: 39410 - RNA, 333 nt, Artificial Sequence
  derived and/or modified sequence opt5 from anti-HIV_CAP256-VRC26.I2_LightChain
cagagcgugcugacccaacccccuuccgucucugccgcuccgggccagaagguuacaaucagcugcuccgggucuagcuccacgauuggaaacaauuacgugucuugguaucagcuccugcccggcaccgccccuaaacuucugaucuacaagaacgacaaaagacccagcgggauuccugaucgguucuccggaagcaagucuggcacauccgcgacccucgggaucacaggacugcagaccggcgacgaggcugauuauuacuguggcacaugggacaccagccuuucugccgggggaguguuuggcacggggaccaaagucacagugcug

SEQ ID NO: 39411 - RNA, 432 nt, Artificial Sequence
  derived and/or modified sequence opt5 from anti-HIV_CAP256-VRC26.I2_HeavyChain
caggugcaacuggucgagagcggcgggggaguugugcagcccggcagaucccuccggcugucuugcgccgcuagcggguucaccuuuuccaacuucgccaugggaugggugcgccaggcgccuggcaaggggcuugaaugggucgcuuuuaucucuagcgacggauccaauaaaaacuacggcgauucugugaagggcagauucacaauuagccgggacaauuccaaaaacacgcuguuucuccagaugaauagccugcgcgccgaggauaccgcccuuuauuacugugcuaaggacguuggggaauauaaaucugaugagugggccacagacuacuaugaucuguccaucgcuuacccgauucaagaccccagagccauggugggagcguucgauaucuggggccaggggaccauggucacagugagcucu

SEQ ID NO: 39412 - RNA, 333 nt, Artificial Sequence
  derived and/or modified sequence opt5 from anti-HIV_CAP256-VRC26.UCA_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagacccagcgggauuccugaccgguucuccggaagcaaaucuggcaccuccgcgacacuggggaucaccggacuccaaacaggcgaugaagcugacuauuacuguggcaccugggauagcucucuguccgccgggggaguguuuggcacagggaccaaggucacggugcuu

SEQ ID NO: 39413 - RNA, 432 nt, Artificial Sequence
  derived and/or modified sequence opt5 from anti-HIV_CAP256-VRC26.UCA_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuaugcugauucuguuaagggcagauucacaauuagccgggacaauuccaaaaacacgcuguaccuccagaugaauagccugcgcgccgaggauaccgccguguauuacugugcuaaggaccuuggcgaaucugagaacgaagagugggccacagauuauuacgacuuuuccaucggguacccgggacaagaucccagaggcgucgugggggcuuucgacauuuggggacagggcaccaugguuacagugagcucu

SEQ ID NO: 39414 - RNA, 324 nt, Artificial Sequence
  derived and/or modified sequence opt5 from anti-HIV_CH01_LightChain
gagaucgugcuggcccagagccccggcacccucucccugucuccuggggaaagagcuacacuuagcugccgggccucccacaacguccauccgaaguacuucgcgugguaucaacagaaacccggacagucuccucgccugcucauuuacggcgggagcacgagagcugccggaauccccggcaaguuuuccgggucuggaagcggcaccgacuucacacugaccauuucccggguugauccugaggacuuugccguguauuacugucagcaauauggcgggagccccuacacauucggacagggcaccaaaguggaaaucaag

SEQ ID NO: 39415 - RNA, 399 nt, Artificial Sequence
  derived and/or modified sequence opt5 from anti-HIV_CH01_HeavyChain
gaggugcagcuggucgaaagcggcgccaacguugugagacccgggggaucccuccggcugucuugcaaggcuagcggcuucaucuuugagaauuucggguuuuccugggugcgccaagccccuggaaaaggccuucagugggucgcggggcugaacuggaauggaggcgacaccagauacgcugauucugugaagggccgguuccgcaugagcagagacaacucccggaauuuuguuuaucucgauauggacaaagugggggucgaugacacagccuucuacuauugugcccgcggaacggauuacaccauugacgaugcuggcauccacuaucaggggucuggaacauuuugguacuucgaccuguggggcagagggacccuugugagcguuuccagc

SEQ ID NO: 39416 - RNA, 324 nt, Artificial Sequence
  derived and/or modified sequence opt5 from anti-HIV_CH02_LightChain
gagaucgugcugacccagagccccgccacacucuccgucucuccuggcgaaagagcuacgcugagcugccgggccucccaaaacguucacccgcgcuacuucgcgugguaucagcagaagagagggcagucuccccggcuucugauucauagcggauccacccgcgcugccggcaucgccgacagauuuucugggggaggcagcgggaugcacuucacacucaccauuacacggguggagccugaagauuuugcuguguacuucugucaacaguauggaggcucccccuacaccuuuggccaggggacacgcgucgagcugaga

SEQ ID NO: 39417 - RNA, 399 nt, Artificial Sequence
  derived and/or modified sequence opt5 from anti-HIV_CH02_HeavyChain
gaggugcagcuggucgaaagcggcggguccguugugagacccggaggcucucuccggcugagcugccgcgccuccggguucaucuuugagaacuacggacuuaccugggugagacaagucccuggcaaggggcugcacugggugucuggaaugaauuggaacggcggcgacacacgguaugcugauagcguucgcgggagauucuccaugucucgggacaauagcaacaauauugccuaccuccagaugaacaaucugcgcguggaagauacggcgcuuuauuacugugcuagaggaaccgacuauacaaucgaugaccagggccgguuuuaccagggguccggaaccuucugguauuuugauuucuggggccgcgggacacuggucaccgugagcucu

SEQ ID NO: 39418 - RNA, 324 nt, Artificial Sequence
  derived and/or modified sequence opt5 from anti-HIV_CH03_LightChain
gagaucgugcugacccagagccccgccacacucucccugucuccuggcgaaagagcuacgcuuagcugccgggccucccaaucuguccacccgaaguacuucgcgugguaucagcagaaacccgggcagagcccucgccugcucauuuacuccggaucuaccagagcugccggcaucgccgaccgguuuagcgggggaggcuccgggauucauuucacacugaccaucacacgcguugagcccgaagauuuugcuguguauuucugucaacaguacggaggcagcccuuauaccuuuggccaggggacaaagguggagcuuaga

SEQ ID NO: 39419 - RNA, 399 nt, Artificial Sequence
  derived and/or modified sequence opt5 from anti-HIV_CH03_HeavyChain
gaggugcagcuggucgaaagcggcgggggaguugugagacccggcgggucccuccggcugucuugcgccgcuagcggauucauuuuugagaacuacggccuuaccugggugcgccaagucccugggaagggacugcacuggguguccggcaugaauuggaacggcggggacacaagauaugccgauucuguucggggacgcuucagcauguccagagacaauucuaacaauauugcguaccuccagaugaaaaaccugcggguggaugacacggcucuuuauuacugugcccgcggcaccgauuauacaaucgacgaucaggggaucuuuuacaagggaagcggcaccuucugguauuuugaccugugggggagaggaacacucgucaccguguccagc

SEQ ID NO: 39420 - RNA, 324 nt, Artificial Sequence
  derived and/or modified sequence opt5 from anti-HIV_CH04_LightChain
gagaucgugcugacccagagccccgacacacucucccugucuccuggcgaaagagccacgcuuagcugccgggcuucccaaucuguccacagccgcuacuucgccugguaucagcauaagccggggcagcccccuagacugcucauuuacggaggcuccacccgggcgacagggauccccaaccgcuuuucugcuggaggcagcgggacccaguucacacugaccguuaauagacuugaggccgaagauuuugccguguauuacugucaacaguauggacgguccccuuacacauucggccagggcaccaaaguggagauucgc

SEQ ID NO: 39421 - RNA, 399 nt, Artificial Sequence
  derived and/or modified sequence opt5 from anti-HIV_CH04_HeavyChain
gaggugcagcuggucgaaagcggcgggggacucaucagacccggcgggucccugcggcuuucuugcaagggaagcggcuucauuuuugagaacuucggguuuggauggguucgccaaggcccuggcaaagggcuggaauggguguccggaaccaauuggaacggcggggacucuagauacggagauagcgugaagggccgguucacaaucucccgcgacaauucuaacaauuuugucuaucuccagaugaacagccugagaccggaggauacggccauuuacuauugugcucgggggaccgacuacacaaucgaugaccagggcauucgcuaucagggauccggcaccuucugguacuuugaugugugggggagaggaacacuuguuaccgugagcucu

SEQ ID NO: 39422 - RNA, 627 nt, Artificial Sequence
  derived and/or modified sequence opt5 from anti-HIV_CH103_LightChain
uacgagcugacccagcccccuagcguguccgucucuccgggccaaacagccacgaucacgugcagcggggcuuccacaaacguuuguugguaucaggugaagcccggacagucuccugaaguggucauuuucgagaauuacaaaagacccagcggcaucccugaccgguuuuccgggucuaagagcggauccaccgccacacucaccauucgcggcacacaggcgaucgaugaagcugacuauuacugccaagugugggauagcuucucuaccuuuguuuucggguccggaacccaggugaccguccugagacagcccaaagccaacccuacagugacccuuuuuccgcccagcucugaggaacugcaggccaauaaggcuacacucguuugucugauuuccgacuucuauccuggcgccgugaccgucgcuuggaaagccgauagcucucccgugaaggcgggcguggagacgacaaccccuuccaagcaaagcaacaauaaauacgccgcuuccucuuaucuuagccugacacccgagcaguggaagucccaccggagcuacucuugccaggucacccaugaaggguccaccguugagaaaacaguggccccgacggaauguagc

SEQ ID NO: 39423 - RNA, 678 nt, Artificial Sequence
  derived and/or modified sequence opt5 from anti-HIV_CH103_HeavyChain
caggugcaacugcaggagagcggccccggggucguuaaguccucugaaacccucagccugacaugcacgguguccggaggcucuaugggagggaccuacuggagcuggcuuagacuguccccuggcaaagggcucgaguggaucggauauauuuuccacacaggcgaaaccaacuacucuccgagccugaagggccggguguccaucagcgucgacacaucugaggaucaguuuucccuucgccugagaagcgugaccgccgcugacacagccguuuauuucugugcgucucucccccgggggcagcuggugaaugcuuacuuucgcaacuggggaagaggcucccuggucagcgugaccgccgccucuacgaaagggccuuccguuuucccccucgcuccuagcuccaagucuaccagcggaggcacagccgcucuggggugccuugugaaagauuauuuucccgaaccugucaccguguccuggaauagcggagcccugacaucuggcgugcauaccuucccggcgguccuccaauccagcggccuguacucucuuagcuccguugugacggugcccucuagcucccuggggacacagaccuauauuuguaacgucaaucacaagccuagcaacacaaagguggacaaaaagguugagcccaaaucuugcgauaag

SEQ ID NO: 39424 - RNA, 321 nt, Artificial Sequence
  derived and/or modified sequence opt5 from anti-HIV_M66.6_LightChain
gacauccagcugacccaaagccccuccucucucagcgccuccgugggcgauagagucacaauuacgugccgggcuucucagagcaucggguccuaccugaacugguaucagcagaagccuggaaaagccccgaaacuucugauuuacgcggcuucuacccuccaaagcggcguucccucccgcuucagcgggucuggauccggcacagacuuuacccugacaaucagcucucuucagccugaggauuccgccaccuauuacugucagcagagcuauucuacacccuucaccuuugggccuggaacgaagguggacauuaga

SEQ ID NO: 39425 - RNA, 390 nt, Artificial Sequence
  derived and/or modified sequence opt5 from anti-HIV_M66.6_HeavyChain
caggugcaacugguccagagcggcgccgagguuaagaaacccggggaaucccucaagaucucuugcaaagugagcggauacaacuucgcuuccgaguggauuggcugggugagacagaugccugggaagggacuggaauggaugggcaucauuuauccgggggacucugauaccaaauacagccccuccuuucagggacaagucaucauuucugccgacaagagcaucaauacagcguaucuucagugguccagccugaaggcuucugauacggccaucuacuauugugcccggcagaaccacuacggcuccggcagcuauuucuaccgcaccgcuuacuauuacgccauggacgugugggggcagggaacaaccguuacagugucuucc

SEQ ID NO: 39426 - RNA, 327 nt, Artificial Sequence
  derived and/or modified sequence opt5 from anti-HIV_NIH45-46_LightChain
gaaaucgugcugacccagagccccgccacacucucccugucuccuggcgaaacggcuauuaucagcugcagaaccucccaaucugggagccuugccugguaccagcagcggccgggacaggcgccccgccuggucauuuauuccggcucuacaagagcugccgggaucccugaccgguucagcggaucccgcuggggcgccgauuacaaccucagcauuucuaaucuggaguccggggacuuuggaguuuauuacugucaacaguaugaguucuuuggccagggcaccaagguccagguggauaucaaaagaacaguggcugccccc

SEQ ID NO: 39427 - RNA, 399 nt, Artificial Sequence
  derived and/or modified sequence opt5 from anti-HIV_NIH45-46_HeavyChain
caggugcggcugagccaauccggcgggcagaugaagaaacccggagagucuaugcggcucagcugccgcgccuccggcuacgaguuccugaacuguccuaucaauuggauuagacuugcuccggggcggcgccccgaauggaugggauggcugaagccuagaggcggggccgucaacuaugcgcggaaauuucagggacgcguuaccaugacaagagacguguacucugauacggcuuuccucgaacugcggagccuuaccuccgacgauacagccguguauuuuugcacccgcggcaaguacuguacagccagagacuauuacaauugggauuucgagcacuggggcagaggggcucccgucaccgugucuagcgccuccacaaaaggaccuagcguu

SEQ ID NO: 39428 - RNA, 330 nt, Artificial Sequence
  derived and/or modified sequence opt5 from anti-HIV_PG16_LightChain
cagagcgcccugacccaacccgcuuccgugucuggcagcccugggcagacaaucacgauuuccugcaacggaaccucuagcgacgucggcggguucgauuccguuucuugguaccagcagagcccgggaaaggcccccaaagugaugguguuugacgucucccacagaccuagcggcaucucuaaucgguucuccgggagcaagucuggaaacacagcgucccucaccauuagcggccugcauaucgaggaugaaggcgacuauuuuuguucuucccuuacagaucgcagccacagaauuuucgggggaggcaccaaagugacaguucug

SEQ ID NO: 39429 - RNA, 411 nt, Artificial Sequence
  derived and/or modified sequence opt5 from anti-HIV_PG16_HeavyChain
caggagcaacugguggaaagcggcgggggagucguucagcccggcgggucccucagacugucuugccuugccagcggauucaccuuucacaaguacggcaugcauugggugcggcaggcuccugggaaaggacuggaguggguggcccucaucuccgacgauggcaugcgcaaguaucacucugacagcauguggggcagagucacaauuucccgggauaacucuaaaaauacgcuguaccuucaguucagcucccugaagguggaagacaccgcgauguuuuucugugcucgcgaggccgggggaccgaucuggcaugaugacguuaaauauuacgauuuuaacgacggcuauuacaauuaucacuacauggaugugugggggaagggaacaaccgucacagugagcucu

SEQ ID NO: 39430 - RNA, 315 nt, Artificial Sequence
  derived and/or modified sequence opt5 from anti-HIV_PGT122_LightChain
accuucgugagcgucgcccccggccagacagcuagaaucacgugcggggaggaaucccugggaucucggagcguuauuugguaccaacagcgcccuggccaggccccgucccucaucauuuauaacaauaacgacagacccucugggaucccugaucgguuuagcggaucccccggcucuaccuucgggacaaccgcgacacugaccauuacaagcguggaggcuggagacgaagccgauuacuauugucacaucugggacucccgcagaccuaccaauuggguguuuggcgagggcacgacccuuaucguccug

SEQ ID NO: 39431 - RNA, 396 nt, Artificial Sequence
  derived and/or modified sequence opt5 from anti-HIV_PGT122_HeavyChain
caggugcaucugcaagagagcggccccgggcucgucaagccuuccgaaacccugucucuuacaugcaacguuagcggaacgcuggugagagacaauuacugguccuggauccggcagccgcucggcaaacagcccgaguggauuggguaugugcacgauucuggagacaccaacuacaauccuagccugaagucccgcguccaccuuucucuggauaaaagcaagaaccucgugucccugagacugacaggcguuaccgccgcugacagcgccaucuauuacugugcgacaaccaaacaugggcggcgcauuuauggaguggucgcuuucaaggaaugguuuacauacuucuauauggauguguggggcaagggcaccucuguuacgguguccagc

SEQ ID NO: 39432 - RNA, 315 nt, Artificial Sequence
  derived and/or modified sequence opt5 from anti-HIV_PGT123_LightChain
agcuccaugucugugagccccggcgagaccgccaagaucuccugcgggaaagaaucuauuggaagcagagcuguccagugguaccaacagaagccuggccagccgcccucccugaucauuuauaacaaucaggaccggccugccgggguucccgagcgcuucucugcgagcccugauuuuagacccggaacaacggcuacccucacaaucaccaacguggacgccgaagaugaggccgacuacuauugucacauuuacgaugcucggggcgggacaaauuggguguucgaccgcggaaccacacugaccguccuu

SEQ ID NO: 39433 - RNA, 396 nt, Artificial Sequence
  derived and/or modified sequence opt5 from anti-HIV_PGT123_HeavyChain
cagcugcaccuccaagagagcggccccgggcuggugaagccuccggagacccuuucccugacaugcucugucagcggagccuccaucaacgacgcuuacuggucuuggauuagacagagccccggcaaacggccugaguggguuggguaugugcaucacuccggagauacgaauuacaaccccucucucaagcgcagagugaccuucagccuggacacagccaaaaaugaagucucccuuaagcugguggaucucaccgcggcugacagcgccacauauuuuugugcccgggcucugcauggcaaacgcaucuacgggauuguugcccugggagaacucuucaccuauuuuuacauggauguguggggcaagggcacagcugucaccgugucuucc

SEQ ID NO: 39434 - RNA, 315 nt, Artificial Sequence
  derived and/or modified sequence opt5 from anti-HIV_PGT125_LightChain
cagagcgcccugacccaacccccuuccgcuucuggcagcccggggcaguccaucacaauuucuugcaacggaacggccaccaauuucgugagcugguaccagcaguuucccgacaaggcgccuaaacucaucauuuucggcgucgauaagagacccccugggguucccgaccgguuuuccggaucucgcagcggcacaaccgcuucccugacagugagcagacuucaaaccgaugacgaggccguguauuacugugggucucuggucggaaacugggaugugaucuucggcggcgggacaacccucacgguucug

SEQ ID NO: 39435 - RNA, 411 nt, Artificial Sequence
  derived and/or modified sequence opt5 from anti-HIV_PGT125_HeavyChain
cagagccaacugcaggaguccggccccagacucguggaagccucugagacccugagccuuacaugcaacgucuccggggaaucuacgggagcuuguaccuacuucuggggcuggguucggcaggccccugggaagggacuggaguggaucggcagccucucccacugccagucuuuuugggggagcggauggacauuccauaauccgucccugaaaagccgccuuaccauuucucuggacacacccaagaaccaaguguuucucaaacugaccucccugacagcggcugauaccgccacguauuacugugccagauucgacggcgaagugcucgucuauaaucacuggccuaagcccgcuuggguggaucuguggggccgggggaucccuguuaccgugacagucagcucu

SEQ ID NO: 39436 - RNA, 315 nt, Artificial Sequence
  derived and/or modified sequence opt5 from anti-HIV_PGT126_LightChain
cagagcgcccugacccaacccccuuccgcuucuggcagcccggggcaguccaucucuauuagcugcacaggaacguccaacagauucgugucuugguaccagcagcaccccggcaaggccccuaaacucgucaucuaugggguuaauaagcggcccagcggagugccugaccgcuuuuccggcagcaaaucugggaacaccgcgucccugacagugagcggacuucaaaccgaugacgaggcugucuacuauuguucuucccuggugggcaauugggauguuauuuucggcgggggaacaaagcucaccgugcug

SEQ ID NO: 39437 - RNA, 411 nt, Artificial Sequence
  derived and/or modified sequence opt5 from anti-HIV_PGT126_HeavyChain
cagccccaacugcaggagagcggcccugggcucguggaagccuccgagacccugucucuuacaugcacggucagcggagacuccaccgcugccugugauuacuucuggggcuggguuagacagccgcccgggaagggacuggaauggaucggcgggcucucucacugcgcgggauauuacaacacaggcuggaccuaucauaauccuagccugaaaucccggcuuacaauuucucuggacacccccaagaaccagguguuucucaaacugaauagcgugacagcugccgauaccgccaucuacuauugugcucgcuucgacggcgagguccugguguaccacgauuggccuaagcccgccuggguugaccucugggggagaggaacgcuggugaccgucacaguguccagc

SEQ ID NO: 39438 - RNA, 315 nt, Artificial Sequence
  derived and/or modified sequence opt5 from anti-HIV_PGT127_LightChain
cagagcgcccugacccaacccccuuccgcuucuggcagcccggggcaguccaucacaauuucuugcacgggaaccagcaacaauuucguguccugguaccagcaguaucccggcaaggccccuaaacucgucaucuacgagguuaacaagagacccucuggggugccugaccgguuuagcggauccaaaagcggcucuacagcgucccugaccgugagcgggcuucaagcugaugacgaaggagucuauuacuguucuucccuggugggcaauugggauguuauuuucggcgggggaacaaagcucaccgugcug

SEQ ID NO: 39439 - RNA, 405 nt, Artificial Sequence
  derived and/or modified sequence opt5 from anti-HIV_PGT127_HeavyChain
cagccccaacugcaggagagcggcccugggcucguggaagccuccgagacccugucucuuacaugcacggucagcggagacuccaccggcagauguaacuacuucuggggguggguucggcagccgcccggaaagggccuggaauggaucgggucucucagccacugccgcuccuauuacaauacagauuggaccuaucauaacccuucucugaaaagcagacuuacaauuucccuggacacccccaagaaucagguguuucuccggcugacaagcgugaccgcugccgauacggcgaccuacuauugugcucgcuucggaggcgagguccugguguacagagacuggccuaaacccgccuggguugaucucuggggccgggggacacuggugaccgucucuucc

SEQ ID NO: 39440 - RNA, 315 nt, Artificial Sequence
  derived and/or modified sequence opt5 from anti-HIV_PGT128_LightChain
cagagcgcccugacccaacccccuuccgcuucuggcagcccggggcaguccaucacaauuucuugcacgggaaccagcaacaauuucguguccugguaccagcagcacgccggcaaggcgcccaaacucgucaucuaugacguuaacaagagaccuucuggggugcccgaucgguuuagcggauccaaaagcggcaauacagcuucucugaccguguccgggcuucaaacagacgaugaggccgucuacuauuguggaagccuggugggcaacugggacguuauuuucggcgggggaaccaagcucacagugcug

SEQ ID NO: 39441 - RNA, 405 nt, Artificial Sequence
  derived and/or modified sequence opt5 from anti-HIV_PGT128_HeavyChain
cagccccaacugcaggagagcggcccuacccucguggaagccuccgagacacugucucuuacgugcgcugucagcggggacuccaccgccgcguguaacucuuucuggggauggguuagacagccgcccggcaaggggcuggaaugggugggaagccucucccacugcgcuucuuacuggaaucggggcuggacauaucauaacccuagccugaaaucccgccuuacccuggcccucgauacacccaagaaucugguguuucugaaacucaacagcgucaccgccgcugacacagccaccuacuauugugcuagauucgggggagaggugcugcgguacacggauuggccuaagcccgccuggguugaccuuuggggccgcggcacccuggugacagucucuucc

SEQ ID NO: 39442 - RNA, 330 nt, Artificial Sequence
  derived and/or modified sequence opt5 from anti-HIV_PGT130_LightChain
cagagcgcccugacccaacccccuuccgcuucuggcagccucgggcaguccgugacaaucucuugcaacggaacgagcuccgacauuggcggguggaauuucgucucuugguaccagcaguuuccgggacgggcccccagacugaucauuuucgagguuaacaagcgcccuagcggcgugcccgggagauuuuccggaagcaaaucuggcaauuccgcgagccuuaccgugucuggccugcaauccgaugacgaagggcaguauuucuguagcucucucuuuggacggugggaugucguguucggcgggggaacaaagcugaccguucuu

SEQ ID NO: 39443 - RNA, 387 nt, Artificial Sequence
  derived and/or modified sequence opt5 from anti-HIV_PGT130_HeavyChain
caggugcaacugcaggagagcggccccgggcucgucaagccugccgaaacccugucccuuacaugcucuguuagcggagaguccaucaacacgggccacuacuauugggggugggugagacaggugccgggaaaaggccuggaauggauugggcauauccacuacaccacagcuguccuccauaaucccucucuuaagagccggcugaccauuaaaaucuauacacugcgcaaccagauuacccucagacuguccaaugugacagccgcggacaccgcuguuuaccacugugugcggucuggaggcgauauccuguauuacuaugaguggcaaaagccucauugguucagccccuggggcccugggauccacgucacgguguccagc

SEQ ID NO: 39444 - RNA, 330 nt, Artificial Sequence
  derived and/or modified sequence opt5 from anti-HIV_PGT131_LightChain
cagagcgcccugacccaacccccuuccgcuucuggcagccucgggcagucccugacaaucucuugcagcggaacgggcuccgacauugggucuuggaacuucgugagcugguaccagcaguuuccgggcagagcccccaaucuuaucauuuucgaggucaaccggcgcagauccggaguuccugaucgguuuagcgggucuaaguccggaaauaccgcgagccugacagugucuggccuccgcuccgaagacgaggcugaauauuucuguagcucucuguccggcagaugggauaucguguuugggggaggcaccaaagucacagugcuu

SEQ ID NO: 39445 - RNA, 387 nt, Artificial Sequence
  derived and/or modified sequence opt5 from anti-HIV_PGT131_HeavyChain
caggugcaacugcaggagagcggccccgggcucgucaagccuuccgaaacccugucucuuacaugcacgguuagcggagacuccaucaacaccggccaccauuacugggggugggugagacaggugccgggaaaaggccccgaguggauugcccacauccauuauaauacagcuguccugcacaacccugcccucaagucucgggugaccauuagcaucuucacacugaaaaaucuuauuacccugucccucucuaacguuacagcggcugauaccgccguguacuuuuguguccgcagcgggggagacauccuguauuacaucgaauggcagaagccccauugguucuauccuuggggccccggcauucuggugacgguuuccagc

SEQ ID NO: 39446 - RNA, 321 nt, Artificial Sequence
  derived and/or modified sequence opt5 from anti-HIV_PGT135_LightChain
gagaucgugaugacccagagccccgacacacuguccgucucuccuggcgaaacgguuacccucagcugcagagccucccaaaacauuaauaagaaccuggcuugguaccaguauaaaccggggcagucuccccggcuugugaucuucgagacauacagcaagauugccgcguuuccugcucgcuucguggccuccggaucuggcaccgaauuuacacugaccaucaauaacaugcagagcgaggaugucgccguguauuacugucaacaguaugaagaguggcccagaacauucgggcagggaaccaaaguugacauuaag

SEQ ID NO: 39447 - RNA, 399 nt, Artificial Sequence
  derived and/or modified sequence opt5 from anti-HIV_PGT135_HeavyChain
cagcugcaaaugcaggagagcggccccgggcucgugaagccuuccgaaacccugucucuuagcugcacagucuccggagacucuaucagaggcggggaguggggagauaaagacuaccacuggggcuggguucggcauagcgccgggaagggacuggaauggauuggcuccauccacuggcgcggcacgacccauuauaaagagucucucagacggcgcgugagcauguccauugauacaagcagaaacugguucucucugcggcuugcuuccgugaccgccgcggacacagcugucuacuuuugugcccgccacagacaucacgauguguucaugcugguuccgaucgccgggugguuugacguguggggacccggcguccaggugaccguuagcucu

SEQ ID NO: 39448 - RNA, 321 nt, Artificial Sequence
  derived and/or modified sequence opt5 from anti-HIV_PGT136_LightChain
gagaucgugaugacccagagcccucccacacuguccgucucuccgggcgaaacggccacccucagcugcagagcuucccaaaacguuaagaauaaccuggccugguaccagcuuaaacccgggcaggcgccucggcugcucauuuucgacgcuucuagccgcgccggaggcauccccgauagauuuuccgggucuggauauggcacagacuucacccugacagugaauagcgugcaguccgaggauuuuggggacuacuucugucaacaguaugaagaguggccucggaccuuuggacagggcacaaaggucgauauuaaa

SEQ ID NO: 39449 - RNA, 402 nt, Artificial Sequence
  derived and/or modified sequence opt5 from anti-HIV_PGT136_HeavyChain
cagcugcaacuccaggagagcggccccgggcuggugaagccuuccgaaacccuuucucugacaugcacggucagcggaggcuccaugagagggaccgacuggggagagaacgauuuccacuacggcuggauccggcagucuagcgccaaagggcucgaauggauuggauccauccauuggcgcggcagaacaacccacuauaagacaucuuuucggagccgcgcuacccuguccauugacacaagcaauaacagauucucucuuaccuuuuccuucguuacggccgcggauaccgcuguguacuauugugcccggcauaaauaccacgacaucuuucgcguggucccgguggccggcugguucgaucccugggggcagggacugcucguuacagugagcucu

SEQ ID NO: 39450 - RNA, 321 nt, Artificial Sequence
  derived and/or modified sequence opt5 from anti-HIV_PGT137_LightChain
gagaucaugaugacccagagccccgccauucuguccgugucuccuggcgacagagcuacacucagcugccgggccucccaaucugucaagaacaaucuggcgugguaccagaaacgcccggggcaggcucccagacuucugaucuucgauacgagcucccgggccucuggcauuccugcccgcuuuagcggagggggauccggcaccgaguucacacucaccguuaacagcaugcagucugaagacuuugcuacauauuacugucaacaguaugaagaguggcccagaaccuucgggcagggaacaaagguggaaaucaaa

SEQ ID NO: 39451 - RNA, 399 nt, Artificial Sequence
  derived and/or modified sequence opt5 from anti-HIV_PGT137_HeavyChain
gaggugcaccuggaagagagcggccccgggcucgucagaccuuccgaaacccugucucuuacaugcacggccagcggaggcuccauccgcgggggagaguggggcgacucugauuaccauuggggguggguucggcacagcccggaaaagggacuggaguggauuggcuccauccauuggagaggcaccacacacuauaacgcucccuuccgggggcgcggaagacucucuauugaccugagccggaaucaguuuucccuucgccugaccagcgugacagccgaggauaccgcgguguacuauugugucaaacauaaguaccacgacaucgugaugguugugccuauugcuggcugguucgaucccugggggcaaggacuccaggucacagugucuucc

SEQ ID NO: 39452 - RNA, 336 nt, Artificial Sequence
  derived and/or modified sequence opt5 from anti-HIV_PGT141_LightChain
gacaccguggucacacagagcccccugucccucccuguuacgccgggcgaggccgcuucuaugagcugcuccucuacccaaagccugagacacuccaacggggccaauuaccuugcgugguaucagcauaagcccggacagucuccucggcugcucauccgccugggcagccagagagcuuccggggugcccgaucgguucagcggaucuggcuccgggacacacuuuacccuuaaaauuagccgcguggaagccgaggacgccgcuaucuacuauuguaugcaaggacugaacagaccuuggacauucggcaagggcaccaaacucgaaauuaag

SEQ ID NO: 39453 - RNA, 423 nt, Artificial Sequence
  derived and/or modified sequence opt5 from anti-HIV_PGT141_HeavyChain
caggugcaacugguccagagcggccccgagguuaagaaaccuggguccucugugaaggugagcugcaaagccuccggaaacaccuucucuaaguacgacguccacugggugagacaggcuacaggccaggggcucgaauggguuggauggaugagccaugagggcgauaaaacggaauccgcccaacgguuuaaggggcgcgugaccuucacaagagacaccucugcgagcacagcuuauauggagcugcggggacuuaccuccgaugacacagccaucuacuauuguacccgcggcagcaagcacagacugcgggauuacguccucuaugacgauuacggccugauuaauuaucaggaauggaacgacuaccuugaguuucuggaugugugggggcauggaacggccguuaccgugucuucc

SEQ ID NO: 39454 - RNA, 336 nt, Artificial Sequence; identical to SEQ ID NO: 39452
  derived and/or modified sequence opt5 from anti-HIV_PGT142_LightChain

SEQ ID NO: 39455 - RNA, 423 nt, Artificial Sequence
  derived and/or modified sequence opt5 from anti-HIV_PGT142_HeavyChain
caggugcaacugguccagagcggccccgagguuaagaaaccuggguccucugugaaggugagcugcaaagccuccggaaacaccuucucuaaguacgacguccacugggugagacaggcuacaggccaggggcucgaauggguuggauggaucagccaugagcgggauaaaacggaauccgcccaacgcuuuaagggcagagugaccuucacacgggacaccucugcgacaaccgcuuauauggagcugcgcgggcuuacaagcgaugacaccgccauuuacuauuguacgagaggauccaagcaccggcugcgcgauuacguccucuaugacgauuacggccugaucaauuaucaggaauggaacgacuaccuugaguuucuggauguguggggccaugggaccgccguuacagugagcucu

SEQ ID NO: 39456 - RNA, 336 nt, Artificial Sequence
  derived and/or modified sequence opt5 from anti-HIV_PGT143_LightChain
gacaccguggucacacagagcccccugucccucccuguuacgccgggcgaggccgcuucuaugagcugcaccuccacacaaucucugagacacagcaacggggccaauuaccuugcgugguaucagcauaagcccggacaguccccucggcugcucauccgccugggcucucagagagcuagcggggugcccgaucgguucuccggaagcggcucugggacccacuuuacacuuaaaauuucccgcguggaaccugaggacgccgccaucuacuauuguaugcaaggacugaacagacccuggaccuucggcaagggcacaaaacucgaaauuaag

SEQ ID NO: 39457 - RNA, 423 nt, Artificial Sequence
  derived and/or modified sequence opt5 from anti-HIV_PGT143_HeavyChain
caggugcaacuggagcagagcggcgccgaagucaagaaacccggguccucuguuaaggugagcugcaaggcuuccggaaacaccuucucuaaauacgacgugcacugggucagacaggccacaggccaggggcucgagugggugggauggaugagccaugaaggcgauaaaacggaguccgcgcaacgguuuaaggggcgcguuaccuucacaagagacaccucugcuagcacagccuauauggaacugcggggacuuaccuccgaugacacagccaucuacuauuguacccgcggcagcaagcacagacugcgggauuacgugcucuaugacgauuacggccugauuaauuaucaggaguggaacgacuaccuugaguuucuggaugucugggggcauggaacggcugugaccguuucuucc

SEQ ID NO: 39458 - RNA, 336 nt, Artificial Sequence
  derived and/or modified sequence opt5 from anti-HIV_PGT144_LightChain
gacaccguggucacacagagcccccugucccucucuguuacgccuggcgaggccgcuagcauguccugcaccucuacacaaagccugagacacuccaacggggccaauuaccuugcgugguaucagcauaagccgggacagucuccccggcugcucauccgccugggcagccagagagcuuccggggugccugaucgguucagcggaucuggcuccgggacccacuuuacacuuaaaauuagccgcguggaagccgacgaugccgcuaucuacuauuguaugcaaggacugaacagacccuggaccuucggcaagggcacaaaacucgagauuaag

SEQ ID NO: 39459 - RNA, 423 nt, Artificial Sequence
  derived and/or modified sequence opt5 from anti-HIV_PGT144_HeavyChain
caggugcaacugguccagagcggcgccgagguuaagaaacccggguccucugugaaggugagcugcaaggcuuccggaaacaccuucagaaaauacgacguccacugggugcggcaggccacaggccaggggcucgaauggguuggauggaugucucaugagggcgauaaaacggaaagcgcgcaacgcuuuaaggggagaguguccuucacccgggacaauucugcuagcacagccuauaucgagcugcgcggacuuaccuccgaugacacagccauuuacuauuguaccggcggcagcaagcacagacugcgggauuacguccucuaugacgauuacgggcugaucaaccagcaggaauggaaugacuaucuugaguuucuggauguguggggacauggcacagcuguuaccgugucuucc

SEQ ID NO: 39460 - RNA, 336 nt, Artificial Sequence
  derived and/or modified sequence opt5 from anti-HIV_PGT145_LightChain
gagguggucaucacccagagcccccuguuccucccuguuacaccgggcgaagccgcuucccugucuugcaaguguagccacucccuucaacauucuacgggggccaacuaccuggcgugguaucuccagagacccggacagaccccucggcugcuuauucaccuggcuacacaucgcgccagcggcgugcccgacagauuuuccgggucuggaagcggcaccgauuucacacucaaaaucucccggguggagagcgacgaugucgggaccuacuauugcaugcagggacugcacucuccuuggacauuuggccaaggcaccaagguggaaauuaaa

SEQ ID NO: 39461 - RNA, 420 nt, Artificial Sequence
  derived and/or modified sequence opt5 from anti-HIV_PGT145_HeavyChain
caggugcaacugguccagagcggcgccgagguuaagaaacccggguccucugugaaggugagcugcaaggcuuccggaaacucuuucagcaaucacgacguccauugggugagacaggccaccggccaggggcucgaauggaugggauggaugucccacgagggcgauaaaacagggcuggcgcaaaaauuucagggacggguuacgaucacccgcgacucuggcgcuagcacaguguacauggaacuuagaggccugaccgccgaugacacagccauuuauuacugucucaccggguccaagcaucggcugcgcgauuauuuccuuuacaacgaguauggaccuaauuacgaagaguggggcgacuaucuggcuacacucgaugucugggggcacggaaccgccgugacgguuagcucu

SEQ ID NO: 39462 - RNA, 657 nt, Artificial Sequence
  derived and/or modified sequence opt5 from anti-HIV_PGT151_LightChain
gacaucgugaugacccagacaccccugagccucuccgucacgccuggccaaccggccucuauuagcugcaaguccucugagagccugagacaguccaacgggaaaaccucucuuuacugguaucggcagaagcccggacagagcccucaacugcucguuuucgaaguguccaaucgcuuuagcggcgugucugauagauucgucggguccggaagcggcacagacuuuacccugcggaucucucgcguggaggcugaagauguuggguucuacuauuguaugcaguccaaagacuuuccccuuacauucggaggcggcaccaagguggaucugaaaagaacagucgccgcgccuagcguguuuauuuuucccccuucugacgagcagcucaaguccgggaccgcuagcguugugugccugcugaacaauuucuacccgcgggaagccaagguccaguggaaaguggauaacgcccuccaauccggaaauucucaggagagcgugacggagcaggacuccaaggauagcaccuauucucuguccagcacacuuacccugucuaaagcugacuacgaaaagcacaaagucuaugccugugagguuacacaucagggccucagcucccccgugaccaagucuuucaaccgcggggaaugc

SEQ ID NO: 39463 - RNA, 720 nt, Artificial Sequence
  derived and/or modified sequence opt5 from anti-HIV_PGT151_HeavyChain
agagugcagcuggucgagagcggcgggggaguugugcaacccggcaaguccgugcggcucucuugcgucgugagcgacuucccuuuuuccaaauacccgauguauuggguucgccaggcccccgggaagggacuggaauggguggcugccaucucuggcgaugcguggcacgucguguacagcaacuccguucaggggagauuccuugugucucgggacaaugucaaaaacacccuguaucucgagaugaauagccugaagauugaagauacagcuguguaccgcugugccagaauguuucaggaguccggaccuccccggcuugaccgcuggagcggcagaaacuauuacuauuacucuggcauggaugugugggggcaaggaacgaccgucacaguuuccagcgccucuaccaaaggcccuuccguguucccccuggcuccuagcucuaaguccacaagcgggggaaccgccgcucucggcugccuggugaaggacuacuuuccggaacccgucacaguguccuggaacucuggggcccugaccagcggaguucauacguucccugcggugcuccaguccagcggccuguauucucuuuccagcgucgugaccguucccucuagcucccugggcacacagaccuacaucuguaaugugaaucacaaaccuucuaacacaaaggucgauaaacggguggagcccaagagcugcgacaaa

SEQ ID NO: 39464 - RNA, 657 nt, Artificial Sequence
  derived and/or modified sequence opt5 from anti-HIV_PGT152_LightChain
gacaucgugaugacccagacaccccugagccucuccgucgauccuggccaaccggccucuauuagcugcaaguccucucagagccugcggcaguccaacgggaaaacgucucuuuacugguaucagcaaaagcccggacagagcccucagcugcucaucuucgagguuuccaaucgguuuagcggcgugucugaccgcuucgugggguccggaagcggcaccgauuuuacacugagaauuucucgggucgaagcugaggacgugggguucuacuauuguaugcaguccaaagauuuuccccuuaccuucggaggcggcacaaagguugaccugaaacgcaccguggccgcgccuagcgucuuuaucuuucccccuucugaugaacaacucaaguccgggacagcuagcgugguuugccugcugaacaauuucuacccgagagaggccaaggugcaguggaaagucgacaacgcccuccaguccggaaauucucaggaaagcgugaccgagcaagauuccaaggacagcacguauucucuguccagcacccuuacacugucuaaagcugauuacgagaagcacaaaguguaugccugugaagucacccaucagggccucagcucccccguuacaaagucuuucaacagaggggagugc

SEQ ID NO: 39465 - RNA, 720 nt, Artificial Sequence
  derived and/or modified sequence opt5 from anti-HIV_PGT152_HeavyChain
agagugcagcuggucgagagcggcgggggaguugugcaacccggcaaguccgugcggcucucuugcgucgugagcgacuucccuuuuuccaaauacccgauguauuggguucgccaggcccccgggaagggacuggaauggguggcugccaucucugcggaugcuuggcacgucguguacagcggcuccguucaggggagauuccuugugucucgggacaacagcaaaaauauucuguaucucgagaugaacacccugaagaucgaagauacagccgucuaccgcugugccagaauguuucaggaguccggaccuccccgguucgacagcuggucuggccgcaauuauuacuauuacuccggcauggaugugugggggcaaggaacgaccgugacagucagcucugcuuccaccaaaggcccuagcguuuuuccccuugccccuucuuccaagagcacauccgggggaaccgcugcccugggcugccucgugaaggacuacuucccggaacccgugacagucucuuggaacagcggggcgcugaccuccggagugcauacguuuccugccguucugcagagcucuggccucuauucccugagcucuguggucaccgugcccagcuccucucuuggcacacagaccuacauuuguaauguuaaccacaaaccuagcaauacaaagguggauaaaagagucgagcccaaguccugcgacaaa

SEQ ID NO: 39466 - RNA, 309 nt, Artificial Sequence
  derived and/or modified sequence opt5 from anti-HIV_VRC-CH30_LightChain
gacauccagaugacccaaagccccuccucucugagcgccucccucggcgauagagugacaauuacgugccaggcuucucgggggaucggaaaggaccugaacugguaccagcagaaaccuggcaaggccccgaaacuucuggucagcgaugcguccauucucgaagggggaguucccucucgcuucagcggcuccggguuucaccaaaauuucagccugaccaucucuucccuucagccugaggacguggcuacauauuuuugucagcaguacgagaccuucggacaaggcacaaagguggauauuaaa

SEQ ID NO: 39467 - RNA, 393 nt, Artificial Sequence
  derived and/or modified sequence opt5 from anti-HIV_VRC-CH30_HeavyChain
caggugcaacugguccagagcggcgccgcuguuagaaagcccggggccuccgugaccgugucuugcaaauucgcggaggacgaugacuacagcccucacugggucaacccggcucccgaacauuauauccacuuucuccggcaggccccuggacagcaacuggaguggcuugccuggaugaaucccacaaacggcgcugugaauuacgccuggcagcugcaugggcgccucacggcuaccagagauggauccaugacaaccgccuuccuggaaguucggucucuucgcagcgacgauacagcgguguauuacugugccagagcucagaagcggggccgcuccgagugggccuaugcucacugggggcagggaaccccugucgccgugucuagc

SEQ ID NO: 39468 - RNA, 309 nt, Artificial Sequence
  derived and/or modified sequence opt5 from anti-HIV_VRC-CH31_LightChain
gacauccagaugacccaaagccccuccucucugagcgccucccucggcgauagagugacaauuacgugccaggcuucucgggggaucggaaaggaccugaacugguaccagcagaaagccggcaaggcgccuaaacuucuggucagcgaugcuuccacccucgaagggggaguuccgucucgcuucagcggcuccggguuucaccaaaauuucagccugacaauuucuucccuucaggccgaggacguggccaccuauuuuugucagcaguacgagacauucggacaaggcaccaagguggauaucaaa

SEQ ID NO: 39469 - RNA, 393 nt, Artificial Sequence
  derived and/or modified sequence opt5 from anti-HIV_VRC-CH31_HeavyChain
caggugcaacugguccagagcggcgccgcuguuagaaagcccggggccuccgugaccgugucuugcaaauucgcggaggacgaugacuacagcccuuauugggucaacccggcucccgaacacuuuauccauuuccuccggcaggccccuggacagcaacuggaguggcuugccuggaugaaucccacaaacggcgcugugaauuacgccugguaucugaacgggcgcguuacggcuaccagagaucgguccaugacaaccgccuuucucgaagugaagucucugcgcagcgacgauacagcggucuacuauugugccagagcucagaaacggggacgcuccgagugggccuacgcucacuggggccaggggaccccugugguugugucuagc

SEQ ID NO: 39470 - RNA, 309 nt, Artificial Sequence
  derived and/or modified sequence opt5 from anti-HIV_VRC-CH32_LightChain
gacauccagaugacccaaagccccuccucucugagcgccucccucggcgauagagugacaauuacgugccaggcuucucgggggaucggaaaggaccugaacugguaccagcagaaaccuggccgcgccccgaaacuucuggucagcgaugcguccauucucgaagggggaguucccaccagauucucuggcagcggguuucaccaaaauuucucccugacaaucagcucucuucaggcugaggacguggccaccuauuuuugucagcaguacgagacauucggacaaggcaccaagguggauauuaag

SEQ ID NO: 39471 - RNA, 393 nt, Artificial Sequence
  derived and/or modified sequence opt5 from anti-HIV_VRC-CH32_HeavyChain
caggugcaacugguccagagcggcgccgcuguuagaaagcccggggccuccgugaccgugucuugcaaauucgcggaggacgaugacuuuagcccucacugggucaacccggcucccgaacauuacauccacuuccuccggcaggccccuggacagcaacuggaguggcuugccuggaugaagcccacaaauggcgcugugaacuaugccuggcagcugcaggggcgcguuacggugaccagagaucggucccagacaaccgcuuuucucgaagucaaaaaucugcgcucugacgauacagccguguacuauugugcgagagcccaaaagcggggacgcagcgagugggcuuacgcccauuggggccaggggaccccuguugugauuuccgcu

SEQ ID NO: 39472 - RNA, 309 nt, Artificial Sequence
  derived and/or modified sequence opt5 from anti-HIV_VRC-CH33_LightChain
gacauccagaugacccaaagccccuccucucugagcgccucccucggcgauagagugacaauuacgugccaggcuucucgggggaucggaaaggaccugaacugguaccagcagaaacgcggcagagccccucggcuucuggucagcgaugcguccguucucgaagggggagugccgucucgcuucagcggcuccggguuucaccaaaauuucagccugaccauuucuacacuucagcccgaggacguggcuaccuauuuuugucagcaguacgagacauucggacaaggcaccaaggucgauaucaaa

SEQ ID NO: 39473 - RNA, 393 nt, Artificial Sequence
  derived and/or modified sequence opt5 from anti-HIV_VRC-CH33_HeavyChain
caggugcaacugguccagagcggcgccgcuguuagaaagcccggggccuccaucucugugagcugcaaauucgcggacgcugaugacuacuccccucacuggaugaacccggcccccgagcauuauauucacuuucuccggcaggccccuggacagcaacuggaauggcuugcuuggaugaaucccaccaacggcgccgugaauuacgcuugguaucugaacgggcgcgucacagccacgagagaucggucuaugaccacagcguuccucgaggugcgcagccugagauccgacgauaccgccguuuacuauugugcucgggcccagaagcgcgcuagaucugaaugggccuacgcgcauuggggacagggcacaccuguggucgugagcucc

SEQ ID NO: 39474 - RNA, 309 nt, Artificial Sequence
  derived and/or modified sequence opt5 from anti-HIV_VRC-CH34_LightChain
gacauccagaugacccaaagccccuccucucugagcgccucccucggcgauagagugacaauuacgugccaggcuucucgggggaucggaaaggaccugaacugguaccagcagaaagccggcaaggcgccuaaacuucuggucagcgaugcuuccauucucgaagggggaguuccgucucgcuucagcggcuccggguuucaccaaaauuucagccugaccaucucuucccuucagcccgaggacguggccacauauuuuugucagcaguacgagaccuucggacaaggcacaaagguggauauuaaa

SEQ ID NO: 39475 - RNA, 393 nt, Artificial Sequence
  derived and/or modified sequence opt5 from anti-HIV_VRC-CH34_HeavyChain
caggugcaacugguccagagcggcgccgcuguuagaaagcccggggccuccgugaccgugucuugcaaauucgcggaggacgaugacuggagcccucacugggucaacccggcucccgaacauuacauccacuuucuccggcaggccccuggacagcaacuggaguggcuugccuggaugaaucccacaaacggcgcugugaauuaugccuggcagcugaacgggcgccucacggcuaccagagauacauccaugaccacagccuuccuggaaguuaagucucuucggagcgacgauaccgcgguguacuauugugcccgcgcucagaaaagaggacgguccgagugggccuacgcucauuggggccaggggacaccugucgugguuucuagc

SEQ ID NO: 39476 - RNA, 306 nt, Artificial Sequence
  derived and/or modified sequence opt5 from anti-HIV_VRC-PG04_LightChain
gagaucgugcugacccagagccccggcacacucucccugucuccuggggaaacggccagccuuuccugcaccgcugccucuuacggacacaugacaugguaucaaaagaaaccgggccagcccccuaagcugcucauuuucgcgaccagcaaaagagcuuccgggauccccgaccgguuuucuggaagccaguucggcaagcaguacacacugaccauuacacgcauggagccugaagauuuugccagauauuacugucaacagcuugaguucuuugggcagggaacccggcuggaaauccgcaga

SEQ ID NO: 39477 - RNA, 375 nt, Artificial Sequence
  derived and/or modified sequence opt5 from anti-HIV_VRC-PG04_HeavyChain
caggugcaacugguccagagcggcuccgggguuaagaaacccggagccucugugagagugagcugcuggaccuccgaggacaucuucgaacggacagagcucauucacuggguccgccaggcuccuggccaggggcuggaauggaucggaugggugaagacgguuaccggcgccgugaacuuugggucuccggauuucagacaacgggucagccuuacacgcgacagagaucuguuuaccgcgcauauggacauucggggacucacacagggcgauaccgcuacauacuucugugcccgccagaaauuuuauaccggcgggcagggaugguacuucgaccuguggggcagagggacgcuuaucgugguuuccucu

SEQ ID NO: 39478 - RNA, 303 nt, Artificial Sequence
  derived and/or modified sequence opt5 from anti-HIV_VRC-PG04b_LightChain
gagaucgugcugacccagagccccggcacacucucccugucuccuggggaaacggccagccuuuccugcaccgcugccucuuacggacacaugacaugguaucaaaagaaaccgggccagcccccuaagcugcucauuuucgcgaccagcaaaagagcuuccgggauccccgaccgguuuucuggaagccaguucggcaagcaguacacacugaccauuacacgcauggagccugaagauuuugccggguauuacugucaacaggucgaguucuuuggacagggcaccagacuugaaauccgg

SEQ ID NO: 39479 - RNA, 375 nt, Artificial Sequence
  derived and/or modified sequence opt5 from anti-HIV_VRC-PG04b_HeavyChain
caggugcaacugguccagagcggcuccgggguuaagaaacccggagccucugugagagugagcugcuggaccuccgaggacaucuucgaacggacagagcucauucacuggguccgccaggcuccuggccaggggcuggaauggaucggaugggugaagacgguuaccggcgccgugaacuuugggucuccgaauuucagacaucgggucagccuuacacgcgauagagaccuguuuaccgcgcacauggauauucggggacucacacaaggcgacaccgcuacauacuucugugcccgccagaaauuugagagaggcgggcagggaugguauuucgaucuguggggccgggggacccuuaucgugguuuccucu

SEQ ID NO: 39480 - RNA, 612 nt, Artificial Sequence
  derived and/or modified sequence opt5 from anti-HIV_VRC-PG20_LightChain
cagagcgcccugacccaacccccuuccgugucuggcagcccggggcaguccaucacacucucuugcacgggagcuagcaccuccgucgccugguaccagcaguaugcggacaaggcucccagacugauuguuuucgauggcaacaaacggccuucugacaucagcucccgcuuuagcgggucucaauccggaggcacagccagccuuaccauuucugggcugcaguccgaggaugaagccuacuaucacuguaaugcuuucgaguuuuucggaggcggcacaaagcucaccgugcugagccagcccaaagccgcuccuucugugacacuuuuucccccuuccagcgaggaacugcaggccaacaaggcgacccucgucugccugaucuccgacuucuacccgggggccgugacgguugcuuggaaagccgauucuagccccgugaaggcuggagucgaaaccacaaccccuuccaagcaaagcaauaacaaauaugccgcgucuuccuaccugagccucacacccgagcaguggaagucucauaaaagcuauuccugucaggugacccacgagggcucuacgguugaaaagacaguggccccuaccgagugc

SEQ ID NO: 39481 - RNA, 681 nt, Artificial Sequence
  derived and/or modified sequence opt5 from anti-HIV_VRC-PG20_HeavyChain
gaggugcaccugaugcagagcggcaccgaaaugaagaaacccggggccuccgucagaguuacaugccaaacgucuggauacaccuucagcgacuauuuuauccauuggcuccgccaggugccuggccggggguucgaguggaugggauggaugaacccgcaguggggccaggugaauuacgcuagaacauuucaagggcgggucaccaugacacgcgauguguauagagaaguugccuaccuggaccuucggucccugaccuucgcggauacagcuguguauuuuugugcccgcagaaugcggucucaggaccgcgagugggauuuccagcacuggggacagggcaccagaauuaucgucagcuccgccucuacgaagggccccagcguguuuccucucgcucccuccagcaaaucuaccuccgggggaacagccgcucugggcugccuuguuaaggacuacuucccugaacccgugaccgucagcuggaacucuggggcccugacauccggagugcauaccuuuccugcggugcuccaaagcucuggccuguauucccugagcuccgucguuacggugccgucuagcucccucgggacacagaccuacauuuguaaugugaaccacaaacccagcaauacaaaggucgauaagaaaguggagccuaagucuugcgacaaa

SEQ ID NO: 39482 - RNA, 1059 nt, Artificial Sequence
  derived and/or modified sequence opt5 from anti-HIV_VRC-PG20_G-Chain
guguggaaggacgccgauaccacacuguucugcgcuagcgacgccaaagcgcacgagacggaaguccauaacguuugggcuacccacgccugugugcccacagauccuaauccgcaggagauccaucucgaaaacgugaccgagaauuuuaacauguggaagaauaacauggucgaacaaaugcaggaggacgugauuucccugugggaucagucucuucagcccugcguuaaacugacaggcgggagcgugaucaagcaagccuguccuaaaauuuccuucgaccccaucccuauucacuacugcacccccgcuggauaugucauccucaaguguaaugauaagaacuuuaauggcacagggccuugcaaaaacgugucuagcguucaguguacccauggaaucaagccgguggucuccacgcagcugcuucugaauggcucucucgccgaggaagagauuaucauuagaagcgaaaaccugaccaauaacgcuaaaacaaucauugugcaccugaauaaguccguggagaucaacugcacccggcccagcaacgggggaucuggcuccggcggggacauucgcaaagccuacugugagaucaauggaacaaaguggaacaagguccucaaacagguuaccgaaaagcugaaagagcacuucaauaacaagacgaucauuuuucaaccucccagcggcggggaucuugaaaucacaaugcaucacuucaauugcagaggagaguuuuucuauuguaacaccacacagcuguuuaauaauaccugcauuggcaacgaaaccaugaaagggugcaacggaacaaucacgcucccuuguaagauuaaacagaucaucaauauguggcagggcaccggccaagcgauguacgcucccccgauugacgggaagaucaacugcgugucuaauauuacaggaauccugcuuacccgggauggcggggccaacaauacauccaacgagaccuuccgcccuggaggcgggaacauuaaggacaauuggagaagcgagcuguauaaauacaaggugguccagaucgaa

SEQ ID NO: 39483 - RNA, 312 nt, Artificial Sequence
  derived and/or modified sequence opt5 from anti-HIV_VRC02_LightChain
gaaaucgugcugacccagagccccggcacacucucccugucuccuggggaaacggccauuaucagcugcagaaccucccaauacggaucucuugcuugguaucagcagcggccgggccaggcgccccgccuggucauuuacagcggguccacaagagccgcuggaaucccugaccgguucucuggcagccgcugggggcccgauuauaaccucaccauuagaaaucuggaguccggagacuuuggccuuuacuauugucaacaguacgaguucuuuggccaggggacaaagguucagguggauaucaaacgg

SEQ ID NO: 39484 - RNA, 363 nt, Artificial Sequence
  derived and/or modified sequence opt5 from anti-HIV_VRC02_HeavyChain
caggugcaacugguccagagcggcgggcagaugaagaaacccggagaguccaugagaaucucuugccaggccagcggcuacgaguucauugacuguacccucaacuggguucggcuggcuccugggcgcagaccggaauggaugggauggcuuaagccccggggcggggccgugaauuaugcgcgcccucugcaaggaagagugacaaugacgcgggaugucuacuccgacaccgcuuuucucgaacugcgcucucuuacagccgaugacaccgccguguauuacugcacaagaggcaaaaacugugauuauaauugggacuucgagcacuggggccgggggacccccguuacagugagcucc

SEQ ID NO: 39485 - RNA, 309 nt, Artificial Sequence
  derived and/or modified sequence opt5 from anti-HIV_VRC03_LightChain
gagaucgugcugacccagagccccggcauucucucccugucuccuggggaaacagccacgcuuuucugcaaggcuagccaaggaggcaacgccaugaccugguaccagaagagacgggggcaggucccgcgccugcucaucuaugacacauccagacgggcgucuggaguucccgaucgcuuugugggcagcggguccggaaccgacuucuuucugacaauuaauaaacuugauagagaggacuucgcuguguacuauugucagcaauuugaguucuuuggccugggcucugaacucgaaguccaccgg

SEQ ID NO: 39486 - RNA, 390 nt, Artificial Sequence
  derived and/or modified sequence opt5 from anti-HIV_VRC03_HeavyChain
caggugcaacugguccagagcggcgccguuaucaagacccccggguccucugugaaaauuagcugcagagcuuccggauacaacuuccgggacuauucuauccacugggugcgccucauuccugauaagggcuuugaguggaucggguggauuaaaccgcuguggggagccgucagcuacgcgagacagcuucagggccggguguccaugacacgccaacugucucaggaccccgaugacccugauuggggaguugcuuauauggaguucagcgggcucacgcccgccgacaccgccgaauacuuuugugugagacggggcuccugcgauuauuguggcgacuucccuuggcaguacugggggcagggaacagucgugguugugagcucu

SEQ ID NO: 39487 - RNA, 630 nt, Artificial Sequence
  derived and/or modified sequence opt5 from anti-HIV_VRC23_LightChain
gagaucgugaugacccagagccccgucacaguuuccgugucuagaggcgggacggccacccugagcugccgggcuucccaaggagugggcucugacgucgccugguaccagcacaagccugggcagacaccgcgccuccugauuuauggagcgagcaccagagcuuccggcgugcccgaacgguucucugggagcggauuucauguugauuucacacuuuccaucagcggccugcagccugaggacguggccauuuacuauugucaacaguacgaaaccuuuggccaggggacaaaagucgagaucaagcgcaccguggccgcucccucuguuuucauuuuuccucccuccgaugaacagcucaaaagcggaacggccucuguggucugccugcuuaacaauuucuauccuagagaggcuaaggugcaauggaaaguggacaacgcccugcaguccggcaauagccaggagucugucaccgaacaggauuccaaggacagcacauacucccucucuagcacccugacacuguccaaggcggauuaugagaaacacaagguuuacgccugugaagugacccaucaagggcucagcucuccggugacgaaauccuuuaaccggggagagugc

SEQ ID NO: 39488 - RNA, 672 nt, Artificial Sequence
  derived and/or modified sequence opt5 from anti-HIV_VRC23_HeavyChain
gaggugcaguucguccaaagcggcgccgaaguuaagaaacccggggcuuccgugagagugucuugcgaggccagcggauacuccuuuaccgacuauguccugcaguggauccggcaggcgccuggccagcgcccggaauggaugggguggauuaagcccgagagaggagcugugucuuacgccccucaauuccagggccggcucacacugacgcgcgaucuuuauaccgaaacagccuacaugcacuuuaaaaaccugagaagcgacgauaccgcuaucuauuacugugcccgcgggguucggagagacgcuuccugguggcuccaguucuggggacagggcacacuggugaccgucucuagcgccuccacaaagggccccagcguguuuccucuugcgcccucuuccaaaagcaccucugggggaacggccgcucugggcugccucguuaaggauuauuucccugagccggugaccgucuccuggaauagcggggcccugacaucuggagugcauaccuuucccgcugugcugcaauccagcggccucuacucccugucuagcgucguuacagugccuuccagcucucuugggacccagacguacauuuguaacgugaaucacaagcccuccaacacaaaagucgacaagaaaguggagccuaagagcugc

SEQ ID NO: 39489 - RNA, 1077 nt, Artificial Sequence
  derived and/or modified sequence opt5 from anti-HIV_VRC23_G-Chain
guguggagagacgccgauaccacacuguucugcgcuagcgacgccaaggcguacgagacggaaaaacacaacgucugggcuacccaugccuguguuccgacagauccuaauccgcaggagauccaccucgacaacgugaccgaaaaguuuaauauguggaaaaacaauaugguggagcaaaugcauacagauauuaucucccugugggaccagucucuuaagcccugcgucaaacugaccggcgggagcgccauuacacaggcuuguccuaagguguccuucgaacccaucccuauucacuauugcacccccgccggauuugcuauccucaaguguaaagaugagggcuucaacgggacgggacugugcaagaauguuucuaccgugcaguguacacauggcaucaaaccugucgugagcacccaacuucugcucaacgggucccuggccgagaagaauauuacaauccggucugaaaacauuaccaauaacgcgaaaaucauuaucguucagcuggugcagccggucacgauuaagugcauccgccccaauaacggaggcagcggcuccgggggagacaucagacaggcccacuguaaugugacacggagccgcuggaacaagacccuccaagagguggcugaaaaacugagaacauacuuuggcaacaagaccauuaucuucgccaauucuuccgggggagaucuugagauuaccacacacagcuuuaacugcggcggggaguucuuuuauuguaauacgucuggacuguucaacuccaccugguacgucaauagcacauggaacgacaccgauucuacacaggaauccaaugacaccaucacgcucccuugccggauuaaacagaucaucaacauguggcagcgcgcuggccaagccauguaugcgcccccuauucccggcguuaucaagugcgagagcaauauuacagggcugcuucugaccagagauggaggcaaagacaacaaugugaacgaaaccuuucggcccgggggaggcgacaugcgcgauaauuggagauccgagcucuacaaguauaaaguggucgaaaucgag

SEQ ID NO: 39490 - RNA, 648 nt, Artificial Sequence
  derived and/or modified sequence opt5 from anti-HIV_5CCK_LightChain
cagagcgcccugacccaacccgcuuccgugucugccagcccuggccaguccaucacaauuucuugcagcgggacgagauccgacgucggaggcuacgauuucguuucuugguaucagcagcacccggggaaggugcccaagcucaucauuuacgaggugaccaagcggccuagcggaaucccccaacgcuuuuccggcagcaaaucugggaacacagcgucccugaccauuagcggacuucaggcugacgaugaagccgacuauuacuguugcucuuaugccaauuacgauaagcugauccucggcggcgggacaaaacugaccguccuuggacagccuaaggcuaaccccacagugacccuguucccuccguccagcgaggaacuccaggccaauaaggcuacgcugguuugucugaucucugacuuuuaucccggcgccgugaccgucgcguggaaagccgauggguccccugugaaggcuggaguugagacaaccaaacccagcaagcaauccaacaauaaauacgccgcuucuagcuaccucucccugacaccugaacaguggaaaagccauagaucuuauuccugccaggugacccacgagggcagcacggucgagaagacaguggcccccaccgaauguucu

SEQ ID NO: 39491 - RNA, 696 nt, Artificial Sequence
  derived and/or modified sequence opt5 from anti-HIV_5CCK_HeavyChain
caggugcaacugguccagagcggcgccgagaugaaggaccccggggcuuccguuaaagugucuugcagagccagcggauacaaguucaccgauuauuacaugcacugggugcggcaggcgccuggccaggggcucgaaugggucggaugggugaacacaaauggcggguuuacgaaauauggagcuaaguuccaaggccgcguuaccgugacaagagacaccuccacaaacaccgucuuucuggagcuuucucggcugacauucggcgauaccgccauguacuuuugugcccgcccgaugagacccgugagccaugggaucgacuauuccggacucuucguuuuucaguucuggggccgggggacgauggugaccgucucuagcgcuuccacaaaaggaccuagcguguuuccccuggccccuucuuccaagagcaccucuggcgggacagcugcccuuggaugccuggugaaggauuacuuccccgaaccugucaccguuuccuggaauagcggcgcgcucacgucuggcgugcacacauuuccggccgugcugcaguccagcgggcuguauucccucucuagcgucgugaccguucccuccagcucucugggaacacagaccuacauuuguaacgugaaucauaaaccuuccaacaccaaggucgacaaaaagguggagcccaaaagcugcgau

SEQ ID NO: 39492 - RNA, 648 nt, Artificial Sequence; identical to SEQ ID NO: 39368
  derived and/or modified sequence opt5 from anti-HIV_5AWN_LightChain

SEQ ID NO: 39493 - RNA, 696 nt, Artificial Sequence
  derived and/or modified sequence opt5 from anti-HIV_5AWN_HeavyChain
caggugcaacugaugcagagcggcgcccagcucagagaccccggggauucccugaagaucucuugcaaagcuagcggauacaacuucauugacuaucacauccauuggguccggcuugccccuggccgcgggcuggaguggaugggauggauugauccgguuggcgggaucaccaaguacgcgggacaguuucaaggcagacucucccugacacgggacacgucuaccaauacacuuuuccuggaacucagccgccugaccgcuggcgauacagccguguauuuuugugccagauccaugcggcccguggaccacgggauugauuacucuggacuguucgucuuucauuucuggggccgcgggagcgacgugcucguuuccagcgcuucuaccaaaggaccuuccguguuuccccuggccccuagcucuaaguccacaagcggcgggaccgcugcccuuggaugccuggucaaagauuauuuccccgagccugugacgguuucuuggaacuccggcgcgcucaccagcggcgugcacacauuuccggccguccugcaguccucugggcuuuacagccuguccagcguggugaccguccccucuuccagccucggaacacagaccuauaucuguaauguuaaccauaagccuucuaauacgaagguggacaaaaagguggaacccaaaagcugcgau

SEQ ID NO: 39494 - RNA, 645 nt, Artificial Sequence
  derived and/or modified sequence opt5 from anti-HIV_3QEG_LightChain
gagaucgugaugaugcagagccccggcacccugucccucucuccuggggaaagagccacacugagcugccgggcuucccaaucugucagcuccucuuaccuugccugguaucagcagaagccgggacaggcgccccgccugcucauuuacggcgcuagcuccagagccacggggaucccugaccgguucagcggaucuggcuccgggaccgauuuuacacugaccauuagccgccuugagcccgaagacuucgccguuuauuacugucaacaguauggaucuuccccugagacauuuggccagggcaccaaaguggaaaucaagagaacaguggcugcccccagcgucuucauuuuuccuccgucugaugagcagcugaaauccgggaccgcuagcgugguuugccuccugaacaauuucuacccccgggaggccaaggugcaauggaaagucgacaacgcgcugcaguccggaaauucucaggaaagcgugacggagcaggauuccaaggacagcaccuauucucucuccagcacacugacccuuucuaaggccgauuacgaaaaacacaagguuuacgcuugugaggugacacaucaaggccugagcuccccugucaccaaaucuuuuaaccgcggggagugc

SEQ ID NO: 39495 - RNA, 717 nt, Artificial Sequence
  derived and/or modified sequence opt5 from anti-HIV_3QEG_HeavyChain
caggugcaacugguccagagcggcgccgagguuaagaaacccggguccucugugaaggugagcugcagagcuucccggggaaccuucucuagcuacggcaucacauggguccgccaggccccugggcagggacucgaauggaugggcgggauuaucccgauuuuugacgugacgaacuaugcgcaaaauuuccagggaagaguugcuaucaccacagaugccgagauguccaccgccuacauggaacugcggucucuuaaaagcgaggacuccgcuguguauuacugugccagcgauucucgcgacuuuuccuauuacgaacccggcacaagcuauucucacuacuacaacauuauggaugucuggggccaggggaccacagugaccguuuccagcgcuucuacgaagggaccuuccguguucccccuggccccuagcuccaaaucuaccagcggcgggacagcggcccucggaugccuggucaaggacuauuuucccgagccugugaccguguccuggaauagcggcgcucuuacaucugggguccauaccuucccggccguucugcaguccagcggacucuacucucugagcuccguggugacgguccccucuagcucccugggcacacaaaccuauaucuguaacgugaaucacaagccuagcaacacaaaaguugauaagagaguggagcccaaaucuugcgacaagacccau

SEQ ID NO: 39496 - RNA, 690 nt, Artificial Sequence
  derived and/or modified sequence opt5 from anti-HIV_1N0X_K-Chain
caggugcaacugguccagagcggcgccgagguuaagaaacccggggcuuccgugaaggugucuugccaggccagcggauacagauucuccaacuuugucauccacugggugcggcaggcgccuggccaacgcuucgaauggaugggguggauuaauccguauaacggaaauaaagaguuuucugcuaaguuccaggacagaguuaccuuuacagccgauacgagcgccaacaccgcuuacauggaacuccggucccugcgcucugccgacacagcuguguauuacugugccagagucggccccuauagcugggaugacuccccucaggauaauuacuauauggacgugugggggaaaggaaccacaguuaucgugagcucugcguccaccaagggccccagcgucuucccucuugcccccucuuccaagagcacaucuggcgggaccgcugcccugggaugccucgugaaagauuacuuuccugagccggugacggucuccuggaacagcggcgcucugaccuccgggguucauacauuccccgccgugcuucagucuagcggacuguacucccucagcucuguggucaccgugccuuccagcucucugggcacacaaaccuauauuuguaauguuaaccacaagcccagcaauacgaaaguggacaagaaagucgaaccuaaguccugc

SEQ ID NO: 39497 - RNA, 645 nt, Artificial Sequence
  derived and/or modified sequence opt5 from anti-HIV_1N0X_M-Chain
gagaucgugcugacccagagccccggcacacucagccugucuccuggggaacgggccacguucagcugccgguccucucacagcauucgcuccagacgggucgcuugguaccaacauaagccgggacaggcgccccgccuuguuauccacggcgugucuaacagagccagcgggauuuccgaccgguuuagcggaucuggcuccgggaccgauuucacacugaccaucacacgcguggagccugaagacuuugcucucuauuacugucaggucuauggagccagcucuuacaccuucggccagggcacaaaacuggagagaaagcggaccguggccgcucccuccguuuuuauuuucccucccagcgaugaacaacuuaaaucugggacggccuccguggucugccugcucaauaacuuuuauccucgcgaggcuaaggugcaguggaaaguugacaaugcccugcagagcggaaacucccaggagucugugaccgaacaagauagcaaggacuccacauacagccugucuuccacccucacacugagcaaggcggauuaugagaaacauaaggucuacgccugugaagugacccaccagggccuuagaucuccggugacgaaauccuucaauagaggggagugc

SEQ ID NO: 39498 - RNA, 654 nt, Artificial Sequence
  derived and/or modified sequence opt5 from anti-HIV_3QEH_HeavyChain
gacaucgugaugacccagagcccccugucccucccugucacaccgggcgaggccgcuucuauuagcugcagauccucucaaagccugcuucacacgaacggguuccaguaccuggauugguaucuccagaagcccggacaguccccucaacugcuuaucuaccugggcucuaaucgggccaccgggguuccccaucgcuuuagcggauccggcagcgggacagaguucacccucaaaauuucuagaguggaagcggaagacgugggagucuauuacuguaugcaggcuaaggaguccccuacauuuggccagggcaccaaaguggaaaucaagcggacaguugccgcccccagcguguucauuuuuccuccgucugaugagcagcugaaauccgggaccgcuagcgucgugugccugcucaacaauuucuauccccgcgaggccaagguucaauggaagguggacaacgcucugcagucuggaaauucccaggaaagcgucacggagcaggauuccaaagacucuaccuacagccuuuccagcacacugacccucucuaaggccgauuaugaaaaacacaagguguacgcgugugaggugacacaucaaggccuguccagcccugucaccaaaucuuuuaacagaggggagugc

SEQ ID NO: 39499 - RNA, 696 nt, Artificial Sequence
  derived and/or modified sequence opt5 from anti-HIV_3QEH_G-Chain
caggugcaacugguccagagcggcgccgagguuagaaagcccggggcuuccgugaccgugucuugcaaaacaagcggauacacguucgucaacuuuuauaucguguggguucggcaggccccuggccaggggcucgaauggaugggagugauuaauccguuccgcggcgacaccuacuuugcgcaaaaguucaaagggagagucacacugacccgggauacauccaccucuacaguguuuauggagcuuagcucccugcgcucugacgauaccgcuaucuauuacugugccagagaccucgaaaugcgggauggaaacaaucacggcagccaucuggaguucuggggccaggggacgcuuguuaccguguccagcgccucuacaaagggacccuccgucuuuccucuggcucccagcucuaaauccaccagcggcgggacagccgcucucggaugccuggugaaggacuauuucccugaacccgugaccgucucuuggaacuccggcgcccugacgagcgggguucacacauuuccugcggugcuccaguccucuggacuguacagccuuuccagcguggucaccgugccgucuuccagccugggcacacagaccuauauuuguaauguuaaccauaagcccucuaauaccaaaguggauaagcgcgucgagccuaaaagcugcgacaagacacac

SEQ ID NO: 39500 - RNA, 678 nt, Artificial Sequence
  derived and/or modified sequence opt5 from anti-HIV_2B1H_HeavyChain
gagauccagcuggaacaaagcggcgccgaggugaagaaauccggggaaucucucaagauuagcugccagaccuccggauacucuuucagcgacuauuggaucggcugggucagacagaugcccgggaaaggacuggaguggaugggcaucuuuuacccuggggauuccgacucucgguauagcccguccuucgaaggacagguuacaaugagcgcugaucgcucuacgaacaccgcccaccuucaaugguccagccugaagcccucugacacagcgcucuacuauugugcuagacugggcggcgauuacgaggacuccggggccgaugccuuugacuucuggggacagggcacccuugugacagugagcucugcuuccaccaaagggccuagcgucuuuccccuggccccuuccucuaagagcacauccggaggcaccgcugcccucgggugccuggugaaggauuauuuccccgagccuguuacggugagcuggaacucuggagcgcugaccuccggcguccauacauuuccggccgugcuccagagcucuggccuguacagccuuuccucuguugugaccguccccagcuccagccuggggacacagaccuacauuuguaaugugaaucacaaaccuucuaacacgaagguggacaaaaaggucgaacccaaaucc

SEQ ID NO: 39501 - RNA, 645 nt, Artificial Sequence
  derived and/or modified sequence opt5 from anti-HIV_2B1H_LightChain
cagagcgugcugacccaacccccuuccgccucuggcacaccggggcagagaaucagcauuuccugcucuggaacgagcuccaacgucgagaauaacuacguuuauugguaccagcaccuccccggcaccgcuccuaagcugcuuaucuaucggaaugaccaucgcucuagcgggauucccgauagauucuccgccagcaaaucuggaacauccgcgagccuggcuaucucuggccuccggccugaagacgagggggauuacuauugugccgccugggacgauucccgcggaggccccgacuggguguuuggcgggggaaccaagcugacagugcuugcucagccuaaagccgcuccgagcgucacccuguuucccccuucuuccgaggaacuccaagccaacaaggcgacacuggugugccugauuagcgauuucuaccccggcgccguuaccguggcuuggaaagccgacuccucuccugucaaggcugggguggaaacgaccacacccagcaagcaguccaauaacaaauaugccgcgagcucuuaccucucccugaccccggagcaguggaaaagccacaagucuuacagcugucagguuacacaugagggauccaccguggaaaagacggucgccccuaca

SEQ ID NO: 39502 - RNA, 648 nt, Artificial Sequence
  derived and/or modified sequence opt5 from anti-HIV_3TNM_B-Chain
cagagcgugcugacccaacccccuuccgccucuggcagcccggggcaguccgucacaaucucuugcacgggaaccagcuccgacguuggcggguacaacuaugugucuugguaccagcaccaucccggaaaggcuccuaaacucauuaucagcgaggugaauaacagacccuccggcgucccugaucgguucagcgggucuaaguccggaaauacagccagccugaccgugucuggccuucaggcggaagacgaggcugaauauuacuguuccagcuauacagauauucacaacuuuguuuucggcgggggaaccaaacugacagugcucggccaacccaaggccgccccuucugucacccuguuuccgcccuccagcgaggaacuucaggcuaauaaagccacgcuggugugccucaucuccgacuucuacccuggggcuguuaccguggccuggaaggcggauucuagccccgucaaggccggaguggagacaaccacaccuuccaaacagagcaacaauaaguaugcugccucuuccuaccugagccugacccccgagcaguggaaaucucaucgcagcuacuccugucaagugacgcacgaaggcucuacagucgagaagaccguugcuccgacagaaugcagc

SEQ ID NO: 39503 - RNA, 693 nt, Artificial Sequence
  derived and/or modified sequence opt5 from anti-HIV_3TNM_A-Chain
caggugcaacugcaggagagcggccccgggcucgucaagccuucccagacccugucucuuagcugcacaguuuccggaggcucuagcuccucuggggcccacuacuggagcuggaucagacaguauccgggaaaaggccuggaauggauuggguacauccauuauuccggaaacacguacuauaaucccagccucaagucucggauuaccaucucccaacacacaagcgagaaccaguucucucugaaacuuaauuccgugaccguggcugacacagccgucuacuauugugcgcgcggcaccagacugcggacacuccgcaacgcuuuugauauuuggggccaggggaccauggugacgguuagcucugccuccaccaagggaccuagcguguucccccuggccccuuccucuaaaagcacauccggcgggaccgcugcccugggaugccucgucaaggacuacuuucccgaaccugugacaguuagcuggaacucuggcgcucugaccuccggggugcauacguucccggccguccuucagagcucuggacuguacagccucuccucuguggugacaguccccagcuccagccugggcacccaaacauauaucuguaauguuaaucacaagccuucuaacaccaaaguggauaagagaguggagcccaaauccugcgacaagacccauaca

SEQ ID NO: 39504 - RNA, 690 nt, Artificial Sequence
  derived and/or modified sequence opt5 from anti-HIV_3UJJ_HeavyChain
gaggugcagcugguccaaagcggcgccgaaguuaagaaacccggggagucccucaagaucucuugcaaagcuagcggauacuccuucucuagcuauuggauugccugggugagacagaugccuggcaaggggcuggaauggaugggauuuaucuacccggcggacuccgauacccgguauucucccagcuuccagggccaggggacaauuuccgcugacaaaagcaucucuacggccuaccuucaaugguccagccugaaggccucugauaccgcuauguauuacugugccauucucggauuuuggggcgcuaaccgcggcgggggaggcauggacgugugggggcagggaacaaccgucaucguguccagcgccucuacaaagggcccuuccguuuucccccuggcgccuagcuccaaaucuaccagcgggggaacagccgcucuuggcugccuggugaaggauuauuuucccgagccugucaccguguccuggaauagcggcgcccucacgucugggguucacaccuucccggcugugcugcaguccagcggacuguacucucucagcuccgucgugacagugcccucuagcucccugggcacccagacauacaucuguaacgucaaucauaaaccuagcaacaccaagguugacaaaaagguggaacccaagucuugcgauaaaacg

SEQ ID NO: 39505 - RNA, 639 nt, Artificial Sequence
  derived and/or modified sequence opt5 from anti-HIV_3UJJ_LightChain
agcuacgagcugacccagcccccuuccgugucugucagcccgggccaaacagccagaaucacgugcuccggggacgcucuccccgaaaaguaugccuacugguaucagcagaaaucuggacaggcgccuguucugauuaucuacgaggauagcaagcggcccuccggcauuccugaacgcuucucugggagcagauccggaaccauggcuacacuuaccaucagcggcgcccaaguggacgaugaggccgacuauuacuguuauucuacaaacuccgggggaaccuuuuucguguuuggcacaggcaccaaagucacggugcuggggcagcccaaggcuaauccuaccguuacacucuucccgcccagcucugaggaacugcaggccaacaaagcuacccuugugugccugauuuccgauuuuuacccuggagccgucacaguggcguggaaggccgacagcucucccguuaaggcuggcguggagaccacgacaccuuccaaacagagcaauaacaaguacgccgcuuccucuuaucucagccugacccccgaacaauggaaaucccaccggagcuacucuugucaggucacacaugagggguccaccguggaaaagaccguggccccgacagagugc

SEQ ID NO: 39506 - RNA, 669 nt, Artificial Sequence
  derived and/or modified sequence opt5 from anti-HIV_3UJI_HeavyChain
caggugcaacugguccagagcgccgcugagguuaagaaacccggcgaagcccucaagaucuccugcaaagggucuggauacagcuucuccaacuauuggauugcgugggugagacagaugccuggcaaggggcuggaguggaugggaaucguguacccggacgauucugacagcuccuauaauucuagcuuucagggccaaauuaccuucuccgcugauaaaagcaucucuacagccuaccuucacuggacgucccugcaggccagcgacaccgcuauguauuacugugcccggcucggguuugaaggagauuauucuggcuccuucuuugacuacuggggccaggggacacugcuuauugucagcucugcuuccaccaagggacccagcguguucccucuggcccccuccucuaagagcacauccggcgggaccgcggcccucggaugccugguuaaagauuacuuuccugagcccgugacagucagcuggaacucuggcgcucugaccuccggggugcauacguucccugccguucuccagagcucuggacuguauagccuuuccucuguggucaccgugccgagcuccagccugggcacacaaaccuacaucuguaaugugaaccacaagcccucuaauacaaaagucgacaagaaaguugaaccu

SEQ ID NO: 39507 - RNA, 627 nt, Artificial Sequence
  derived and/or modified sequence opt5 from anti-HIV_3UJI_LightChain
agcuacgagcugacccagcccccuuccgugucugucagcccgggccaaacagccuccaucacgugcucuggggacauucucggagauaaguauguuagcugguaccagcagaaauccggccagucuccccugcuugugaucuaugaagacaccaagagaccuagcgggauucccgaucgguucuccggaagcaaaucuggcaacacagcuacccugacaaucuccgggacccaagccauggacgaggcggauuacuauugucaggcuugggacagcacacucggaguggucuuuggcggcgggaccaaggugacgguucugggacagccuaaagccgcccccucugugacccuuuucccuccguccagcgaggaacugcaggcuaauaaggccacacucgucugccugauuucugauuuuuaccccggcgcugugaccguugccuggaaggcggacuccagcccugugaaagccggggucgaaacaaccacgcccuccaagcaaucuaacaauaaauaugcugccagcuccuaccugagccucacaccugagcaguggaagucucacaaauccuacagcugucaggugacccaugagggaucuacaguggaaaagaccgucgcuccc

SEQ ID NO: 39508 - RNA, 666 nt, Artificial Sequence
  derived and/or modified sequence opt5 from anti-HIV_2QSC_HeavyChain
caggugcaacugguccagagcggcgggggacucguucagcccggcgggucccugagacuuucuugcgccgcuuucggauuuaacuucagcuccuacgugaugcacugggugcggcaggccccuggccaagggcuggaguaucucucugcgaucagcuccgacggagaaaccacauaccaugcuaauucugucaagggccgcuuuacgagcuccagagauaacagcaaaaauacccuguuccuucagaugggcucucugcggacagaggacguggccguuuauuacugugcccgcgauagauauuacgaaaccuccgggagcaacgcuuuugacguguggggacagggcacaauggucgugguuucuuccgccagcaccaaggggccgucuguguucccccucgcuccuugcucccggagcacauccgagucuaccgccgcgcugggaugucuggucaaagauuauuuucccgaaccugugacggugagcuggaacuccggcgcccucaccagcgggguccacacauuccccgcuguucugcagucuuccggacuuuacagccugucuagcguggugaccgucccuuccucuaauuuuggcacacaaaccuacacgugcaauguggaccauaagccgagcaacacaaaaguugauaagaccguggag

SEQ ID NO: 39509 - RNA, 645 nt, Artificial Sequence
  derived and/or modified sequence opt5 from anti-HIV_2QSC_LightChain
aacagcgugcugacccagucccccucuagccucuccgccucugucggcgaccggguuacaaucacgugccaagcuagccaggauauuuccaauuaccugaacugguaucagcacaagccugggaaagccccgaaacuucugaucuacaccgcgucuaaucucgagacaggagugcccagccgguucuccggcgggggaagcggcacccauuuuucuuucacaauuaccucccugcagccugaagacgcugccacauauuuuugucaacaguacgauaaccuuggggaccugagcuucggaggcggcaccaaaguggagaucaagcgcacggucgccgcucccucuguguuuauuuucccucccuccgaugaacagcucaaaagcgggaccgccucuguugugugccugcugaauaacuuuuauccuagagaggcuaagguccaguggaagguggacaaugcccuccaauccggaaacagccaggaauccguuacagagcaggauucuaaagacagcaccuacucccugagcucuacacuuacccuguccaaggcggauuaugagaaacacaagguguacgccugugaagucacgcaucagggccucagcucuccggugacaaagagcuucaauagaggggagugc

SEQ ID NO: 39510 - RNA, 690 nt, Artificial Sequence
  derived and/or modified sequence opt5 from anti-HIV_3MLZ_HeavyChain
caggugcaacugcaggagagcggccccgggcucgucaagccuuccgaaacccugucucuuacaugcacgguuagcggaggcuccaucucuggguuccacuggagcuggauuagacagccgcccggaaaaggccuggaguacaucggguauauuuacuauuccggaucuaccagcuacaacccuucccucaagagccgggugucuauguccguggacacaagccgcaaucaguuuucucuggaacuuuccagcgucaccgccgcugauacagccguguauuacugugcgagagacuucggcgaguaucauuacgauggccggggguuucaaugcgaaggauucgaccuguggggccaggggacccucguuacagugucuuccgcuagcaccaaaggacccuccgucuuuccucuggcccccucuagcaaguccacgagcggcgggaccgccgcucugggaugucucgugaaagauuacuucccugagccgguuacagugucuuggaacuccggcgcccugaccagcggcguccacacauuucccgcugugcuucagucuagcgggcuguauucccucucuagcguggucaccguuccuuccagcucucugggaacgcagacauacaucugcaaugugaaccauaagcccuccaauaccaagguggacaaaaaggucgagccuaaaagcugu

SEQ ID NO: 39511 - RNA, 642 nt, Artificial Sequence
  derived and/or modified sequence opt5 from anti-HIV_3MLZ_LightChain
cagagcgugcugacccaacccccuuccgucucugccgcuccgggccagaagguuacaaucagcugcuccgggucuagcuccaacauuggaaauaacauggugucuugguaccagcagcaccccggcacggccccuaaacuccugaucuaugagaauagcaagagacccuccgggauuccugaccgguucagcggaucucgcuccggcaccagcgcgacacuugggaucauuggacugcaaaccggcgaugaagcugaguacuauugugccacaugggacggcucucucagaaccguguuugggggaggcacaaaacugaccguccuuucccagcccaaggccgcuccuagcgugacgcuguucccgcccucuuccgaggaacuccaggccaacaaagcuacccugguuugccugaucagcgauuuuuacccuggggccgugacagucgcguggaaggccgacuccucucccgugcgggcuggaguugaaaccacaaccccuagcaagcaguccaauaacaaauaugccgcuagcucuuaccucucccugacgcccgagcaauggaaaagccaucgcucuuauagcugucaggugacacacgagggcuccaccgucgaaaagacaguggccccgaccgagugc

SEQ ID NO: 39512 - RNA, 684 nt, Artificial Sequence
  derived and/or modified sequence opt5 from anti-HIV_3MLX_I-Chain
caggugcaacugcaggagagcggccccgggcucgucaagccuuccgaaacccugucucuuacaugcacgguuagcggaggcuccaucucuggguuccacuggagcuggauuagacagccgcccggaaaaggccuggaguacaucggguauauuuacuauuccggaucuaccagcuacaacccuucccucaagagccgggugucuauguccguggacacaagccgcaaucaguuuucucuggaacuuuccagcgucaccgccgcugauacagccguguauuacugugcgagagacuucggcgaguaucauuacgauggccggggguuucaaugcgaaggauucgaccuguggggccaggggacccucguuacagugucuuccgcuagcaccaaaggacccuccgucuuuccucuggcccccucuagcaaguccacgagcggcgggaccgccgcucugggaugucucgugaaagauuacuucccugagccgguuacagugucuuggaacuccggcgcccugaccagcggcguccacacauuucccgcugugcuucagucuagcgggcuguauucccucucuagcguggucaccguuccuuccagcucucugggaacgcagacauacaucugcaaugugaaccauaagcccuccaauaccaagguggacaaaaaggucgagccuaaa

SEQ ID NO: 39513 - RNA, 633 nt, Artificial Sequence
  derived and/or modified sequence opt5 from anti-HIV_3MLX_M-Chain
agcgugcugacccagcccccuuccgucucugccgcuccgggccaaaagguuacaaucagcugcuccgggucuagcuccaacauuggaaauaacauggugucuugguaccagcagcaccccggcacggccccuaaacuccugaucuaugagaauagcaagagacccuccgggauuccugaccgguucagcggaucucgcuccggcaccagcgcgacacuugggaucauuggacugcagaccggcgaugaagcugaguacuauugugccacaugggacggcucucucagaaccguguuugggggaggcacaaaacugaccguccuuucccaacccaaggccgcuccuagcgugacgcuguucccgcccucuuccgaggaacuccaggccaacaaagcuacccugguuugccugaucagcgauuuuuacccuggggccgugacagucgcguggaaggccgacuccucucccgugcgggcuggaguugaaaccacaaccccuagcaagcaguccaauaacaaauaugccgcuagcucuuaccucucccugacgcccgagcaguggaaaagccaucgcucuuauagcugucaagugacacacgagggcuccaccgucgaaaagacaguggccccgacc

SEQ ID NO: 39514 - RNA, 684 nt, Artificial Sequence
  derived and/or modified sequence opt5 from anti-HIV_3MLW_I-Chain
caggugcaacugguccagagcggcgccgagguuaagaaagcuggggaaucccucgagaucucuugcaagggaagcggcuacaccuucacagaccacuggauugccugggugagacaggugcccgggaaaggacuggaauggaugggcaugaucuauccuggggauuccgacacgcgguacucuccgagccuucagggacgcgucaccauguccgcggauaagacacugucuaccgcuuaucuccaauggagcagacuggaggccuccgacacagccauguacuauugugcucggcuucauuacagcgaucgcucuggcuccuauuuuaacgacguguuccacauguggggccaggggaccacaguuaccgugagcucugccuccacgaaaggacccagcgucuuuccucuggcucccucuuccaagagcaccuccggcgggacagccgcgcucggaugccuggugaaggauuacuucccugaacccguuaccgugucuuggaauagcggcgcccugacauccgggguccauaccuuuccugcugugcuccagagcucuggacuguacucccuuagcucuguggucacgguuccgagcuccucucugggcacacagaccuauauuuguaacgugaaucacaaacccagcaacacaaagguggacaaaaaggucgagccuaaaucc

SEQ ID NO: 39515 - RNA, 645 nt, Artificial Sequence
  derived and/or modified sequence opt5 from anti-HIV_3MLW_M-Chain
cagagcgugcugacccaacccccuuccgccucuggcacaccggggcagagagucacgaucagcugcuccggaaacucuagcaauauugagaacaauuacguuuauugguaccagcagcuccccggcuccaccccuaagcugcuuaucuuccgggacgaucaacgccccucuggggugccugacagauuuagcggauccaaaagcggcacaucugcuucccuggccauuagcgggcuccggucugaagaugaggcggacuauuacugugcuuccugggaugacagccgcggaggccccgauuauguguucggcaccgggacaaaggucaccgugcugggacagccuaaagccaacccgacaguuacccuuuuucccccuucuuccgaggaacugcaggccaauaaggcuacgcucgugugccugaucagcgacuucuaccccggcgccgucaccguggcuuggaaagccgauggguccccuguuaaggcgggaguggaaacaaccaagcccucuaaacagagcaacaauaaguaugccgcuuccagcuaccugucucucacaccggagcaauggaaaucccacagaagcuacucuugucaggucacccaugagggcagcacgguggaaaagacaguggccccuacc

SEQ ID NO: 39516 - RNA, 678 nt, Artificial Sequence
  derived and/or modified sequence opt5 from anti-HIV_3MLV_N-Chain
gaggugcagcuggucgaaagcggcggggagguuaagcaacccggacagucccucaaaaucucuugcaagagcuccggcuacaacuuccuggacucuuggauugggugggugagacagaucccuggaaaaggccuugaauggauugggaucauuuauccggaugacagcgaugcccacuacucccccucuuuugagggacaggugaccaugagcgucgacaaguccaucagcacagcuuaucugcaauggacgacccuccaggccucugauacaggcaaauacuucuguacccggcuguaucuuuuugaaggcgcgcaguccagcaaugcuuucgaccugugggggcagggaacaaugauccucgugucuuccggcaccacaaaggggccuagcguuuuuccccuggccccuucuuccaagagcaccuccggaggcacggccgcucuggggugccucgugaaagauuacuuccccgagccugucaccgugucuuggaacagcggagcccugacauccggcguucauaccuuuccggcugugcuucaaagcucuggccuguauucccucagcucugucgugacagugcccagcuccucucuggggacccagacguacauuuguaaugucaaccacaagccuagcaauacaaaaguugacaagaaaguggagcccaagucc

SEQ ID NO: 39517 - RNA, 657 nt, Artificial Sequence
  derived and/or modified sequence opt5 from anti-HIV_3MLV_M-Chain
agcuaccugcucacccagcccccuuccgugucugucagcccgggccaaacagccuccaucucuugcagcggggacaagcuggaugacaaauauguuuccugguacuaucagagacccggacagucuccugugcuucugauguaccaggauuucaagcggcccagcggcauuccugagcgccucuccgggagcaaaucuggaaagacggcuacccugacaaucuccggcacccaaagccuugacgaaggggauuauuacugucaggccugggacgcgucuacaggaguguccggcggcgggaccaaacugacaguccucuuuggagagggcaccagacugacggugcuggcucagcccaaggccgccccuagcguuacccucuucccgcccucuuccgaggaacugcaggcuaacaaggccacacuugugugccugauuagcgauuuuuauccuggggcugucaccguggccuggaaagcggacuccucucccguuaaggccggaguggaaacaaccacgccuagcaaacaauccaauaacaaguacgcugccagcucuuaccucucccugacacccgagcaguggaaaagccacaagucuuauagcugucaggucacccaugagggcuccacaguggaaaagaccguggcuccgacc

SEQ ID NO: 39518 - RNA, 654 nt, Artificial Sequence
  derived and/or modified sequence opt5 from anti-HIV_3MLU_LightChain
uaccugcucacccagcccccuagcguguccgucucuccgggccaaacagccagcaucuccugcucuggggacaagcuggaugacaaauauguuagcugguacuaucagagacccggacaguccccugugcuucugauguaccaggauuucaagcggcccucuggcauuccugagcgccucagcggguccaaaagcggaaagacggcuacccugacaaucucuggcacccaaucccuugacgaaggggauuauuacugucaggccugggacgcgagcacaggagugucuggcggcgggaccaaacugacaguccucuuuggagagggcaccagacugacggugcuggcucagcccaaggccgccccuuccguuacccucuucccgcccagcucugaggaacugcaggcuaacaaggccacacuugugugccugauuuccgauuuuuauccuggggcugucaccguggccuggaaagcggacagcucccccguuaaggccggaguggaaacaaccacgccuucuaaacaaagcaauaacaaguacgcugccuccagcuaccucucucugacacccgagcaguggaaaucccacaagagcuauucuugucaggucacccaugagggcagcacaguggaaaagaccguggcuccgacc

SEQ ID NO: 39519 - RNA, 657 nt, Artificial Sequence
  derived and/or modified sequence opt5 from anti-HIV_3MLT_G-Chain
agcuacgaccugacccagcccccuuccgugucugucagcccgggccaaacagccuccaucucuugcagcggggauaagcucgacgauaaauauguuuccugguacuaucagagacccggacagucuccugugcugcuuauguaccaggacuucaagcggcccagcggcauuccugagcgccuguccgggagcaaaucuggaaagacggcuacccucacaaucuccggcacccaaagccuggaugaaggggacuauuacugucaggccugggaugcgucuacaggaguguccggcggcgggaccaaacuuacaguccuguuuggagacggcaccagacucacggugcuggggcagcccaaggcugccccuagcguuacccuguucccgcccucuuccgaggaacuccaggccaacaaggcuacacuggugugccuuauuagcgauuuuuauccuggagccgucaccguggcuuggaaagccgacuccucucccguuaaggcgggcguggagacaaccacgccuagcaaacaauccaauaacaaguacgccgcuagcucuuaccugucccucacacccgaacaguggaaaagccacaagucuuauagcugucaggucacccaugagggguccacaguggagaagaccguggccccgacc

SEQ ID NO: 39520 - RNA, 666 nt, Artificial Sequence
  derived and/or modified sequence opt5 from anti-HIV_3GO1_HeavyChain
gaggugcagcugcaagaaagcggccccgggcucgucaagccuuccgagacccugucucuuacaugcacgguuagcggaggcccgaucaacaaugccuacuggaccuggauuagacagcccccugggaaaggacuggaauaucucggcuacguguaucacacaggggugaccaacuacaaucccucccugaagucucggcuuacaaucaccauugacacaagccgcaaacagcugucccucucucugaaguucgucaccgcugccgauagcgcgguguauuacugugcuagagagugggccgaagacggagauuuuggcaacgccuuccauguuuggggccaggggacgaugguggcugucuccagcgccucuaccaaaggaccuuccguguuuccccuggcuccuagcucuaaguccacaagcggcgggaccgccgcgcucggaugccugguuaaggacuauuucccggagcccgugacagucucuuggaacuccggcgcccuuaccagcggggugcacacguuuccugcugugcugcaauccucuggacucuacagccuguccagcgucguuacagugcccucuuccagccuuggcacccagacauacaucuguaaugugaaucauaaaccuucuaacaccaaggucgauaaacggguggagccc

SEQ ID NO: 39521 - RNA, 627 nt, Artificial Sequence
  derived and/or modified sequence opt5 from anti-HIV_3GO1_LightChain
agcuacgugcugacccagcccccuuccgucucuguuagcccgggccaaacagccagaaucacgugcuccgcugaggcccucucuaaccaguaugcguacugguaucggcagcgccccgggcaggcuccucugcuuauuaucuacaaggacaccaaaagacccagcggcauuccugaacgguucuccggaucuacaagcgggaccacagugacccugacaaucuccggagugcaagccgaggaugaagccgacuauuacugucagagcgcugauucuuccggcgacuaugucuuugggggaggcaccaaggugacgguucucggccagcccaaagccaauccuaccgugacacuguucccgcccagcucugaggaacuucaggcuaacaaggccacccuggucugccucauuuccgauuuuuacccuggggcggugacaguugccuggaaagcugacggaagccccgugaaggccggcgucgagaccacgaagccuucuaaacaauccaauaacaaguacgcugccagcuccuaucugucucugacacccgagcaguggaaaagccaccgcuccuacagcugucaggugacccaugaagggucuacaguggagaagaccgucgcgccg

SEQ ID NO: 39522 - RNA, 690 nt, Artificial Sequence
  derived and/or modified sequence opt5 from anti-HIV_4XCY_J-Chain
caggugcaacugguccagagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcuggggguggcugggaaaacccaucggcgcuuucgcccacugggggcaaggaacccucgugacagucagcucugcguccaccaaaggcccuagcguguuuccccuggccccuucuuccaagagcacaucugggggaaccgcugcccugggcugccucguuaaagacuauuucccggaacccgugacggucuccuggaacagcggcgcucugacauccggggugcauaccuuuccugccgugcuucagucuagcggacuguacucccucagcucugucguuacagugcccuccagcucucugggcacccagaccuauauuuguaaugugaaccacaagccuagcaauacaaaggucgauaaaaagguggagcccaaauccugc

SEQ ID NO: 39523 - RNA, 645 nt, Artificial Sequence
  derived and/or modified sequence opt5 from anti-HIV_4XCY_K-Chain
gagaucgugcugacccagagccccggcacacaaucccucucuccuggggaaagagccacgcugagcugccgggcuucccagucugucggaaacaauaaacuugccugguaccagcagcgcccgggccaagcgcccagacugcucauuuauggggcuagcucccggccuucuggaguugccgaccgcuucagcggcuccgggagcggaaccgauuuuacacugaccaucucuagacuugagcccgaagacuucgccguguacuauugucagcaguacggccagucccugagcacauuuggccaagggaccaaaguggaggucaagcggacaguggcugccccuucuguuuucauuuuucccccuuccgaugaacagcucaaaagcggaaccgcuucuguggucugccugcugaacaauuucuauccgcgcgaggccaaggugcaguggaaaguugacaacgcgcuccaguccggcaauagccaagaguccgugacggaacaggauucuaaggacagcaccuacucccugagcucuacacuuacccuguccaaggccgauuaugagaaacacaaggucuacgcuugugaagugacacaucaggggcucagcucucccgugaccaagagcuuuaacagaggagagugc

SEQ ID NO: 39524 - RNA, 630 nt, Artificial Sequence
  derived and/or modified sequence opt5 from anti-HIV_4YBL_C-Chain
gugcugacccagcccccuagcgccuccggcucuccggggcaaagcgucacaaucuccugcacgggaaccucuagcgacguuggcggguacaacuauguguccugguaccagcaccaucccggaaaggcuccuaaacucauuaucucugaggugaauaacagacccagcggcgucccugaucgguucuccgggagcaagucuggaaauacagccucccugaccgugagcggccuucaggcggaagacgaggcugaauauuacuguucuuccuauacagauauucacaacuuuguuuucggcgggggaaccaaacugacagugcucggccagcccaaggccgccccuagcgucacccuguuuccgcccucuuccgaggaacuucaagcuaauaaagccacgcuggugugccucaucagcgacuucuacccuggggcuguuaccguggccuggaaggcggauuccucucccgucaaggccggaguggagacaaccacaccuagcaaacaguccaacaauaaguaugcugccagcucuuaccugucccugacccccgagcaguggaaaagccaucgcucuuacagcugucaggugacgcacgaaggcuccacagucgagaagaccguugcuccg

SEQ ID NO: 39525 - RNA, 672 nt, Artificial Sequence
  derived and/or modified sequence opt5 from anti-HIV_4YBL_B-Chain
caggugcaacugcaggagagcggccccgggcucgucaagccuucccagacccugucucuuagcugcacaguuuccggaggcucuagcuccucuggggcccacuacuggagcuggaucagacaguauccgggaaaaggccuggaauggauuggguacauccauuauuccggaaacacguacuauaaucccagccucaagucucggauuaccaucucccaacacacaagcgagaaccaguucucucugaaacuuaauuccgugaccguggcugacacagccgucuacuauugugcgcgcggcaccagacugcggacacuccgcaacgcuuuugauauuuggggccaggggaccauggugacgguuagcucugccuccaccaagggaccuagcguguucccccuggccccuuccucuaaaagcacauccggcgggaccgcugcccugggaugccucgucaaggacuacuuucccgaaccugugacaguuagcuggaacucuggcgcucugaccuccggggugcauacguucccggccguccuucagagcucuggacuguacagccucuccucuguggugacaguccccagcuccagccugggcacccaaacauauaucuguaauguuaaucacaagccuucuaacaccaaaguggauaagagaguggagcccaaa

SEQ ID NO: 39526 - RNA, 630 nt, Artificial Sequence
  derived and/or modified sequence opt5 from anti-HIV_4R4N_X-Chain
gacauccagaugacccaaagccccuccuucgugucugccagcgucggcgauagaguuacaauuacgugccgggcuucccaggggaucucuagcuaccuggccugguaucagcagaagccuggaaaagcgccgaagcucgugauuuacgcugccuccacccugcaaucuggcgugcccagccgcuuuuccgggagcggaucuggcacagaguucacccuuacaaucuccagccugcagccugaagacuuugccaccuauuacugucagcaccucauugggcugagaucuuucggacagggcacaaaacuugagaucaagcggaccgucgcugcccccuccguguuuaucuucccucccagcgaugaacaacugaaaucuggcacggcuuccguugugugccuccugaacaauuuuuauccucgcgaggccaagguccaguggaagguggacaacgcgcugcagagcggaaauucccaggaaucuguuaccgagcaagauagcaaagacuccacauacagccucucuuccacccugacacuuagcaaggccgauuaugagaaacauaagguguacgcuugugaagucacccaccaggggcugucuagcccggugacgaaauccuucaacaga

SEQ ID NO: 39527 - RNA, 660 nt, Artificial Sequence
  derived and/or modified sequence opt5 from anti-HIV_4R4B_F-Chain
caggugcaacugcagcaguggggcgccgggcuccugaagcccagcgagacccuuucccugacaugcggagucuacggcgaaucucucagcgggcacuauugguccuggguuagacagccuccgggaaaacggcuggaguggaucggcgaaauuaagcauaacgggucucccaauuaccacccuagccuuaaaucccgcgugacgaucucucuggacaugagcaagaaccaauucucccucaaucugaccagcgugacagcugccgauaccgcggucuauuuuugugcuagacggucuaacuggcccuaccugccuuucgaccccuggggacagggcacacucgugaccguuuccagcgccucuacaaaaggcccuuccguguuuccgcuggcccccagcucuaaguccaccagcgggggaacggcugcccuuggcugccuggucaaggauuauuucccugagcccgugaccguuuccuggaacucuggggcucucacaagcggagugcauaccuuuccugccguccugcaguccagcggccuuuacucucuguccagcguggugacaguccccucuagcucccucgggacccagacguauauuuguaauguuaaucacaaaccgucuaacacaaagguggacaaaaagguggaaccuaaa

SEQ ID NO: 39528 - RNA, 750 nt, Artificial Sequence
  derived and/or modified sequence opt5 from anti-HIV_3JUY_D-Chain
caggugcaacugguccagagcggcgccgagguuaagaaacccggggcuuccgugaaggugucuugccaggccagcggauacagauucucccacuuuaccguccauugggugcggcaggcgccuggccaacgcuucgaauggaugggguggaucaacccguauaauggaaacaaagaguuuucugcuaaguuccaggacagaguuacauuuacggccgauaccagcgccaauacagcuuacauggaacuccggucccugcgcucugccgacaccgcuguguauuacugugccagagucggcgagugggggugggaugacagccccuaugauaacuacuauauggacguguggggaaaaggcacaaccguuauuguguccagcggcgggggaggcucugggggaggcggguccggaggcggcgggagcgaaaucguccuuacacaggcgccuggaacccugucucucucccccggcgagcgggccacguucagcugcagaucuucccacagcauucgcucccggcgcguggcuugguaccagcauaagccugggcaagcccccagacuggugauccacggagucucuaaucgggcuagcggcauuuccgaucgcuuuagcgggucuggauccggcaccgacuucacacuuaccaucacaagaguugagccugaagauuuugcccuguacuauugucagguguacggcgcgagcucuuauaccuucgggcagggaacgaagcucgagcggaaa

SEQ ID NO: 39529 - RNA, 369 nt, Artificial Sequence
  derived and/or modified sequence opt5 from anti-HIV_4KG5_HeavyChain
cagcuggugcaaagcggccccgaggccaagagaccuggguccucugucaaaguuagcugcaaggcuucccgggacaccuucaacaauuacgugcucaacugggugcgccaggccccgggacagggccuggaauggaugggagggaucggccccauuaucgagacagcggauuaugcugaaaaauuuagagggcggcuuucuauuacggccgacgagagcaccacaaccgccuacauggaacuguccucucucacaagcgaugacaccgcugucuauuacugugcccgcuccccuuauagcucucugacagauaccuacuauuacuacauggaccuuuggggaaagggcacgaccgugacaguuuccagc

SEQ ID NO: 39530 - RNA, 336 nt, Artificial Sequence
  derived and/or modified sequence opt5 from anti-HIV_4KG5_LightChain
cugacccagagccccgacucccucgccgugucucugggcgagagagcuacaaucaacugcaagagcucccaaucuauucuugauagcuccaauaaccggaauuaccugacgugguaucagcagaaaccugggcagccgcccaagcuccugaucuacugggccucuacccgcgaaagcggagucccugacagauucuccggcagcgggucuuccacagauuuuacccuuacaauuagcucucugcaagcggaggacguugcuguguauuacugucagcaguauuucuccacccccggaaucacauuuggccaggggacccggcucgaaauuaaacgc

SEQ ID NO: 39531 - RNA, 309 nt, Artificial Sequence
  derived and/or modified sequence opt5 from anti-HIV-1_LightChain
gagaucgugcugacccagagccccgccacacucucccugucuccuggcgaaagagcuacgcuuagcugccgggccucccaaucugucuacaccaagcuggcgugguaucagcagaaaccggggcagcccccucgccuccugauuuacgacgcuagcaacagagccgccggaauccccgcucgguucuccggcucugggagcggaacagaguuuacccuuacaauuaagcgcauggaaagagaggauuucgccguuuauuacugucaaauccuggaauuuuucggccaggggaccacaauugacaugaau

SEQ ID NO: 39532 - RNA, 312 nt, Artificial Sequence
  derived and/or modified sequence opt5 from anti-HIV-1_LightChain
gacauccagaugacccaaagccccuccucugugagcgccuccgucggcgauagaguuacaauuacgugccgggcuucucaggggauccugagcucccagcucgccuggcaccagcaacgcagaggacagccuccgcggcugcuuauuuacggcgggucuaaccgcgcgcccggaaucccugagagauucaccggcagcggguccggaacagacuuugugcugaccauuaagcggcuccagcgcgaugacuucgcuguguauuacugucagauccuggaauuuuucggcagaggcacacgggucgagaugaau

SEQ ID NO: 39533 - RNA, 312 nt, Artificial Sequence
  derived and/or modified sequence opt5 from anti-HIV-1_LightChain
ggccugcuccugacccagagccccgggccuguguccuucuuuccgggagagagagccacagucucuugccgggcuagccacuccguuaacucugccgcgaucaauugguaccaacagaagcgcggccagcccccuagacuuauuaucguggacgggagcacgcgggcuaccgccgugcccgaacgcuucuccgccacaggaucuggcaccgaguuuacacuggucauuagcagacucgaaccugaggauuucgcuguguauuuuugucagcaucugcaauucuuugggcuuggaaccaaaguugacaucaag

SEQ ID NO: 39534 - RNA, 312 nt, Artificial Sequence
  derived and/or modified sequence opt5 from anti-HIV-1_LightChain
gccuucgugaugacccagagccccggcacacuggcucucuccccuggggagagagccacgcugucuugccggaccagccaagaaauccuuuccaaccagcuggcguggcaccagcagcgcagaggacaaccgccccggcuccugauuuacggcgggucuaaucgcgcuccuggaauccccgagagauuuacaggcagcggguccggaaccgacuucguccuuacaauuaaccggcuggaacgcgaugacuuugccguuuauuacugucagauccucgaguucuuuggcagaggcacccggguggaaaugaau

SEQ ID NO: 39535 - RNA, 312 nt, Artificial Sequence
  derived and/or modified sequence opt5 from anti-HIV-1_LightChain
ggcaucgugcugacccagagccccgacacacucucccugucuccuggggauagagccacgcuuagcugcaagaccucccaaucuauugcuagcgagcaccuggccugguaccagcagcggccgggacagcccccucgccuccugaucuucggcgcguccaacagagcuucugggauucccacacgguuuagcggauccggcagcggggccgacuucacccuuucuaucacacgccuggaaccugaggauuuugccgucuauuacugucaauucuccgaauuuuucggaagaggcgcucggguugaggugaaa

SEQ ID NO: 39536 - RNA, 312 nt, Artificial Sequence
  derived and/or modified sequence opt5 from anti-HIV-1_LightChain
caguucgugaugacccaaagccccgccacacuguccucuagcccuggcgggacggcuacccucuccugcagaacaucucacagcauccugaacucccagcuugccuggcaucagcagcggcgcggacaaccgcugagacuccugauuuacggcgcgucuaaucgggcucccgggaucccugagcgcuuuagcgccuccggaagcggcaccgaguucguccuuacaauuaagagaauggaacgggaagacuuugccguuuauuacugucagauccuggaguucuuugggcagggaaccacaauugauaugaac

SEQ ID NO: 39537 - RNA, 354 nt, Artificial Sequence
  derived and/or modified sequence opt5 from anti-HIV-1_HeavyChain
agagugcaccugguccagagcggcacccaaguuaagaaacccggggccuccgugaaggugucuugcgagacaagcggauucaaauuucucgacucccugauccauuggguccggcaggcuccuggccaggggcuuuacuggaugggauggauuaagccguaucgcggcucugugaacuacgauggguauuucagaggacggguuagcaugacgcgcgacaucuacaccgauacagccuaucuggaacucuccggccugagaucugacgauaccgcgauuuacuauugugcuuuuggcgccggggacggaugggaucuuguguggggccaggggacacuggucaucgugagcucc

SEQ ID NO: 39538 - RNA, 354 nt, Artificial Sequence
  derived and/or modified sequence opt5 from anti-HIV-1_HeavyChain
agagugcaccugguccagagcggcacccaaguuaagaaacccggggccuccgugaaggugucuugcgagacaagcggauucaaauuucucgacucccugauccauuggguccggcaggcuccuggccaggggcuuuacuggaugggauggauuaagccguuccgcggcucugugaacuaugauggguacuuuagaggacggguuagcaugacgcgcgacaucuauaccgauacagccuacauggaacuguccggccucagaucugacgauaccgcgauuuauuacugugcuuucggcgccggggacggaugggaucugguguggggccaggggacacuugucaucgugagcucc

SEQ ID NO: 39539 - RNA, 354 nt, Artificial Sequence
  derived and/or modified sequence opt5 from anti-HIV-1_HeavyChain
caggugcaccugguccaaagcggcacccagguuaagaaacccggggccuccgugagagugucuugcgagacaagcggauucaaguuucucgacuccaucauucauugguuccggcaggcuccuggcgaagggcuguuuuggaugggauggaucaaaccguacacgggcucugucaacuaugugcgcagauaccaggggcggguuagcaugacccgcgauguguauuccgacacagccuacauggaucuuucuggacugaauagcgacgauaccgcggucuauuucuguacauacggcgcuggcgacggguggaaccucguguggggacaaggcacccugguuauuguguccgcc

SEQ ID NO: 39540 - RNA, 363 nt, Artificial Sequence
  derived and/or modified sequence opt5 from anti-HIV-1_HeavyChain
caggugagacugguccaaagcggcaaccagguucggaagcccggggccuccgugcgcaucucuugcgaggcuagcggauacaaguucauugaccacuuuauccauugggugagacaggucccuggccacgggcucgaauggcugggauggauuaauccgcggggcgggggagugaacuauucccgcggcuuccagggcaaacuuucuaugaccaugacaagagauaauuuugaggaaacggccuaccuggaccucagccggcugaaccccggggauaccgcgguuuauuacugugcucgcggauucgccggcuaugagugguccuuucuuugggggcaaggaacacuggugaucgucucuagc

SEQ ID NO: 39541 - RNA, 357 nt, Artificial Sequence
  derived and/or modified sequence opt5 from anti-HIV-1_HeavyChain
caggugagccugguccaauccggcaaccagcucaagaaacccggggccucuguuagaaucagcugcgagaccuccggauacaauuuccugaaccacuuuauucauugggugcgccaggugccuggccacgggcuugaauggcugggauggaucaauccgcggggcgggggagucaacuauucuagaaauuuccagggcaaggugagccucacacggaacauugacauggagacgguuuaccuggaugugcgcggccuuacccccggggacacagcugucuauuacugugccagaggauuuggcggguccgauuggaauuucguguggggacaaggcacccggaucacaguuucugcg

SEQ ID NO: 39542 - RNA, 357 nt, Artificial Sequence
  derived and/or modified sequence opt5 from anti-HIV-1_HeavyChain
agaaucaaccugcaccagagcggcucccaagugaagcggucuggggccagcguccgcauuuccugcgagaccucuggauucaaauuuauggacagccaucuccacuggguuagacagguggcuggccagggguucgaauggaugggauggaucuuuacauccggcgggggagugaauuacgcccggcaguuccaaggccgccugacgcuuaccagagaugucuuuacagacaccguguucauggaucugucuggcguuaacgugggggacacaggagucuauuacugugugaagggcaccgggggaaaugaguggggcuuuagcugggggcagggaacaguuguggucguguccccc

SEQ ID NO: 39543 - RNA, 357 nt, Artificial Sequence
  derived and/or modified sequence opt5 from anti-HIV-1_HeavyChain
agaaucaaccuggaccagagcggcucccaagugaagaaaucuggggccagcguccggauuuccugcgagaccucuggauucaaguuuauggauagccaccuccauuggguucgccagguggcuggccagcccuucgaauggaugggguggaucuuuacauccggaggcggggugaauuacgccagacaguuccaaggacggcugacgcuuacccgcgacgucuuuucugagacaguguucauggaucugagcggccucaacgcgggcgacaccgggguuuauuuuugugugaaaggaacaggcgggaaugaauggggauucgucuggggccaggggaccgugguuguggucuccccu

SEQ ID NO: 39544 - RNA, 357 nt, Artificial Sequence
  derived and/or modified sequence opt5 from anti-HIV-1_HeavyChain
agaaucgagcugcaccagagcggcucccaagugaagaaaucuggggccagcguccggauuuccugcgaaaccucuggauucaaguuuauggacagccaucuccacuggguucgccagguggcuggccagagauucgaguggaugggguggaucuuuacauccggaggcggggugaacuacgcccggcaguuccaaggacgccugagacuuacgcgggaugucuuuucugaaagcguguucauggaccuguccggccucaauagcggcgauaccgggguuuauuacugugugaaaggaacaggcgggaacgaguggggauuugucuggggccaggggucucuggugguuguguccccc

SEQ ID NO: 39545 - RNA, 372 nt, Artificial Sequence
  derived and/or modified sequence opt5 from anti-HIV-1_HeavyChain
caggcccuggugcaaagcggcucccagaugaagaaacccggggacucugucagacucagcugccagaccuccgauucugcuaucacaaaguacuucauucacuggauccggcaggccccuggaaaaggccuggaguggauugcguggaucagcccguaugggggacgcguuaacuacggcuggcaagugagagaccgggcuacgcuuacccgcaauauucauauggaaacaguguauauggaucugagagggcuccggcccgacgauaccgccacauacuauugugccaugcgcgacuacugcagagaugacaacuguaaucggugggaucugggacacuggggccagggcucccuuaucgucgugucugcu

SEQ ID NO: 39546 - RNA, 357 nt, Artificial Sequence
  derived and/or modified sequence opt5 from anti-HIV-1_HeavyChain
caggugacccugguccaaagcggcaaccagcucaagagacccggggccuccguucggaucucuugcgagacaagcggauacaauuucauggaccacuuuauucauugggugcgccaggugccuggccacgggccggaauggcugggaugggucaaccccagaggcgggggagugaauuauucccggaaauuccagggccgcuuuucuaugacgagagauguuuacauggagaccgcuuaucuugacgugacaggccugagcccugccgauaccgcggucuacuauugugcucggggguucggaggcuccgacuggucuuuucucugggggcaaggaacacugaucauugugagcucc

SEQ ID NO: 39547 - RNA, 324 nt, Artificial Sequence
  derived and/or modified sequence opt5 from anti-HIV-1_LightChain
gagaucgugcugacccagagccccggcacacucucccugucugccggggaaagagcuagccuuuccugccgggccucucaaacgcugaacagcaauuucuuugcgugguaccaccagaagccuggacaggcuccgcgccuccugauuuauggcgccuccaacagagccaccgggauccccgaccgguucucuggaagcggcuccgggagcgauuuuacacuuaccauuucucgccuggagccugaagacuucggaaaauacuauugugagcaguacgaugucucccccagaacauuuggccaaggcaccaagguugaaaucaaa

SEQ ID NO: 39548 - RNA, 324 nt, Artificial Sequence
  derived and/or modified sequence opt5 from anti-HIV-1_LightChain
gaggugguccugacccagagccccggcacacucucccugucuccuggggaaagagccacgcuuagcugccgggcuucccaaucuaucaacagcaauuucuuugccugguaccaccagaagccgggacaggcgccccgccugcucauuuauggcgcuuccucuagagccaccgggaucccugaccggauuagcggaacaggcuccggggccgauuucacccugacaaucaccggacuugagcccgaagacuuuggccuguacuauugucagcaauacgauuucagcccucgcacauuuggccaggggaccagaguugagauuaaa

SEQ ID NO: 39549 - RNA, 324 nt, Artificial Sequence
  derived and/or modified sequence opt5 from anti-HIV-1_LightChain
gaggugguccugacccagagccccggcacacucucccugucuccuggggaaagagccacgcuuagcugccgggcuucccaaaccaucaacucuaauuucuuugccugguaccaccagaagccgggacaggcgccccgccugcucauuuauggcgcuagcuccagagccacagggaucccugaccggauuucuggaagcggcuccgggaccgauuucacacugaccaucacaggacuugagcccgaagacuuuggccuguacuauugucagcaauucgauuuuagcccucgcaccuucggccaggggacgagaguugagauuaaa

SEQ ID NO: 39550 - RNA, 324 nt, Artificial Sequence
  derived and/or modified sequence opt5 from anti-HIV-1_LightChain
gagaucgugcugacccagagccccggcacacucucccuggccccuggggaaagagcuacgcuuucuugccgggccagccaauccauuucuaccacauaccuggcgugguaucagcagaagccgggacaggcuccccgccuccugaucuacgagaccagcuccagagccucugacauuccugaucgguucagcggcuccgggagcggaacagacuuuacccuuacaaucucucgccuggaacccgaggauuucgccgucuauuacugucaccaauaugacagauccccucggaccuuuggccaggggacgaaaguugaaauuaag

SEQ ID NO: 39551 - RNA, 336 nt, Artificial Sequence
  derived and/or modified sequence opt5 from anti-HIV-1_LightChain
gacaucgugaugacccagagccccgccucccugucugucacaccuggcgagacggcuagcauuuccugcaaguguucuagaagccuccgggaagagguuggguacaacuaucuggauugguaccuucaacgcccgggaaaaucuccccagcugcucaucuaugugggcuccuucagagccccuggggugagcgaacgguuucgcggauccggcgagcacaaggacuucacccugaaaauugcgagagucgaacccggggaugcuggaaucuacuauugcaugcagggcauugacacaccucggaccuuuggccaggggacaacccuugagaucaau

SEQ ID NO: 39552 - RNA, 321 nt, Artificial Sequence
  derived and/or modified sequence opt5 from anti-HIV-1_LightChain
gacauccagaugacccaaagccccuccucucugagcgccuccgugggcgauagagucacaauuacgugccgggcuucucaggccuuccgcaacgaccucgggugguaccagcacaagccuggaaaagcgccggagagacugaucuaugcuaccagcacacuugaauccggcguucccucucgguuuagcggguccggaagcggcaccaauuucacacugaccauuucuucccuccaggccgaggauuuugccacauacuauugucugcaauacaacaccuucccucgcacguuugggcagggaaccaagguggaaaucaaa

SEQ ID NO: 39553 - RNA, 333 nt, Artificial Sequence
  derived and/or modified sequence opt5 from anti-HIV-1_LightChain
aacuucaugcugacccagccccacagcguguccgagucuccuggcaagacagucacgaucagcugcgccagaacccgcgggggaauugacuccgcuuacguucauugguaucaacagcggccgggcucugugcccacaaccgugaucuuugaagauaauagacggccucccggggucccugaccgcuucagcggauccauugauacaucuagcaacaccgccucccucacaaucagcggccugaagaccgaggacgaagcggauuacuauugucagucuuacgacgauacguauuuuuggguguucgggggaggcaccaaacuuacaguucug

SEQ ID NO: 39554 - RNA, 333 nt, Artificial Sequence
  derived and/or modified sequence opt5 from anti-HIV-1_LightChain
aacuucaugcugacccagccccacagcguguccgagucuccuggcaagacagucacgaucagcugcgccagaacccgggggacaauugacuccgcuuacguucauugguaucaacagcgcccgggagccgugcccaccacagugaucuuugaagaugacagacggccuucuggcguccccgaucgcuucagcggguccauugacucuagcuccaauagcgcgucucucaccaucuccggacugaagacagaggaugaagcugacuacuauugucagagcuacgauucuaacuauuacuggguguuuggcgggggaaccaaacuuacgguucug

SEQ ID NO: 39555 - RNA, 396 nt, Artificial Sequence
  derived and/or modified sequence opt5 from anti-HIV-1_HeavyChain
caggugcaacugcagcagagcggccccgcccucgucaagccuuccgagacccugucucuuacaugcagcguuuccucugggagagugagcuccuacuauuggucuuggauccggcagagcccgggaaaaggccuggaauggauuggguacauccacuaugaccccgauacgaacaccaauuaccgcacacauuaucacccuucccucagaggacggguggucauuagcguggacucuuccaagagccaaguuucucugaaagugcgcuccgucaccgcugccgauagcgcgcuuuacuauugugcuagacaucgguacgaccccuggucuaagggcuacgauauccgcuccccuuucgacuuuugggggcagggaacacuggugaccguuagcucc

SEQ ID NO: 39556 - RNA, 396 nt, Artificial Sequence
  derived and/or modified sequence opt5 from anti-HIV-1_HeavyChain
caggugcaucugcaacagagcggccccgggcucgucaagccuuccgagacccugucucuuacaugcacgguuagcggaggcagaguguccucuuacuauuggagcuggauccggcaguccccggggaaaggacuggaauggauuggcuacauccacuaugaccccgauaccucuacaaacuaccgcacccacuaucauccuagccucagagggcggguggucauuuccguggacacaagcaagaaucagguuucucugaccgugcgcuccgucacagccgcugauagcgcccuuuacuauugugcgagacaccgguacgacguguggucuaacggauacgauauccgcucccccuaugacuucuggggcagaggcacccugguuacggugagcucu

SEQ ID NO: 39557 - RNA, 396 nt, Artificial Sequence
  derived and/or modified sequence opt5 from anti-HIV-1_HeavyChain
caggugcaccuggagcaaagcggccccgcccucgucaagccuuccgaaacccugucucuuacaugcacgguuagcgggggaagaguguccucuuacuauuggagcuggauccggcaguccccgggcaaagggcuggaguggauuggauacauccauuaugaccccgauaccucuacaaacuaccgcacccacuaucauccuagccucagaggccggguggucauuuccguggacagcucuaagaaucagguuucccugaaagugcgcagcgucacagcugccgauucugcgcuuuacuauugugcuagacaccgguacgacgugugguccaagggguacgauauccgcagccccuucgacuuuuggggaagaggcacccugguuacagugucuucc

SEQ ID NO: 39558 - RNA, 390 nt, Artificial Sequence
  derived and/or modified sequence opt5 from anti-HIV-1_HeavyChain
cagguggucuuccaaaagcccggcccugggguugugaaaccgagcgagacccugucccucacaugcacggugucuggaggcagaguccggagcuacuauugguccuggauccgccugcccccugggcagggacuugaauggauuggcuacauccacuaugacgagaccacagaauacaagagaucuuauaaccccagccugaaaucccggauuaccaucucuauggauacaagcaagaaucaggugucccucaaacugagcucuguuaccgccgcugacgccgcgguguacuauugugcucgccauagauacgaucggugguccgacagcuacgauauucgcucuccuuuugacaucugggggcagggaacagucgugaccguuuccgcc

SEQ ID NO: 39559 - RNA, 396 nt, Artificial Sequence
  derived and/or modified sequence opt5 from anti-HIV-1_HeavyChain
caggugcaacugcagcaguggggcgccgggcuccugaagcccagcgagacccuuucccugacaugcgcuaucuacggaucuagcuucuccggccacuauuggauguggauuagacagucuccugccaaaacgcucgaauggaucgcggagauuaaccauaccgggggaacacgguacaauccgagccuggcuucccgcgucagaguguuuucugacaccagcaagaaccaauucucccuuaauaugacaagccugaccgccgccgauacaggcaucuauuacuguguucgggggcaccucucucgcgacagacugggacaguaugcuuuuugguccggcgcccugauugauuaccucgaccccuggggccaggggacccuggugacggucagcucu

SEQ ID NO: 39560 - RNA, 387 nt, Artificial Sequence
  derived and/or modified sequence opt5 from anti-HIV-1_HeavyChain
caggugcaacugcaccaguggggcgccgggcuccugaagcccagcgagacccuuucccugacaugcgcugucuacggaucuuucacgggcuuucaguggaccuggguuagacagacaccugggaaaggacucgaauggaucggcgagauuaaccauagcgggcugcuugugaccggaaagacagacuauaauccgucccuggaaucucgggugaccaucagcgucgauacauccaaaaaccaauucucucucaagcugaccagcgugacggccgcggacaccggcguuuacuauugugcucgcgccggcgggauguccgauugggccuaccccuauuacuauggaauggacguguggggccaggggacaauggucaccgugagcucu

SEQ ID NO: 39561 - RNA, 357 nt, Artificial Sequence
  derived and/or modified sequence opt5 from anti-HIV-1_HeavyChain
caggugcaacuggucgagagcggcgggggaguugugcagcccggcagaucccucacccugucuugcgccacaagcggguucgacuuuuccucuuacggauuccacugggugcggcaggcuccuggcaaggggcuucagugggucagcaucauuucccaugauggaucuaucaaaaacuauggcgacagcaugaagggccgcuuuuccgugagcagagauaaugccaaagacauucuguaccuccaaaugaacucucugcggccggaugacacggcgcuuuaucacuguguucgcggggauggagaaaauggcgggaccgacuacuggggacugggcacacucgugaccgucuccgcu

SEQ ID NO: 39562 - RNA, 357 nt, Artificial Sequence
  derived and/or modified sequence opt5 from anti-HIV-1_HeavyChain
cagguggaccuggucgagagcggcgggggaguugugcaacccggcaagucccucaaacugucuugcaccgccagcggguucacauuuacguccuacggaaugcacugggugagacagaucccuggcaaggggcuugaaugggucgcuauuaucucucaugauggaaccauuaaaaacuauggcgacagcgugaagggccgguucacaaucucccgcgauaaugccaugaacauucuguaccuccagaugaauaaccugagaggggacgauaccgcgcuuuauuacuguguucggggagacggcgagaaugggggaacagauuauuggggccaggggaccguggucacagugucuagc

SEQ ID NO: 39563 - RNA, 369 nt, Artificial Sequence
  derived and/or modified sequence opt5 from anti-HIV_V3_HeavyChain
gaggugcagcugguccaaagcggcgccgaaguuaagaaacccggggagucccucaagaucucuugccagggauucggcuacaccuuuagcacauauuggauugggugggugagacagaugccuggaaaaggccuggaauggcuugggaucauuuacccggaggacuccgaaacgaucuauucucccagcuuccagggacaagcuaccauuuccgccgauaagucucugagcacagcguaccuccagugguccggccugcgggcuagcgacucugccaucuauuacugugcccgccuuggcuauugcggguccaccagcuguuccuuuuucgauuuuuggggaagaggcacacuggugaccgucucuagc

SEQ ID NO: 39564 - RNA, 369 nt, Artificial Sequence
  derived and/or modified sequence opt5 from anti-HIV_V3_HeavyChain
gaggugcagcugguccaaagcggcgccgaaguuaccaagcccggggagucccucaaaaucucuugcaagggaagcggcuacuccuucucuacacacuggauugcuugggugagacagaugccugggcggggacuggaauggaugggcuuuaucuauccggacgauagcgacacgcgcuacucccccucucuucaggggcaugugauuaucagcgccgauaaaucccugagcaccgcguaucuccaguggucuucccugaaggcuagcgacacagccauguacuauugugccagacuuggaggcgaugaguaccaaucuuccggcgggauggacgucuggggacagggcaccacagugauuguuagcucu

SEQ ID NO: 39565 - RNA, 393 nt, Artificial Sequence
  derived and/or modified sequence opt5 from anti-HIV_V3_HeavyChain
gaggugcagcugguccaaagcggcgccgaaguuaagaaacccggggcuaccgugaagaucuccugcaaagugucuggauacacacucacggacuauuacauucacuggguccagcaggccccuggcagagggcuggaguggcuuggacugguggauccggaaaacggcgagacccucuaugcggaaaaguuccaggggcggguuacacugaccgcugacacaagcaccgauacagccuacauggagcuuaaaucccugcgcuaugaggacaccgccguguacuauugugcuacggaaggacccccuucuuacuacgauagcggcaccuaugccaagucccuccccgcuucuuuugccugcuggggccaagggacacuggucaccgugagcucc

SEQ ID NO: 39566 - RNA, 369 nt, Artificial Sequence
  derived and/or modified sequence opt5 from anti-HIV_V3_HeavyChain
caggugcaacugcaggagagcggccccgggcucgucaagccuuccgaaacccugucucuuacaugcacgguuagcggaggcuccaucaacaauuacuauuggucuuggauuagacagccgcccgggaagggacuggaguacaucggcuauauuuucuacagcggguccaccaacuauaauccuucucucaagagccgggugacauuuuccguggacaccagcaaaaaccaguucucucugaaacuuacauccgucaccgccacagauaccgcuguguacuauugugcccgcggaccccugcucuacuuuggcgcgccuagaacgcacuucgacuacuggggccaaggggcucugguuaccgugagcucu

SEQ ID NO: 39567 - RNA, 372 nt, Artificial Sequence
  derived and/or modified sequence opt5 from anti-HIV_V3_HeavyChain
gaggugcagcugguccaaagcggcgccgaaguuaagaaacccggggagucccucaagaucucuugcaaaggaagcggcuacuccuucucuagccacuggauugggugggugagacagcugccuggaaagggccuugaauggauggggaucauuuauccggacgauuccgacaccaaauacaaccccucuuuucagggacaggugacaaucagcgcugaucgguccauuagcacggccuaucugcaauggucuucccucaaggcgagcgacaccgcuauguacuauugugcccgcgucggcuacgauucuuauggcuacuccgggagcaauuucgacgaguggggacagggcacacuggugaccguuucuucc

SEQ ID NO: 39568 - RNA, 357 nt, Artificial Sequence
  derived and/or modified sequence opt5 from anti-HIV_V3_HeavyChain
gaggugcagcugguccaaagcggcgccgaaguuaagaaacccggggagucccucaagaucucuugcaaaggaagcggcuacaacuucaauuccgacuggauugggugggugagacagaugccuggaaagggccuggaauggguggggaugaucuauccggaugacuuugagguccggcacucucccccuuuccagggacgcgugaccaugagcguugauaaauccauuucuacagcuuaccuucaguggagcucccucaagagcucugacacgggcauguauuuuugugccagacuggauggcaacgcggcugccuucgacuacugggggcaaggaacccaggugacagucuccagc

SEQ ID NO: 39569 - RNA, 360 nt, Artificial Sequence
  derived and/or modified sequence opt5 from anti-HIV_V3_HeavyChain
gacgugcagcugguccaaagcggcgccgagguuaagaaagcuggggaaucccucaagaucucuugcagacccagcggauacaacuucgccgauuauuggauuggcugggugcggcagaugccugggaaaggacuggaguggaugggcaucauuuuuccggacgauuccgacacccgcuacgggcccucuuucgaaggacaggugacaaucagcgcggauaaguccauuaauacggcuuaucuucaguggaacucucugaaagccagcgacaccgccauguacuuuugugcuagacacggcggcuccggggccgcuccuggagauuauuggggccaagggacacucgucaccgugagcucu

SEQ ID NO: 39570 - RNA, 363 nt, Artificial Sequence
  derived and/or modified sequence opt5 from anti-HIV_V3_HeavyChain
gaggugcagcugguccaaagcggcgccgaaguuaagaaacccggggcuaccgugaagaucuccugcaaagugucuggauacacauucacggacuauuuuaugcacuggguccaggaggccccuggcaaggggcucgcguggaugggacugguggauccggaaaacggcgacaccguuuacgcugagaaacuucaggggagagugacaaugagcgccgauaccucccgggacacagccuauauggaacugaccucucuccgcagcgaggauacagcugucuacuauugugccauuggaaaguccguggcuggcaccucugccuacgacaucuggggccaggggacgaugguuaccgugagcucc

SEQ ID NO: 39571 - RNA, 369 nt, Artificial Sequence
  derived and/or modified sequence opt5 from anti-HIV_V3_HeavyChain
caggugcaacugguccagagcggcgccgagguuagaaagcccggggcuuccgugaaagugucuugcaaggccagcggagacaccuucaacaaucacgauaucaacuggguccggcaggcgccuggccaggggccggaaugggugggauggaugaaucccaaauccggcaacgcuggguacgcccaaaaguuucagggacgcguuacaaugacgagagacaccucuauuagcacagccuauauggagcuccggucccugaccucugaagauacaggcguguacuauugugcucgccuuaccgucgacugcgaugacggcggguguuacggagauuauuggggccaggggacacuggugaccguuagcucc

SEQ ID NO: 39572 - RNA, 354 nt, Artificial Sequence
  derived and/or modified sequence opt5 from anti-HIV_V3_HeavyChain
gagguguaccugcagcaaagcggcgccgaacucaaggagcccggggcuaacgucaaaaucuccugcaaggccuucggauuuauuuucaccgacuauuuuauccacuggcugagacaggcgccuggcaaagggccgcaguggguuggagugguggaucccgaagacggcucuacaacguacgcugaggccuuccaggggcgggucagcauuaccgccgaucgcuccacagacaccgcuuauauggaucuugccggacugacaucugacgauaccgcuguguacuauugugcccucauguggaaugaaagcggcccugacaacuggggccaagggacacugguuaucguguccucu

SEQ ID NO: 39573 - RNA, 393 nt, Artificial Sequence
  derived and/or modified sequence opt5 from anti-HIV_V3_HeavyChain
gaggugcaggucguugaguucggcggggaagugaagaaacccggagccagcgugaaggucuccugcgaggcuucuggcuacaccuuugccaaauucgcgauccacugggugagacaagcuccucggcaggggcuggaauggaugggauggauuaacggcgacgaugggaagacagaauauagccagaaauuucaggaccgcguuacgaugaccagagauacauccgccucuaccguguacauggagcucagcucccugcggucugaggacacagcccuuuauuacugugcucgcgccauguauccggauaccgucacaggaaaugacaaccccgcuccucccccuuucgaaggcgauuacuggggccaagggacccuggugacgguuagcucc

SEQ ID NO: 39574 - RNA, 393 nt, Artificial Sequence
  derived and/or modified sequence opt5 from anti-HIV_V3_HeavyChain
gaggugcagcuggucgaaagcggcgggggacucguuaagcccggcgggucccugagacuuaccugcguggccucuggauucacauuuagcgacguguggcugaacuggguccggcaagcuccuggcaaagggcucgagugggugggacgcaucaaguccagaacggauggcggcaccacagacuacgccgcgucuguuaaagggcgguucaccauuagccgcgaugacuccaagaauacacuguaucuucagaugaacucucugaaaaccgaagauacagcuguguacagcuguaccacggacggauuuaucaugauuagaggcgucuccgaggauuauuacuauuacuauauggacgugugggggaagggaaccacaguuaccgugagcucu

SEQ ID NO: 39575 - RNA, 387 nt, Artificial Sequence
  derived and/or modified sequence opt5 from anti-HIV_CD4bs_HeavyChain
gaggaacagcugguggagagcggcgggggacucgucaagcccggcgggucccaaagacugucuugcgccgcuagcgaguucaccuuuucccgguacacaaugaacuggguucgccaggccccuggaaaaggccuugaaugggugucuagcaucuccgggaaugacaacaauauuuauuacgcggauucugugaagggaagauucacgaucagccgggacaacgcucgcaauucccuguaucuccagauuaacagccugagagucgaagauaccgccguguacuauugugcccggggcccgcuugacucuuacgauuuuugguccggcagccgccacuauuacgggcuggacguuuggggacagggcacaaccgugacagucucuucc

SEQ ID NO: 39576 - RNA, 372 nt, Artificial Sequence
  derived and/or modified sequence opt5 from anti-HIV_CD4bs_HeavyChain
caggugcaacugguccagagcggcuccgagcucaagaaacccggggccucuguuaaggugagcugcaaggcuuccggauacaccuucacaucucacaucauuaacugggugagacaggccccuggccaggggcuggaauggaugggauggaucaauacgaacaccggcaauccgacauaugcgcaaggguuuaccggacgguucgucuuuagccuugacacauccgugucuauggcuuaccugcagauuagcucccucaaagccgaggauaccggcguuuauuacugugcccgcggcuucagacaguggcugguggcucggaucacauauuuugacuacugggggcagggaacccuugucacggugagcucu

SEQ ID NO: 39577 - RNA, 369 nt, Artificial Sequence
  derived and/or modified sequence opt5 from anti-HIV_CD4bs_HeavyChain
gagcugagacuccaggccagcggccccgggcuggugaagccuuccgaaacccuuucucuggucugcagcguuuccggagugucuaucagcgacuccuacuggaacuggauucggcaaccggcuggcaaagggcucgaguggaucggacgcguguauacaagaggcacgcacaccuacaaucccucucuugggggacgggccacagucagcggcgauaccaacaagaaugaagugucccugaaacugaugagcguuacagcggcugacaccgccguguauuacugugcccgcgcucucucuggcgauuggacaagacgguauuucuacauggacgucugggggcgcggaaccccugugacgguuuccagc

SEQ ID NO: 39578 - RNA, 381 nt, Artificial Sequence
  derived and/or modified sequence opt5 from anti-HIV_CD4bs_HeavyChain
cagcugcaacuccaggagagcggccccagacuggugaagccuuccgaaacccuuucucugacaugcacggucagcgggggauccaucucuagcggcgacuacuauuggaccuggauucggcagccgcccggggagggacucgaauacaucggcuauauuuacuccgggggaucuacagauuauaacccuagccugaaaucccgcgccagcaucucucaggacaccuccacaaaugaguucagccuuaagcugaccucuguuacagcugccgauaccgcgguguacuuuugugcuagagaccggcgcgugcuccugugguucggcgaacccagacggggccuggauuuuugggggccuggaacgcucgucaccguguccagc

SEQ ID NO: 39579 - RNA, 396 nt, Artificial Sequence
  derived and/or modified sequence opt5 from anti-HIV_CD4bs_HeavyChain
gaggugcagcuggucgaaagcggcgggggacucguuaagcccggcgggucccugagacuuucuugcgccgcuagcggauucaccuuuuccucugccuggaugagcugggugcggcaagcgccuggcaaagggcuggagugggugggacgcaucaaguccaaaucugacggcgaaacaacggauuacgcugccccggucaagggcagauucaccauuagccgggacaaccucgaguccacacuguaucuucagcugaauagccucaaaaccgaagauacagccguguacuauugugcuaccgccacacccucuuacuaugacaucaugaccgggaacuacaaguauuacuacuauauggauguuuggggaaagggcacgaccgugacagucuccagc

SEQ ID NO: 39580 - RNA, 363 nt, Artificial Sequence
  derived and/or modified sequence opt5 from anti-HIV_CD4bs_HeavyChain
caggugcaacuggucgagagcggcgggggacucguuaagcccggcgggucccugagacuuucuugcgccgcuagcggauucaucuuucgggaccacuacaugaccuggauucgccaggccccuggcaaagggcuggaauggguguccuauaucucuagcuccucuaacaauauucaguacgcggauagcgugaagggaagauucacagucucccgggacaacgcuaaaaauagccucuaucugcagaugaacucucuucgcgccgaugacacggccguguacuauugugcuagauccggcccguuuuacaauuaugggcccccuaacaauuggggccaaggaacccugguuacagugagcucu

SEQ ID NO: 39581 - RNA, 378 nt, Artificial Sequence
  derived and/or modified sequence opt5 from anti-HIV_CD4bs_HeavyChain
caggugcaacuggucgagagcggcgggggaguugugcagcccggcgggucccucacccugucuugcacagccagcggauucccuuuuaacuccuacgcuaugcacugggugagacaggccccgggcaaggggcuugaaugggucucuaugacgagccaugacggaggcaauaaagauuucguggacuccguuaagggccgguuuaccaucucucgcgauaacagcagaaauacacuguuccuccagaugaacucccugagccaagacgauaccgggguguauuacuguguccggggaaaacuugaggacuauaauuuuuggggccacuaccgcgauuucgacucuugggggcagggaacacuggugaccguuuccgcg

SEQ ID NO: 39582 - RNA, 405 nt, Artificial Sequence
  derived and/or modified sequence opt5 from anti-HIV_CD4bs_HeavyChain
gagccccacguggucgaaagcggcgggggaauggccaagccuggcgggucccugagacucucuugcgcuggaagcggcuucaccuuuacaaacgccuggaugaauuggguucggcaggcgccggggaaaggacuggagugggugggccuuaucaaguccaaaucugacggcgggacgaccgauuacgcugccgacguggaaggacgcuucacaauuagcagagaugaccuggaguccaccauguuucucgaaaugcauucucugcaaaucgaggauacagccgucuauuucuguaccacacaguacccccgguauuacgaccuuaugaccggcaacuauaagcgcagauacuuuagcuccgggauggauguguggggacagggcacggcuguuaccgugagcucu

SEQ ID NO: 39583 - RNA, 384 nt, Artificial Sequence
  derived and/or modified sequence opt5 from anti-HIV_CD4bs_HeavyChain
caggugcaacugcaggagagcggccccgggcucgucaagccuucccagacccugucucuuacaugcacgguuagcggagacuccgugucuagcggcaacuacuauugguccuggaucagacagccggccgggaaaccccuggaauggauuggacacaucucuaccggcgggggaacaaagaauaacccuagccuccaaucccgggugaccauuagccuggauucuuccaaaaaucaggucagccuuucucuguccagcgugacagcugccgacaccgcgguuuacacaugugcucgcgggcccccuagaucucucugguucggcgaucccaccuauuccuacauggacguguggggcaagggaacgaccgucacagugagcucc

SEQ ID NO: 39584 - RNA, 372 nt, Artificial Sequence
  derived and/or modified sequence opt5 from anti-HIV_CD4bs_HeavyChain
caggugcaacugguccagagcggcgccgagguuaagaaacccggguccucugugaaggugagcugcaaggcuuccggaggcaccuucaacucucacgccuuuacaugggucagacaggcgccugggcagggacucgaauggaugggcgggaucauuccgacgcugggacuugcuaaugacgcccaaaaauuccagggccgguuuaccaucacagccgaugagagcaccacaaccguguacauggaacuguccucucuccgcagcgaggacacagcuguuuauuacugugccagacggcccuauuacgaucagguguccggcgucggggcuuucgacauuuggggacagggcacccgcgugacgguuagcucu

SEQ ID NO: 39585 - RNA, 390 nt, Artificial Sequence
  derived and/or modified sequence opt5 from anti-HIV_V2_HeavyChain
caggugcaacugguccagagcggcgccgagguuaagaaacccggguccucugugaaggugagcugcgaggcuuccggagucaccucuagcuccuacacaaucucuugggugagacucgccccuggccaggggcuggaauggaugggacggauuacgccgaucuucgacauuaccaacuaugcgcagaaauuucaaggccgcguuacacuuaccgcugauaagagcacagggaccacauacauggaacuguccagccucagaucugacgauaccgccguguauuacugugcccgggacaaauccgaugucgugguugugacgagcauccgccccgcuuauuacuauggaauggacgucuggggccagggcaccacagugaccgugucuucc

SEQ ID NO: 39586 - RNA, 366 nt, Artificial Sequence
  derived and/or modified sequence opt5 from anti-HIV_V2_HeavyChain
caggugcaacugguccagagcggcgccgagguuaagaaacccggguccucugugaaggugagcugcaaggcuuccggaggcaccuucagaucuuacgccaucagcuggguccggcaggcgccugggcagggacucgaauggaugggcgggauuaucccgauuuuuggaacagcugacuaugcccaaaaauuccagggcaaagugacgaucaccgccgaugaguccacaucuaccgcuuacauggaacugagcucccuuacaagcgaggacaccgccauguauuacugugcucgcucuagagaucacuuuuucgacacacggguuuuucagggcugggggcagggaacccuggugacggucuccagc

SEQ ID NO: 39587 - RNA, 363 nt, Artificial Sequence
  derived and/or modified sequence opt5 from anti-HIV_V2_HeavyChain
caggugcaacugguccagagcggcgccgagguuaagaaacccggguccucugugaaggugagcugcaaggcuuccggaggcaacuucaauaccuacacaaucucuugggucagacaggccccugggcagggacucgaauggaugggccggauuaucccgauuuuugggaucgugaaccccgcgcaaaaauucccuggacgcguuacgauuaauguggacaaaagcaccaacacagcuuauauggagcuguccucucuuagaagcgaagauaccgccgucuacuauugugccacauccggcgugggccugcacuuuggguacuucgacuauuggggacagggcacccagguuacagugagcucu

SEQ ID NO: 39588 - RNA, 378 nt, Artificial Sequence
  derived and/or modified sequence opt5 from anti-HIV_V2_HeavyChain
caggugcaacugcagcaguggggccccgggcuccugaagccuagcgagacccuuucccugacaugcgccgucuacggaggcucuuucgggagauauuacuggagcuggauccggcaguccucuggagaaggccucgaguggcuggggcaaauugaccacacgggaagcaccacauauaacccgucccuuaaaggccgcguuaccaucucuauugauagcuccacaaaucaguuuagccugaaggugaccucugugaucgcugccgacacagcggucuacuauugugcuagagcccccuccggcuacccuggggugagccucuaucaguacuacggacuggauguuuggggccaggggaccacggugaccgucucuccc

SEQ ID NO: 39589 - RNA, 366 nt, Artificial Sequence
  derived and/or modified sequence opt5 from anti-HIV_V2_HeavyChain
caggugcaacugguccagagcggcgccgagguuaagaaacccggguccucugugaaggugagcugcaaggcuuccggaggcaccuucucuaacuacgccaucagcugggucagacaggcgccugggcagggacucgaauggaugggcgggauuaucccgauuuuuggaacaacggacuaugcucaaaaauuccagggccgggugaccaucacagccgaugccuccaccucuacagcuuacauggagcugagcucccuucgcagcgacgauaccgccguuuauuacugugcuagaucucggggccacuauuuugacacacgcguguucgaaggguggggacagggcacccuggucacgguguccagc

SEQ ID NO: 39590 - RNA, 372 nt, Artificial Sequence
  derived and/or modified sequence opt5 from anti-HIV_V2_HeavyChain
caggugcaccugguccaaagcggcaccgagguuaagaaacccggggccuccgugacagugucuugcaaggcuagcggauacuccuucacgggcuauuaccuccauugggucagacaggccccugggcagggacuggaauggaugggcuggaucaaccccaauucugggggaaccuauuacgcgcagaacuuucaagcucgggugacaaugacccgcgacacaagcauuuccaccguuuauauggaucuuucuagacugcggagcgacgauacagccguguacuauuguguccgcagagccgugcucaccgcucugccgccucgguacuacuucgacuuuuggggccagggcacgcuuguuaccguguccagc

SEQ ID NO: 39591 - RNA, 318 nt, Artificial Sequence
  derived and/or modified sequence opt5 from anti-HIV_V3_LightChain
agccuggagcucacccaacccccuuccgugucugucagcccgggccaaacaguuuccaucacgugcucugggaaccugcuuggagacaaggaugccagcugguaccagcugaaacccggccaguccccuauucucgugaucuaucuggacaccgaaagacccucugggauuccugagcgguucagcggauccaagagcggcaauacagcuacccuuacaaucucugggacccaggccauggaugaagcggaguacuuuugucaggcuugggacacaaccacggugcuguucggaggcggcacccgccucacaguccug

SEQ ID NO: 39592 - RNA, 324 nt, Artificial Sequence
  derived and/or modified sequence opt5 from anti-HIV_V3_LightChain
agcgacgagcugacccagcccccuuccgugucugucagcccgggccaaacagccagaaucacgugcuccggggaugcucuccccgaaaaguacgccuauugguaccagcagaaaucuggacaggcgccuguucuggugauugacgaggauaacaagcggcccuucggcaccccugaacgcuuuagcggguccagaucuggaacaauggcuacccuuacaaucaccggcgcccaaauggaggacgaagccgauuauuacuguagcuccacagacagccgggggaccuauuggguguucggaggcggcacgaaacugaccguccuc

SEQ ID NO: 39593 - RNA, 336 nt, Artificial Sequence
  derived and/or modified sequence opt5 from anti-HIV_V3_LightChain
cagagcgugcugacccaacccccuuccgucucugccgcuccgggccagaagguuacaaucagcugcuccgccgggaacucuaaaauuggagacaauuacaucagcugguaucagcacgugcccggcgcggcuccuaagcuccugauuuacgagaacgauaaaagacccuccgggaucccugaccgguucucuggaagcaaguccggcacgagcgccucucuugggauuaccggacugcagacaggcgaugaagccgacuauuacugugcugccugggauaauucccucagcucugcucuguauguguuuggcaccgggacaaaagucaccgugcuu

SEQ ID NO: 39594 - RNA, 339 nt, Artificial Sequence
  derived and/or modified sequence opt5 from anti-HIV_V3_LightChain
gacaucgugaugacccagagccccgauucccuggccgucucucucggcgagagagcuacaauuaacugcaagagcucccaaaauguuuucuacucuagcaacaaucggaacuaucuggccugguaccagcagcgcccugggcagccgcccaaacuucuguuuuauugggcguccacgagagaaucuggagugccugaccgguucagcggcuccgggagcggaaccgauuuuacacucaccaucucuucccugcaaacagaggacguggcuauuuacuauugucagcaguacuauaauacacccccuaccuucggccccgggaccaaggucgaaaucaaa

SEQ ID NO: 39595 - RNA, 318 nt, Artificial Sequence
  derived and/or modified sequence opt5 from anti-HIV_V3_LightChain
agcuacgagcugacccagcccccuuccgugucugucagcccgggccaaacagccacgauuaccugcuccggggaccuccugggagauaaguaugcuucuugguacagacagaaacccggccagagcccuguucuugugaucuaugaagacacaaagcggcccuccgggcugccugagcgcuucucuggaagcaacuccggcaauaccgccacacucaccaucagcgaaacacaggcgauggaugaggcugacuacuauugucaagccugggauaccagaacgguggucuuugggggaggcaccaaacugacagugcuu

SEQ ID NO: 39596 - RNA, 327 nt, Artificial Sequence
  derived and/or modified sequence opt5 from anti-HIV_V3_LightChain
cagagcgugcugacccaacccccuuccgucucugccgcuccgggccagaagguuacaaucagcugcuccgggagaucuagcgacauugagaacaaauucguguccugguaccagcagcuccccggaacggccccuaagcugcuuaucuaugaagauaauaaacggcccucuggcauuccugaccgcuuuagcggguccaagagcggaaccucugcgacacugggcaucaccgggcuccaaacaggagaugaggcugacuacuauuguggcaccugggauaacaaucugagagccggcuucgggggaggcacacaccuuaccgugcug

SEQ ID NO: 39597 - RNA, 324 nt, Artificial Sequence
  derived and/or modified sequence opt5 from anti-HIV_V3_LightChain
agcuacgagcugacccagcccccuuccgugucugucagcccgggccaaacagccagaaucacgugcuccggggacgcucuccccaacaaguaugccuucugguaccagcagaaaucuggacaggcgccuguucuggugauuuuugaugacaaucggcgccccgcuggcaucccugaaagauucagcgggucccggucuggaacccuugccacacugaccauuagcggcgcccaaguggaggaugaagcugacuauuacuguuauuccacagauaacgacgggaaguacuuugucuucggaagcggcaccauggugacaguucuc

SEQ ID NO: 39598 - RNA, 318 nt, Artificial Sequence
  derived and/or modified sequence opt5 from anti-HIV_V3_LightChain
agcuacgagcugacccagcccccuuccgugucugucagcccgggccaaacagccuccaucacgugcucugggcacaagcucggagacaaauaugcuagcugguaccagcauaagcccggccaguccccuguucuggugauuuaugaagauacccagagacccucugggaucccugagcggauuagcggauccaaaagcggcaacacagccacccuuacaaucucugggacccaagcgauggacgaagcugauuacuauugucaggccugggacucccgcgccgcuguguucggaggcggcacaagacugaccguccuc

SEQ ID NO: 39599 - RNA, 327 nt, Artificial Sequence
  derived and/or modified sequence opt5 from anti-HIV_V3_LightChain
cagagcgcccugacccaacccgcuuccgugucuggcagcccugggcaguccaucacaauuucuugcacgggaaucagcuccgacauuggcaccgauaacuacgucucuugguaucagcagcacccggggaaggcccccaaacucaucauuuacgagguuagcaauagaccuuccggaaucagccaucgguucucuggcuccaagagcgggaacacagcgucucugaucauuuccggacuucaaguggaagacgaggcucacuauuacuguaauagcuaucgcucugauacccugguguuuggcggcgggacaaaagucaccgugcuc

SEQ ID NO: 39600 - RNA, 333 nt, Artificial Sequence
  derived and/or modified sequence opt5 from anti-HIV_V3_LightChain
cagagcgugcugacccaacccccuuccgccucuggcacaccggggcagagagucacgaucagcugcuccggaucuagcuccaacauuggcucuaauaccguuaacugguaccagcaccuccccgggacagcuccuaagcugcuuaucuauagcaaugaccagcggcccuccggagugccugaucgcuucagcgggucuuccagcggcaccucugccucccuggcgauuagcggacuccaaucugaggacgaagcugauuacuauugugccgccugggacgauucccugaacggccccuuuguguucggcacagggaccaaagucacagugcuu

SEQ ID NO: 39601 - RNA, 318 nt, Artificial Sequence
  derived and/or modified sequence opt5 from anti-HIV_V3_LightChain
gacauccagaugacccaaagccccuccucucugagcgccuccgugggcgauagaauuacaaucacgugccggaccucucagagcauugacaaccaccucaauugguaccagcauaagccugggaaagcuccgaagcugcuuaucuccgccgcgucucgccugcagagcggaguccccuccagauucacaggcagcgggucuggaaccgaguuuacacucaccauuuccagccugcaaccugaagauuucgcuguuuauuacugucagcagucuuauaucacaaucaccuuuggccccgggacgaaaguggacauuaag

SEQ ID NO: 39602 - RNA, 321 nt, Artificial Sequence
  derived and/or modified sequence opt5 from anti-HIV_V3_LightChain
gagaucgugaugacccagagccccgccacacuguccgucucuccuggcgaagggguuacgcucagcugcagagcuucccaaucugugagcuccaacauucugugguaccagcagcggccgggacaggcgccccgccuucugcucuauggcgccucuaccagagcuacagggaucccugcccgguucagcggauccggcagcgggaccgaguuuacacugaccauuaauucuaugcaauccgaagacuucgccaucuacuauugucagcaguaccacgauuggcuuuggacacugggacagggcacccaaguggagauuaag

SEQ ID NO: 39603 - RNA, 327 nt, Artificial Sequence
  derived and/or modified sequence opt5 from anti-HIV_V3_LightChain
agcuacgagcugacccagcccccuuccgugucugucagcccgggccaaacagccuccaucacgugcucuggggacaagaugggagaaagauauaccagcugguaccagcagaaacccggccaguccccuguucucgugaugucugagaacauuaagcggcccgcugggaucccugaacgcuucagcggauccagcucuggcaauacagccauucugaccaucuccgggacacaagcgguggaugaggcugacuauuacugucaggucugggauaccacaaccacgagcuaugugauuuuuggaggcggcaccaaacuuacaguucug

SEQ ID NO: 39604 - RNA, 321 nt, Artificial Sequence
  derived and/or modified sequence opt5 from anti-HIV_V3_LightChain
gacauccagaugacccaaagccccuccucucugagcgccuccgugggcgauagagucacaauuacgugccaggcuucucaggacaucgggaacuaccucaauugguaucaccagaagccuggaaaagccccgaagcugcuuauuuacgaugcgagcaacguugagaccggcguggcuucccgguucucugggagcggauccggcacagacuuuacccugacaaucagcucucuccaacccgaagauauugggaccuauuucugucagcaguacgagucccugccuugggccuuuggaggcggcacaaaaguggaaauccgc

SEQ ID NO: 39605 - RNA, 333 nt, Artificial Sequence
  derived and/or modified sequence opt5 from anti-HIV_V3_LightChain
aacuucaagcugacccagccccacagcguguccgagucuccuggcaagacagucacgaucagcugcaccagaacauccgggaccauugccacaaauuacguucaaugguuucagcagcggccgggaucuagccccaccacaaugaucuaugaaaacgacaagcgcccuuccggcgugcccgauagauucucugggagcauugacaccuccagcaauucugcuucccucacgaucagcggacugaaaaccgaggaugaagccgacuacuauugucagucuuacaacuccacagauauuguggucuuuggcgggggaaccaaacuuacagugcug

SEQ ID NO: 39606 - RNA, 327 nt, Artificial Sequence
  derived and/or modified sequence opt5 from anti-HIV_V3_LightChain
cagagcgugcugacccaacccccuuccgucucugccgcuccgggccagaagguuacaaucagcugcuccgggucuagcuccaacauuggaaauaacauggugucuugguaccagcagcaccccggcacggccccuaaacuccugaucuaugagaauagcaagagacccuccgggauuccugaccgguucagcggaucucgcuccggcaccagcgcgacacuugggaucauuggacugcaaaccggcgaugaagcugaguacuauugugccacaugggacggcucucucagaaccguguuugggggaggcacaaaacugaccguccuu

SEQ ID NO: 39607 - RNA, 324 nt, Artificial Sequence
  derived and/or modified sequence opt5 from anti-HIV_V3_LightChain
agcuacgagcugacccagcccccuuccgugucugucagcccgggccaaacagccagaaucacgugcuccggggacgcucuccccaaccaguauggauacugguaucagcagaagccuggccaagcccccguucuggugauuuucaaagauucugaacggccuagcgggauccccgagcgcuuuuccggaucuagcuccggcaccacagugacccuuacaauuagcgggguccaggcggaagacgaggcugauuacuauugucagucugccgacuccagcggaaauuacgaaguguucggcggcgggaccaagcugacaguucuc

SEQ ID NO: 39608 - RNA, 330 nt, Artificial Sequence
  derived and/or modified sequence opt5 from anti-HIV_V3_LightChain
cagagcgugcugacccaacccccuuccgucucugaggccccgagacagcggguuacaaucagcugcuccggcucuagcuccaacauugggaauaacgcugugaauugguaccaacaggugcccggaaaggccccuaaacuccugaucuauuacgacgaucuucugcccucuggcgucagcgaccgcuucuccgggagcaagucuggauccagcgcgucucucgcuauuuccggccugcagagcgaagaugaggccgacuauuacugugccgcuugggaugacucucuuaaaguguauguuuuugggacgggaaccuccgugacaguccug

SEQ ID NO: 39609 - RNA, 333 nt, Artificial Sequence
  derived and/or modified sequence opt5 from anti-HIV_V3_LightChain
gacaucgugaugaaccagagcccucccucccuggccgucaccccgggcgagcccgcuucuauuagcugcagagccucccaaucucuccuguacagcgaugggcacaauuaucuugacugguaccugcagaagccuggacaggcgccccagcuccugaucuaucuuggcuccacacgggcuucugggguuccugaucgcuucagcggauccggcagcgggacggacuuuacccugaaaauuucuagaguggaagccgaggaugugggagucuacuauuguaugcaaccccuccaguccuacacauucggccagggcaccaagcuggaaaucaaa

SEQ ID NO: 39610 - RNA, 321 nt, Artificial Sequence
  derived and/or modified sequence opt5 from anti-HIV_V3_LightChain
gccuacgagcugacccagcccccuagcguguccgucucuccgggccaaacagcuagaaucacgugcagcggggacgcccuccccaaccaguaugcguacugguaucaccagcggccuggacaggcucccguucuggugauucauaaggauaccgaacgcccuuccggcauccccgccagauucucugggagcuccucuggaacaaccgugacacuuaccauuagcgagguccaagccgaagacgagggcgauuacuauugucaguccgcugacacaagcgccuacgugguuuuugggggaggcaccaaacugacggugcuc

SEQ ID NO: 39611 - RNA, 330 nt, Artificial Sequence
  derived and/or modified sequence opt5 from anti-HIV_V3_LightChain
cagagcgugcugacccaagcccccuccucuagcggcacaccugggcaguccgucacgaucucuugcagcggauccucuagcaacauggagauuaauuacguuuauugguacagacaguucccgggcaccgcuccccagcuccugaucuauaacgacaaucaacggccuuccggggugcccgaucgcuuuagcgccucuaaguccggaacaagcgcgucucuugcuauuggcgggcugagauccgaagacgaggccgauuacuucugugccguguggcacggagaccggggcggcccugucuuugggggaggcaccaaacucacagugcug

SEQ ID NO: 39612 - RNA, 327 nt, Artificial Sequence
  derived and/or modified sequence opt5 from anti-HIV_V3_LightChain
agcuacgagcugaagcagcccagauccgugucugucagcccuggccaaaccgcccggaucacaugcuccggggacgcuaugccgaaccaguaugccuacugguaucagcagcgccccggcagagcgccuguucuccugauuuucaaagauaaugaacgggcuucuggaauccccgagcgcauuagcggguccucuagcggaacgaccgccacacuuaccaucaacagagugcaagccgaagacgaggcugauuaccugugucaguccgccgacagcucuggcgcuuuuccuuggguguucgggggaggcacaacccucacaguccug

SEQ ID NO: 39613 - RNA, 324 nt, Artificial Sequence
  derived and/or modified sequence opt5 from anti-HIV_V3_LightChain
agcuacgagcugacccagcccccuuccgugucugucagcccgggccaaacagccagaaucacgugcuccggggacgcucuccccaaggaauaugccuacugguaucagcagaaaucuggacaggcgccuguucuggugauuuacgaggauacccggcgccccagcggcaucccugaaagauucuccgggucuagcuccggaacaauggcuacccuuacagugagcggcgcccacgucgacgaugaggccgacuauuacuguuauucucgggauaccuccgcuaaccaauggguguuugggggaggcacaaagcugaccguucuc

SEQ ID NO: 39614 - RNA, 318 nt, Artificial Sequence
  derived and/or modified sequence opt5 from anti-HIV_V3_LightChain
gagaucgugcugacccagagccccgccacacucucccugucuccuggcgaaagagcuacgcuuagcugccgggccucccaaucuauuagcaccuaccuggggugguaucagcagaagccgggacaggcgccccgccuccugaucuacgacgcuuccaacagagccacaggcauuccugcccgguucucugggagcggauccggcaccgauuuuacacuuaccaucagcucucuggagcccgaagacuucgcugucuauuacugucaacagcgcuauacauggauuaccuuugggcagggaacgagacucgagaucaaa

SEQ ID NO: 39615 - RNA, 327 nt, Artificial Sequence
  derived and/or modified sequence opt5 from anti-HIV_V3_LightChain
agcuacgagcugacccagcccccuuccgugucugucagcccgggccaaacagccagaaucacgugcuccggggacgcucuccccaaccaguauguuuacugguaucagcagcggccuggacaagcccccguggugguccuguacaaggauaccgaacgcccuucuggcauucccgagagauucagcggguccucuagcggaacaaccgugacacuuaccaucuccggcguucaggcggaagacgaggcugauuauuacugucagagcgccgacaauucuggggccuauccucuguuuuucggaggcggcacaaaacucaccgugcug

SEQ ID NO: 39616 - RNA, 333 nt, Artificial Sequence
  derived and/or modified sequence opt5 from anti-HIV_V3_LightChain
cagagcgugcugacccaacccccuuccgucucugccgcuccgggccagaagguuacaaucagcugcuccgggucuagcuccaacauuggaaauaacuacgugcucugguaucagcaguuccccggcacggccccuaagcugcuuaucuacgggaauaacaagagacccucuggcauuccugaccgguuuagcggauccaaaagcgggaccucugcgacacugggaaucaccggccuccaaacaggcgaugaggcugacuauuucugugccaccugggauuccgggcugagcgccgacuggguguuuggaggcgggacaaaacuuaccguccug

SEQ ID NO: 39617 - RNA, 321 nt, Artificial Sequence
  derived and/or modified sequence opt5 from anti-HIV_V3_LightChain
gacauccagaugacccaaagccccuccucucugagcgccuccgugggcgauagagucacaauuacgugccgggcuucucaggagaucgacaacuaccucgccugguaucagcagcgcccugggaaggcgccgaaaagccugauuuacgcugccuccucucuucaaggaggcguucccccuaaguucagcggguccggaagcggcaccgaauuuacacugaccaucucuucccuccaggccgaggauuucgcuacauauuacugucagcaguauaaugccuacccccugaccuuugggcaaggaacaagacuugacauuaac

SEQ ID NO: 39618 - RNA, 324 nt, Artificial Sequence
  derived and/or modified sequence opt5 from anti-HIV_V3_LightChain
agcuacgagcugacccagcccccuucccucucugugagcccgggccaaacagccuccaucacgugcucuggggacggacugcccaagcaguauggcuacugguaucagcagaaaccugggcaagcuccccuucuggucauucucaaggauaccgaaagaccuagcggaauccccgagcgguucuccggcucuagcuccgggacaaccguuacacugaccauuagcggagugcaggccgaagacgaggcggauuacuauugucagucuguggacuccacaggcagcuacuaugucuuuggcccugggaccaaagugacgguucuu

SEQ ID NO: 39619 - RNA, 324 nt, Artificial Sequence
  derived and/or modified sequence opt5 from anti-HIV_V3_LightChain
agcuacgagcugacccagcccccuuccgugucugucagcccgggccaaacagccagaaucacgugcuccggggacguucuccccaagaaauaugcuuacugguaucagcagaagucuggacuggccccugugcuugugauuuacgaagauaaccggcgccccagcggcaucccugagagauucuccgggucuagcuccggaaccauggcgacacugaccauuagcggcgcucaggucgaagacgagggggauuauuacuguucuuccacagacagcucuggagaucacuauguguuuggcaccggcacaaaaguuaccgugcuc

SEQ ID NO: 39620 - RNA, 321 nt, Artificial Sequence
  derived and/or modified sequence opt5 from anti-HIV_V3_LightChain
gccuacgagcugacccagcccccuagcguguccgucucuccgggccaaacagcuagaaucacgugcagcgccgaagcgcucuccaaccaguaugcuuacugguaucggcagcgccccgggcaggccccucugcuuauuaucuacaaggacaccaaaagacccucuggcauuccugagcgguucagcggauccacaucugggaccacaguuacccugacaaucagcggagugcaagccgaagaugaggcugacuauuacugucaguccgccgauagcucuggcgacuauguguuugggggaggcaccaaggucacggugcuc

SEQ ID NO: 39621 - RNA, 333 nt, Artificial Sequence
  derived and/or modified sequence opt5 from anti-HIV_CD4bs_LightChain
cagcccgugcugacccaaagcuccucugccagcgcuucccucggcucuagcgucaagcugacaugcacgcuuggguccggacacucuggcagcaucauugccuggcaucagcagcagccugggaaagcgccgagauaccugaugaagguucaauccagcggaucuuauaacaaaggcuccggggugcccgaccgguucagcggaucuuccagcggcgcugaucgcuaccucaccaucucuaaucugcaguuugaggacgaaggcgauuauuacugugagacaugggacaccaacaaguauguguucgggacaggaaccaaagucacagugcuu

SEQ ID NO: 39622 - RNA, 324 nt, Artificial Sequence
  derived and/or modified sequence opt5 from anti-HIV_CD4bs_LightChain
gagcuggugcucacccagagccccggcacacugucccuuucuccuggggaaagagccacgcugagcugccgggcuucccaaucugucgccagcuacuaucucgcgugguaccagcagaagccgggacaggcuccccgccugcuuaucuauggcgccuccucuagagccaccgggauuccugaccgguucagcggauccguuagcggcacagauuuuacccugacaaucucucgccucgagcccgaagacuucgcucuguacuauugucaacaguacggguccagcccucugucuuuuggaggcggcaccaaaguggagauuaga

SEQ ID NO: 39623 - RNA, 333 nt, Artificial Sequence
  derived and/or modified sequence opt5 from anti-HIV_CD4bs_LightChain
cagagcgcccugacccaacccccuuccaugucuggcagcccggggcaguccaucacaauuucuugcacgggaagcggcuccgacguggggucucacaacuucgucagcugguaccagcagcaucccgcuagaguuccuaagcuccugaucuaugccgugggaaaucggcccuccggcgugagcgagcgcuuuucuggguccaaaagcggaaacaccgcguaccuuacaauuucuggccugcaagcugaugacgaagccgauuauuacuguuccagccacaccacaggcaccacacucgaggucuucgggggaggcaccagacugacggugcuu

SEQ ID NO: 39624 - RNA, 333 nt, Artificial Sequence
  derived and/or modified sequence opt5 from anti-HIV_CD4bs_LightChain
gacaucgugaugacccagagcccccugucccucccugucacaccgggcgagcccgccucuauuagcugcagauccucugaaagccugcuucacuccaacggguucaucuaccuggauugguaucuccaaaagccuggacagucuccccagcugcuuauuuaccugggcagcaaacgggcuuccgggguuagcgaccgcuuuucuggauccggcagcgggacggccuucacccucaagaucucuagaguggaggcggaagaugugggagucuauuacuguaugcaggcucuggagucccggacauuuggccaaggcaccaaacuggaaauuaag

SEQ ID NO: 39625 - RNA, 327 nt, Artificial Sequence
  derived and/or modified sequence opt5 from anti-HIV_CD4bs_LightChain
gagaucgugcugacccagagccccggcacacucucccugucuccuggggaaagagccacgcuuagcugccgggcuucccaaucugucagcuccucuuaccuggccugguaucagcagaagccgggacagagcccccgccuccugauuuacggcgcguccagcagagcuaccgggaucccugaccgguucucuggauccggcagcgggacagauuuuacccuuacaauuucucgccuggagcccgaagacuucgccguuuauuacugucaacacuauggauccagcucuaucuuuaccuucggcccuggcacaaaaguggauauuaga

SEQ ID NO: 39626 - RNA, 330 nt, Artificial Sequence
  derived and/or modified sequence opt5 from anti-HIV_CD4bs_LightChain
aacuucaugcugacccagccccacagcguguccggcucuccugggaagacagucacgaucagcugcaccagauccucuggaagcauugccggcaauuacguucaaugguaucagcagcggccggggacaucccccaccacagugaucuacgagaacgaccagcgcucuagcggagugccugauagauuuuccggcagcauugacucuuccagcaauucugcuucccucaccaucagcgggcugaagacagaagaugaggccgacuauuacugucauucuuaugaugcgaccaaccaagucuucggaggcggcacgaaacuuaccgugcug

SEQ ID NO: 39627 - RNA, 333 nt, Artificial Sequence
  derived and/or modified sequence opt5 from anti-HIV_CD4bs_LightChain
gacguggucguuacccagagcccccugucccucccugugacacugggccaaccggccucuaucagcugcagauccucucagagccuuguguacuccgaugggacgacccaccugaacugguaucaucagcggcccggacagccuccccgcagacucauuuaccgggucucuaaucgcgacagcggcgugccugauagauucuccgggagcggaucuggcacagacuuuacccugcggaucucccgcguugaggcugaagauguggggcuuuauuacuguaugcuggccacacaccccuucaccuuuggaccuggcacaaaggucgagauuaaa

SEQ ID NO: 39628 - RNA, 336 nt, Artificial Sequence
  derived and/or modified sequence opt5 from anti-HIV_CD4bs_LightChain
cagagcgugcugacccaacccccuuccgucucuggcgccccggggcagacaguuacgaucagcugcaccggauccucuagcaacauuggccccuccuacgacgugcagugguaucagcaauucccugggagagcucccaagcuccugaucucuggaaauaacaaucgggccagcggcgugccugaucgcuuuuccgggagcaaaucuggaacauccgcgagccuugcuauuaccggccugcagucugaggacgaagccgauuacuauugucagacauacgacuccagccucucuggccacgucguguucgggggaggcaccagacugacaguucuu

SEQ ID NO: 39629 - RNA, 321 nt, Artificial Sequence
  derived and/or modified sequence opt5 from anti-HIV_CD4bs_LightChain
gacauccagaugacccaaagccccuccacacugucugccagcgugggcgauagagucacgauuaccugccgggcuuccgccucuaucuacacauggcucgcgugguaucagcagcgcccugggaaggcuccggagguucugauuuacaaagccagcacccuuaaguccggagugcccucuagauucagcggcuccgggagcggaacagaauuuacccugacaaucucuucccuccagccuggcgacuucgccaccuauuacugucaacaguauacgaccuacccccugacauuugggggaggcaccacaguggagauuaaa

SEQ ID NO: 39630 - RNA, 330 nt, Artificial Sequence
  derived and/or modified sequence opt5 from anti-HIV_CD4bs_LightChain
cagagcgcccugacccaacccgcuuccgugucuggcagcccugggcaguccaucacaauuucuugcacgggaaccagcaacgacaucggcacauacaaucucgucuccugguaucagcaccauccgaacaaggcccccaaaguugugguguacgagaauaacaagagaccuucugggauuagcaaucgguucuccggaagcaaaucuggcaacaccgcgucccugacaaucagcgggcuucaggcugaagaugaggccgacuauuacuguugcucuuaugccggauccagcaccugggucuuuggcggcgggacaaagcugaccgugcuc

SEQ ID NO: 39631 - RNA, 321 nt, Artificial Sequence
  derived and/or modified sequence opt5 from anti-HIV_V2_LightChain
gacauccagaugacccaaagccccuccacacugucugccagcgugggcgauagagucacgauuaccugccgggcuucccagacaaucucuagcuggcucgccugguaccagcagaaguccgggaccgcgccuaaacugcuuauuuauaaggcuucuagcaucguuuccggagugccgagccgcuucucuggcuccgggagcggaacagaguuuacccugacaauuaccucucuccaacccgacgauuucgccacguacuauugucagcaguacaacuccagcccugaaaccuuuggccaggggacaaaaguggagaucaag

SEQ ID NO: 39632 - RNA, 318 nt, Artificial Sequence
  derived and/or modified sequence opt5 from anti-HIV_V2_LightChain
gagaucgugcugacccagagccccggcacacucucccugucuccuggggaaagagccacgcuuagcugccgggcuucccaaucugucagcuccuaccuggccugguaucagcagaagccgggacaggcgccccgccuccugauuuacgacgcuucuagcagagccaccggcaucccugaucgguucuccgggagcggaucuggcacagacuuuacccuuacaauuucccgccuggagcccgaagauuucgccguuuauuacugucaacacuaugcugggagcagaaccuuuggacagggcacaaaaguggagaucaag

SEQ ID NO: 39633 - RNA, 333 nt, Artificial Sequence
  derived and/or modified sequence opt5 from anti-HIV_V2_LightChain
cagagcgugcugacccaacccccuuccgucucuggcgccccggggcagagaguuacaaucagcugcacgggauccucuagcaacauuggcgcucacuacgacgugcauugguaucagcagcuccccgggaccgccccuaagcugcuuaucuacggaaauuccaaccggcccucuggcgugccugaucgcuucagcggguccaaaagcggaacaucugcgucccuggcuauuaccggccuccaagccgaggacgaagccgauuauuacugucagagcuaugacucuucccugagcggcuacgucuuugggacaggaaccaaggugacaguucuu

SEQ ID NO: 39634 - RNA, 324 nt, Artificial Sequence
  derived and/or modified sequence opt5 from anti-HIV_V2_LightChain
gacaccgugaugacacagagccccgccacgcuguccgucucuccuggcgagagaguuacccucagcugccgggcuucccaaaucauuaacacaaaucuggccugguaccagaagcgcccggggcaggcgcccagacuucugaucuaugcugccucugcccgggcuaccggcauuccugcccgcuucagcggauccgggucuggaacagaauuuacccucacaaucagcggccugcaguccgaggauagcgcuguguacuauugucaacaguacaagcacuggcccccuuauaccuucgggagaggaacgaaacuugaaauucgg

SEQ ID NO: 39635 - RNA, 321 nt, Artificial Sequence
  derived and/or modified sequence opt5 from anti-HIV_V2_LightChain
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccagaaccuuuggccagggcacaaaaguggagaucaag

SEQ ID NO: 39636 - RNA, 321 nt, Artificial Sequence
  derived and/or modified sequence opt5 from anti-HIV_V2_LightChain
gacauccagaugacccaaagccccuccucucugagcgccuccgugggcgauagagucacaauuacgugccgggcuucucagagcaucuccgggaaccucaauugguaccagcagaagccuggaaaagccccgaaccugcuuauuuauggcgcgucuagccugcaauccgggguucccagccgcuucucuggauccggcagcgggaccgacuuuacacucaccaucucuucccugcagccugaggauuucgcuacauaccacugucagcagagccauucuaccuccuggacauuuggacaaggcaccaagguggugauuaaa

SEQ ID NO: 39637 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaaccacuacaccagcugguaucagcagaagacaggacaggccccugugcuucugauuuacccgaaacauaaucgcucccccggcaucucugacagauucagcgcguccucuagcgggaacaccgcuucccucacaauuaccggagcccaaacggaagaugagggcgacuauuacuguagcucucgggauaaguccgggagccgccuggugaccuuuggaggcggcacagaagucaccgggcuu

SEQ ID NO: 39638 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaaccacuacaccagcugguaucagcagaagacaggacaggccccugugcuucugauuuacccgaaacauaaucgcucccccggcaucucugacagauucagcgcguccucuagcgggaacaccgcuucccucacaauuaccggagcccaaacggaagaugagggcgacuauuacuguagcucucgggauaaguccgggagccgccuggugaccuuuggaggcggcacaaaagucaccgugguu

SEQ ID NO: 39639 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaacuacuauaccagcugguaccagcagaagccuggacaggccccggugcuucugauuuaucccaaacacaaucgcccucccggcaucuccgacagauucucugcgagcuccucugggaacacagcuagccucaccauuacaggagcccaaaccgaagaugagggcgacuacuauuguuccagccgggauaagucugggucccgccuggugacguuuggaggcggcaccaaagucacagggcuu

SEQ ID NO: 39640 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaacuacuauaccagcugguaccagcagaagccuggacaggccccggugcuucugauuuaucccaaacacaaucgcccucccggcaucuccgacagauucucugcgagcuccucugggaacacagcuagccucaccauuacaggagcccaaaccgaagaugagggcgacuacuauuguuccagccgggauaagucugggucccgccuggugacguuuggaagaggcaccaaacuuacagucgug

SEQ ID NO: 39641 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaaccacuacaccagcugguaucagcagaagacaggacaggccccugugcuucugauuuacccgaaacauaaucgcucccccggcaucucugacagauucagcgcguccucuagcgggaacaccgcuucccucacaauuaccggagcccaaacggaagaugagggcgacuauuacuguagcucucgggauaaguccgggagccgccuggugaccuuuggaggcggcacaaaagucaccgugcuu

SEQ ID NO: 39642 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaacuacuauaccagcugguaccagcagaagccucgccaggccccggugcuucugauuuaucccaaacacaauagaccucccggaaucuccgaccgguucucugcgagcuccucuggcaacacagcuagccucaccauuacaggggcccaaaccgaagaugagggagacuacuauuguuccagccgcgauaagucuggcuccagacuggugacguuugggggaggcaccaaacuuacaguccug

SEQ ID NO: 39643 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaacuacuauaccagcugguaccagcagaagccuggacaggccccggugcuucugauuuaucccaaacacaaucgcccucccggcaucuccgacagauucucugcgagcuccucugggaacacagcuagccucaccauuacaggagcccaaaccgaagaugagggcgacuacuauuguuccagccgggauaagucugggucccgccuggugacguuuggaggcggcaccaaacuuacaguccug

SEQ ID NO: 39644 - RNA, 327 nt, Artificial Sequence
  derived and/or modified sequence opt5 from anti-HIV_10E8
gccagcgagcugacccaggaccccacaguguccgucgcucucggccaaacgguuaccaucacaugcagaggggauucucugcggaaccacuacaccagcugguaucagcagaagacaggacaggccccuauucuucugaucuacccgaaacauaauagacccccuggcauuuccgaccgcuucucugcgagcuccucugggaacaccgcuagccucacaaucaccggagcccaaacggaagaugagggcgacuauuacuguuccagccgggauaagucugggucccgccuggugaccuuuggaggcggcacaaaacuuaccgugcug

SEQ ID NO: 39645 - RNA, 327 nt, Artificial Sequence
  derived and/or modified sequence opt5 from anti-HIV_10E8
agcuccgaccugacccaggaucccgccgugucugucgcucucggccaaacaguuagaaucacgugccagggggacagccugcggcgcuacuaugccggaugguaccagcagaagccuggccaagcgccggugcuuguggucuaugggagagauaaccggcccuccggcauuccugaccgcuucucuggaagcaccuccgggaauacagcuucucugaccaucgccggagcccaggcugaggaugacgccgauuacuauuguagcuccagagacaaaagcggcucucggcucuccguguuuggcgggggaacaaagcugaccguucuu

SEQ ID NO: 39646 - RNA, 327 nt, Artificial Sequence
  derived and/or modified sequence opt5 from anti-HIV_10E8
gccagcgagcugacccaggaccccgcuguguccgucgccuucgaaaagacaguuacgauuaccugccaaggcgauucucucagaagccacuacguguccugguaucagaaacggccugggcaggcgccggugcuggucuuuuacggaaagaacaaucgccccucuggcaucccugacagauucagcggguccacaucuggaaacaccgcuagccuuacaaucgccggcgcccaggcugaggaugacgccgauuauuacuguuccagccgggacaaaucugggucccgccugagcguguuuggaggcggcaccaagcucacaguuccc

SEQ ID NO: 39647 - RNA, 327 nt, Artificial Sequence
  derived and/or modified sequence opt5 from anti-HIV_10E8
gccagcgagcugacccaggaccccgcuguguccgucgcccucaagcaaacaguuacgauuaccugcagaggcgauucucugcggagccacuacguguccugguaucagcagaaaccugggcaggcgccggugcuugucuucuacggaaagaacaaucgccccucuggcaucccugacagauuuagcggguccucuagcggaaacacagcuucccugaccaucgccggcgcccaagcugaagaugacgccgauuauuacuguagcucucgggacaaauccgggagccgccucucuguguucggaggcggcacaaagcugaccguucuu

SEQ ID NO: 39648 - RNA, 327 nt, Artificial Sequence
  derived and/or modified sequence opt5 from anti-HIV_10E8
agcuccgagcugacccaggaccccggcgugucugucgcccucaagcaaacaguuacgauuaccugcagaggggauagccugcggucccacuacgugucuugguaucagaaaaagccuggacaggcuccggugcuugucuucuacggcaaaaacaucgggcccagcggaaucccugaccgcuuuuccggcucuacaagcgggaauaccgccucccugacaauugcgggagcucaggccgaagaugacgccgauuauuacuguagcucuagagacaaguccggcagccggcucucuguguucggcgggggaaccaaacugacaguucuu

SEQ ID NO: 39649 - RNA, 327 nt, Artificial Sequence
  derived and/or modified sequence opt5 from anti-HIV_10E8
gccagcgagcugacccaggaccccgcuguguccgucgcccucaagcaaacaguuacgauuaccugcagaggcgauucucugcggagccacuacguguccugguaucagaaaaagccugggcaggcgccggugcuugucuucuacggcaaaaacaaucgccccucuggaaucccugacagauuuagcggguccucuagcggaaacacagcuucccugaccaucgccggcgcccaggcugaagaugacgccgauuauuacuguagcucucgggacaaguccgggagccgccucucuguguucggaggcggcacaaaacugaccguucuu

SEQ ID NO: 39650 - RNA, 327 nt, Artificial Sequence
  derived and/or modified sequence opt5 from anti-HIV_10E8
gccagcgagcugacccaggaccccggcguguccgucgcucucaagcaaacaguuacgauuaccugcagaggggauucucugcggagccacuacguguccugguaucagaaacgcccuggacaggccccggugcuugucuucuacggcaagaacaauagacccucugggaucccugaccgguuuagcggauccacaucuggcaacaccgcgagccugacaaucgcuggggcccaggccgaagaugacgcugauuauuacuguuccagccgcgacaaaucuggauccagacucagcguguucggcggcgggaccaagcugacaguucuu

SEQ ID NO: 39651 - RNA, 327 nt, Artificial Sequence
  derived and/or modified sequence opt5 from anti-HIV_10E8
gccagcgagcugacccaggaccccggcguguccgucgcucucgaacaaacaguuacgauuaccugcagaggggauucucugcggagccacuacguguccugguaucagaagaaaccuggacaggccccggugcuugucuucuacggcaagaacaaucgccccucugggaucccugacagauuuagcggauccacaucuggcaacaccgcgagccugacaaucgcuggggcccaggccgaggaugacgcugauuauuacuguuccagccgggacaaaucuggaucccgccucagcguguucggcggcgggaccaagcugacaguucuu

SEQ ID NO: 39652 - RNA, 327 nt, Artificial Sequence
  derived and/or modified sequence opt5 from anti-HIV_10E8
gccagcgagcugacccaggaccccggcguguccgucgcucucaagcaaacaguuacgauuaccugcagaggggauucucugcggagccacuacguguccugguaucagaaaaagccuggacaggccccggugcuugucuucuacggcaaaaacaaucgccccucugggaucccugacagauuuagcggauccacaucuggcaacaccgcgagccugacaaucgcuggggcccaggccgaagaugacgcugauuauuacuguuccagccgggacaagucuggaucccgccucagcguguucggcggcgggaccaaacugacaguucuu

SEQ ID NO: 39653 - RNA, 327 nt, Artificial Sequence
  derived and/or modified sequence opt5 from anti-HIV_10E8
agcuccgagcugacccaggaccccggcgugucugucgcccucaagcaaacaguuacgauuaccugcagaggggauagccugcggucccacuacgugucuugguaucagaaaaagccuggacaggcuccggugcuugucuucuacggcaaaaacaaucgccccagcgggaucccugacagauuuuccggaucuacaagcggcaacaccgccucccugacaaucgcgggggcucaggccgaagaugacgccgauuauuacuguagcucucgggacaaguccggaagccgccucucuguguucggcggcgggaccaaacugacaguucuu

SEQ ID NO: 39654 - RNA, 327 nt, Artificial Sequence
  derived and/or modified sequence opt5 from anti-HIV_10E8
agcuccgagcugacccaggaaacaggcgugucugucgcccucgggagaacgguuaccaucacaugccggggagacagccugcgcucccacuacgcuucuugguaucaagagaagcccggccaggccccuaaacuucuguucuacgggaagaacaauagaccgagcggcauucccgaucgguuuuccggaucugcgagcgggaaccgcgcuucccucaccaucagcggagcccaggccgaagacgaugcugaguauuacuguucuuccagagacaaaagcggcucucggcuguccguguucggcgggggaacaaagcuggccgugcuu

SEQ ID NO: 39655 - RNA, 327 nt, Artificial Sequence
  derived and/or modified sequence opt5 from anti-HIV_10E8
agcuccgagcugacccaggaaacaggcgugucugucgcccucgggagaacgguuaccaucacaugccggggagacagccugcgcucccacuacgcuucuugguaucaaaagaaacccggccaggccccuaaacuucuguucuacgggaagaacaauagaccgagcggcauucccgaucgguuuuccggauucgcgucugggaaccgcgcuagccucaccaucuccggagcccaggccgaggacgaugcugaauauuacuguagcucuagagacaaguccggcagccggcugucuguguuuggcgggggaacaaaacuuaccgugcug

SEQ ID NO: 39656 - RNA, 327 nt, Artificial Sequence
  derived and/or modified sequence opt5 from anti-HIV_10E8
agcuccgagcugacccaggaaacaggcgugucugucgcccucgggagaacgguuaccaucacaugccggggagacagccugcgcucccacuacgcuucuugguaucaaaagaaacccggccaggccccuaaacuucuguucuacgggaagaacaauagaccgagcggcauucccgaucgguuuuccggaucugcgagcgggaaccgcgcuucccucaccaucagcggagcccaggccgaggacgaugcugaauauauuuguucuuccagagacaagagcggcucucggcuguccguguucggcgggggaacaaaacuuaccgugcug

SEQ ID NO: 39657 - RNA, 327 nt, Artificial Sequence
  derived and/or modified sequence opt5 from anti-HIV_10E8
agcuccgagcugacccaggaaacaggcgugucugucgcccucgggagaacgguuaccaucacaugccggggagacagccugcgcucccacuacgcuucuugguaucaaaagaaacccggccaggccccuaaacuucuguucuacgggaagaacaauagaccgagcggcauucccgaucgguuuuccggaucugcgagcgggaaccgcgcuucccucaccaucagcggagcccaggccgaggacgaugcugaauauuacuguucuuccagagacaagagcggcucucggcuguccguguucggcgggggaacaaaacuuaccgugcug

SEQ ID NO: 39658 - RNA, 327 nt, Artificial Sequence
  derived and/or modified sequence opt5 from anti-HIV_10E8
agcuccgagcugacccaggaaacaggcgugucugucgcccucgggagaacgguuaccaucacaugccggggagacagccugcgcucccacuacgcuucuugguaucaaaagaagcccggccaggccccuauucuucuguucuacgggaagaacaauagaccgagcggaauccaugaucgguuuuccggcucugcgagcgggaaccgcgcuucccucaccauuagcggagcccaggccgaggacgaugcugaauauuacuguucuuccagagacaaaagcggcucucggcuguccguguucggcgggggaacaaaacuuaccgugcug

SEQ ID NO: 39659 - RNA, 393 nt, Artificial Sequence
  derived and/or modified sequence opt5 from anti-HIV_10E8
gaggugcagcuggucgaaagcggcggggaccucguuaagcccggaggcucccugagacuuucuugcagcgccuccggguucucuuuuaaaaacaccuggaugacaugggugcggcaagcuccuggaaagggccuggaguggguggggcgcaucacgggaccgggcgaaggcuggaccagcgauuacgccgcgacaguccaggggagauucaccauuucccggaauaacaugaucgacaugcucuaucuggagaugaaucgccuuagaacagaugacaccggacuguacuauugugugcacacagaaaaauacuauaacuuuuggggcggguaucccccuggagaggaguacuuccagcauuggggccgggggacccucguuauugugucuagc

SEQ ID NO: 39660 - RNA, 393 nt, Artificial Sequence
  derived and/or modified sequence opt5 from anti-HIV_10E8
gagaucagacugguggaaagcggcgggggacucgucaagcccggcgggucccugcggcuuucuugcagcgccuccggauucaacuuugacucugcuuggaugaccuggguucgccagccuccgggcaaagggcuggagugggugggaagaauuacaggccccggcgaaggguggagcgugggauacgccgaguccgucaagggccgguucaucauuucucgcaucaauagcauuaacuuucucuaucuggaaaugaauaaccuuagaccugaggauacgggguccuacuucugugcgcacaccggaaaacauuaugacuuuuggcggggcuaucccccuggggaggaauacuuccaagauuggggacagggcacacaggugaucguuagcucu

SEQ ID NO: 39661 - RNA, 393 nt, Artificial Sequence
  derived and/or modified sequence opt5 from anti-HIV_10E8
gagaucagacugguggaaagcggcgggggacucgucaagcccggcgggucccugcggcuuucuugcagcgccuccggauucaacuuugacucugcuuggaugaccuggguucgccagccuccgggcaaagggcuggagugggugggaagaauuacaggccccggcgaaggguggagcguggauuacgccgaguccgucaagggacgguucaucauuucucgcaucaauagcauuaacuuucucuaucuggaaaugaauaaccuuagaccugaggacacgggcuccuacuucugugcgcacaccgggaaacauuaugauuuuuggcggggauaucccccuggcgaggaauacuuccaagacugggggcagggaacacaggugaucguuagcucu

SEQ ID NO: 39662 - RNA, 393 nt, Artificial Sequence
  derived and/or modified sequence opt5 from anti-HIV_10E8
gaggugagacuggucgaaagcggcgggcggcucguucgccccggaggcucccugagacuuucuugcagcgccuccggguucaacuuugacaaugcuuggaugaccugggugcggcagccuccgggaaagggccuggaguggguggggcgcaucacaggacccggcgaaggcuggucugucgauuacgccgcgagcgugaaagggagauucacgauuucccggaugaacucuaucaacuuuuucuaucucgagaugaauaaucugaagauugaagacaccggacuuuacuuuugugcucgcacaggcaaacacuaugccuucuggggaggguacccucccggcgaggaguaucuggaagauugggggcaaggaacccucguuaucgugagcucc

SEQ ID NO: 39663 - RNA, 393 nt, Artificial Sequence
  derived and/or modified sequence opt5 from anti-HIV_10E8
gaggugagacuggucgaaagcggcgggggacucguuaagcccggcgggucccugcggcuuucuugcagcgccuccggauucaacuuugacgaugcuuggaugaccugggugcgccagccuccgggcaaagggcuggagugggugggaagaaucucuggccccggcgaaggguggagcgucgacuacgccgaguccgugaagggacgguucacaauuucucgccucaauagcaucaacuuucuguaucuugaaaugaauaacguuagaacggaggauaccggcuacuauuucugugcgcggacagggaaacacuacgacuuuugguccggauauccucccggcgaggaauacuuccaagauugggggcagggaacccuggugauugucagcucu

SEQ ID NO: 39664 - RNA, 393 nt, Artificial Sequence
  derived and/or modified sequence opt5 from anti-HIV_10E8
gaggugagacuggccgaaagcggcgggggacucgucaagcccggcgggucccugcggcuuucuugcagcgcuuccggauucgacuuugauaacgccuggaugaccuggguucgccagccuccgggcaaagggcuggagugggugggaagaaucacaggccccggcgaaggguggucuguggacuacgcggcuccugucgagggacgguucacgauuagccgccucaauuccaucaacuuucuguaucuugaaaugaauaaccugagaauggaggauucuggccucuacuucugugcccggaccgggaaguauuacgacuuuuggagcggauaucccccuggcgaggaauacuuccaagauugggggcagggaacacuggugauuguucccucc

SEQ ID NO: 39665 - RNA, 393 nt, Artificial Sequence
  derived and/or modified sequence opt5 from anti-HIV_10E8
gaggugagacuggucgaaagcggcgggggacucguuaagcccggcgggucccugcggcuuucuugcagcgccuccggauucgacuuugauaacgcuuggaugaccugggugcgccagccuccgggcaaagggcuggagugggugggaagaaucacaggccccggcgaaggguggucugucgacuacgccgcgccuguggagggacgguucacgauuagccgccucaauuccaucaacuuucuguaucuugaaaugaauaaccugagaauggaggauucuggccucuacuucugugcucggaccgggaaguauuacgacuuuuggagcggauaucccccuggcgaggaauacuuccaagauugggggcagggaacacugguuauugugcccucc

SEQ ID NO: 39666 - RNA, 393 nt, Artificial Sequence
  derived and/or modified sequence opt5 from anti-HIV_10E8
gaggugagacuggucgaaagcggcgggggacucguuaagcccggcgggucccugcggcuuucuugcagcgccuccggauucgacuuugauaacgcuuggaugaccugggugcgccagccuccgggcaaagggcuggagugggugggaagaaucacaggccccggcgaaggguggucugucgacuacgccgcgccuguggagggacgguucacgauuagccgccucaauuccaucaacuuucuguaucuugaaaugaauaaccugagaauggaggauucuggccucuacuucugugcucggaccgggaaguauuacgacuuuuggagcggauaucccccuggcgaggaauacuuccaagauugggggcagggaacacugguuauuguguccagc

SEQ ID NO: 39667 - RNA, 393 nt, Artificial Sequence
  derived and/or modified sequence opt5 from anti-HIV_10E8
gaggugagacuggccgaaagcggcgggggacucgucaagcccggcgggucccugcggcuuucuugcagcgcuuccggauucgacuuugauaacgccuggaugaccuggguucgccagccuccgggcaaagggcuggagugggugggaagaaucacaggccccggcgaaggguggucuguggacuacgcggcuccugucgagggacgguucacgauuagccgccucaauuccaucaacuuucuguaucuugaaaugaauaaccugagaauggaggauucuggccucuacuucugugcccggaccgggaaguauuacgacuuuuggagcggauaucccccuggcgaggaauacuuccaagauugggggcgcggaacacuggugauuguuuccagc

SEQ ID NO: 39668 - RNA, 393 nt, Artificial Sequence
  derived and/or modified sequence opt5 from anti-HIV_10E8
gaggugagacuggucgaaagcggcgggggacucguuaagcccggcgggucccugcggcuuucuugcagcgccuccggauucgacuuugauaacgcuuggaugaccugggugcgccagccuccgggcaaagggcuggagugggugggaagaaucacaggccccggcgaaggguggucugucgacuacgccgcgccuguggagggacgguucacgauuagccgccucaauuccaucaacuuucuguaucuugaaaugaauaaccugagaauggaggauucuggccucuacuucugugcucggaccgggaaguauuacgacuuuuggagcggauaucccccuggcgaggaauacuuccaagauugggggcgcggaacacugguuauuguguccagc

SEQ ID NO: 39669 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggagaucuagcaacauuggaaauaacaauguguucugguaccagcagcuccccggcacggccccuaaacugcuuaucuaugacaacgauaagcggcccuccgggauuccugaccgcuuuucuggaagcaaauccggcaccagcgcgacacuggggaucaccggacuccaaacaggcgaugaggcugacuacuauuguggcaccugggauucuucccugagcgccgggggaguguucggcacagggaccaaggucacggugcuu

SEQ ID NO: 39670 - RNA, 336 nt, Artificial Sequence
  derived and/or modified sequence opt5 from anti-HIV-1_LightChain
cagagcgugcugacccaacccgccuccgucucuggcagcccugggcaguccaucacaauuucuugcacgggaaccaagagcgacaucggcggguacaaauauguuuccugguaccagcagcacccgggaaaggcucccaaaauucucaucuaugaugugaacaagagaccuucuggcauucccgaccgguucagcggguccaaaagcggaacaucugccacccugggcaucacaggccuucaaaccggggaugaggcggacuacuauuguggaacaugggauaauucccugagcaccggcgggguguuuggaacgggcaccaaggucacagugcuc

SEQ ID NO: 39671 - RNA, 321 nt, Artificial Sequence
  derived and/or modified sequence opt5 from anti-HIV-1_LightChain
cagagcgugcugacccaacccccuuccgucucugccgcuccgggccagagaguuacaaucagcugcuucgggucccgguuuucuagcguguccugguaccagcagcuccccggaacggccccuaagcugcuuauuuaugagaacaccaaacgccccucuggcaucccugacagauucagcggguccaagagcggaacaucugcgacccugggcauuacagggcuccaaaccggagaugaagcugacuacuauuguggcacaugggaucggucccugagcgccggcgggguguuuggaaccggcacgaaagucaccgugcuu

SEQ ID NO: 39672 - RNA, 333 nt, Artificial Sequence
  derived and/or modified sequence opt5 from anti-HIV-1_LightChain
cagagcgugcugacccaacccccuuccgccucuggcacaccggggcagacgaucaccauuagcugcuccggaucuagcuccaacaucggcucuaaugacgucuacugguaucagcaccuccccgggacaaccccuaagguugugauuuacaaaaacaauagacggcccagcggaaucccugaucgcuucuccggcagcaagucugggacauccgcuacccugggaauuacaggccuucagaccggcgacgaggccgauuauuacugugggacgugggacagaagccugucugcgggaggcguguuugggaccggaacaaaagucaccgugcuc

SEQ ID NO: 39673 - RNA, 327 nt, Artificial Sequence
  derived and/or modified sequence opt5 from anti-HIV-1_LightChain
cagagcgugcugacccaacccccuuccaugucugccgcuccgggccagaaggucacaaucagcugcuccgggucuacgagcauuaucggaaacaauuacauuuccugguaucagcagcuccccggcaccgccccuaaacugcuuaucuacgaggacaacaagagacccucugggauuccugaucgguucagcggauccaaaagcggcacaucugcgacccuggggaucacaggacuccaaaccggcgacgaagcugauuauuacuguggcacauggcacuccagccugucugccgggggaguuuuuggcaccgggacgaaggugacc

SEQ ID NO: 39674 - RNA, 333 nt, Artificial Sequence
  derived and/or modified sequence opt5 from anti-HIV-1_LightChain
cagagcgugcugacccaacccccuuccgucucugccgcuccgggccucaagguuacaaucagcugcuccgggaacacgucuaaugugggagacaacuucgugagcugguacagauaucugcccggcaccgccccuaaacuucuguccuacgaggaugacaagcggcccucugggauuccugaucgcuuuagcggauccaaaagcggcacaucugcgacccucgggaucacaggacugcagaccggcgacgaagcugauuauuacuguggcacaugggacuccagccuuucugccgggggagucuucggcaccgggacgaaggugaccguucug

SEQ ID NO: 39675 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcucuaauaccguuaacugguaccagcaguuccccgggacagcuccuaagcuccugaucuaugagaauaaccggcgccccagcggagugccugccagauuuuccggcagcaaaucugggaccuccgcgacacuugcuauuaccggacugcaaacaggcgacgaagccgauuacuauugugccaccugggacagcucucucuccgcuggcgggguguucggaacgggcaccaaggucacagugcug

SEQ ID NO: 39676 - RNA, 318 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagacccagcgggauuccugaccgguucuccggaagcaaaucuggcaccuccgcgacacuggggaucaccggacuccaaacaggcgaugaagcugacuauuacuguggcaccugggauaauagccugucuacagggggaguguuuggcaccgggacg

SEQ ID NO: 39677 - RNA, 288 nt, Artificial Sequence
  derived and/or modified sequence opt5 from anti-HIV-1_LightChain
ggccugagccccucccucugcucugggagcuccucuaacaucggaaauaacuacgugagcugguaucagcaacugccuggcaccgccccgaaacuucugauuuacgagaauacaaagagacccuccgggaucccugaccgguucucuggaagcaaguccggcacgagcgcuacccucgggauuacaggacugcagaccggcgaugaaggcgacuauuacugugggacaugggaucgcucucuuuccgccggaggcgucuuugggaccggaacaaaaguuaccgugcug

SEQ ID NO: 39678 - RNA, 333 nt, Artificial Sequence
  derived and/or modified sequence opt5 from anti-HIV-1_LightChain
caguucgugcugacccaacccccuagcgucuccgccgcuccgggccagagaguuacagugucuugcagcgggacgaccuccgacaucggagagaacuacgugucuugguaucagaaguuuagcgaagccgcgcccaaacuccugcuuuacgauaaugacaagcggccuuccggcauucccgaucgcuucucugggagcaaauccggaacaagcgcuacccugggcaucacagggcuccagaccggagacgaggccgauuauuacuguggcacaugggacucuucccugagcgccggcggggucuuuggaaccggcacgaaggugaccguucuu

SEQ ID NO: 39679 - RNA, 327 nt, Artificial Sequence
  derived and/or modified sequence opt5 from anti-HIV-1_LightChain
cagagcgugcugacccaacccccuuccgucucugccgcuccgggccagaagguuacaaucagcugcuccgggggaucuagcaacauuggcaauuacuauguguccugguaccuccagcugcccgggacggccccuaaacuucugaucuaugagaacaauaagagacccucuggcauuccugaccgguucagcggauccaaaagcgggaccucugcgacacucggaaucaccggccugcagacaggcgaugaagcugacuacuauugugggaccuggcacuccagccuuucugccggaggcguguuugggacaggaaccaaggucacg

SEQ ID NO: 39680 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggaacaugucuaauauuggagacaacgccgugagcugguacagacaggugcccgaggcgccuccccagcuccugaucuucggcaaugauaaacggccuuccggggucacggaccgcuuuucuggaagcaaguccggcaccagcgcuacacuugggauuaccggacugcaaacaggcgaugaagccgacuauuacuguggcaccugggauagaucucucuccgccgggggaguguucggcacagggaccaaaguuacggugcug

SEQ ID NO: 39681 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggauccucuagcaacauuggcgcuggguacgacgugcacugguaucuccagcugcccggaaccgccccucggcuucugaucuacgauaaugacaagcgccccuccggcauuccugauagauucucugggagcaaauccggaacaagcgcgacccucggcaucacaggccugcagaccggggacgaggcugauuauuacuguggaacauggcauucuucccuuagcgccggcgggguguuuggaaccggcacgaaggucaccgugcug

SEQ ID NO: 39682 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuacgagcaacauuggaaauaacuucguguccugguaccagcagcuccccggcaccgccccuaaacugcuguuuuaugacaauuacaagagacccucugggaucccugaucgguucagcggauccaaaagcggcacaucugcgacccuugcuauuacagggcuccaaaccggagacgaggccgauuauuacugugccacaugggacuccagccugucugcuggcggcguguuugggaccggaacgaaggucaccgugcuu

SEQ ID NO: 39683 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggaggcuccucuaacauuggggcuggauacgacgugcacugguaucagcaucuccccggcaccgccccucagcugcuuaucuacgagaauacaaagcggcccagcgggauuccugaucgcuucuccggaucuaaaagcggcaccuccgcgacacugggcaucaccgggcuccaaacaggagacgaagcugauuauuacuguggcaccugggacagaagccugucugccgggggaguguuuggcacggggaccaaggucacagugcuu

SEQ ID NO: 39684 - RNA, 333 nt, Artificial Sequence
  derived and/or modified sequence opt5 from anti-HIV-1_LightChain
cagagcgugcugacccaacccccuucccucucugccgcuccgggccagagagucacaguuagcugcuccgggucuagcuccaacaucggagacaauuacgugucuugguaucagcagcugcccggcgccgcgccucggcuucugauuuacgagaacaauaagcgccccagcgggaucccugauagauucuccggaagcaaaucuggcacguccgcuacccucgggauuacaggacugcaaaccggcgacgaagccgauuauuacuguggcacaugggacaacagccuuucuaccgggggaguguuuggcacagggaccaaggucacggugcug

SEQ ID NO: 39685 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggagaucuagcaacauuggaaauuacuucguguccugguaucagcaguuucccggcacggccccuaaacuccugaucuacgacaacaauaagcggcccucugggauuccugaucgcuucagcggauccaaaagcggcaccucugcgacacuugggaucaccggacugcaaacaggcgacgaggcugauuauuacuguggcaccugggacagaucccucagcgccgggggaguguuuggcacagggaccaaggucacggugcug

SEQ ID NO: 39686 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcucuaaugcuguucacugguuccggcagcuccccgggaccgccccuaagcugcuuaucuacgagaacaauaaacgccccagcggcauuccugacagauuuuccggaagcaagucugggacauccgcgacccugggaaucacaggccuccagaccggcgaugaagcugacuauuacugugccacaugggauagcucucuguccgccgggggaguguucggcaccgggacgaaagugaccguccuu

SEQ ID NO: 39687 - RNA, 333 nt, Artificial Sequence
  derived and/or modified sequence opt5 from anti-HIV-1_LightChain
cagagcgugcugacccaacccccuuccgucucugccgcuagcggccagaagguuacaaucuccugcucugggagcuccucuaacauuggaaauaacuacgugagcugguaucaccagcucccgggcacggcccccaaacugcuuaucuacgacaccaauaagagaccuuccgggauucccgaucgguucagcggaucuacauccggcaccagcgcgacacuggggaucaccggacuccagacaggcgacgaggcugauuauuacuguggcaccugggacaacucucuguccaccgggggaguguuuggcacggggacaaaagucaccgugcuu

SEQ ID NO: 39688 - RNA, 333 nt, Artificial Sequence
  derived and/or modified sequence opt5 from anti-HIV-1_LightChain
cagcccgugcugacccaaccuccgagcgucuccgccgcucccggccagacaguuacgaucucuugcagcggguccuucucuaacauugagaccaauuacgugagcugguaucagcagcucccuggaacagcccccaagcugcuuaucuacgacaacaauaugagaccuuccggcauucccgaucgguuuucugggagcaaauccggaaccagcgcgacacugggcaucaccgggcuccaaacaggagacgaagcugauuauuacuguggcaccugggacacgucucuguccgccggcgggguguucggaaccggcacaaaggucaccgugcuu

SEQ ID NO: 39689 - RNA, 336 nt, Artificial Sequence
  derived and/or modified sequence opt5 from anti-HIV-1_LightChain
cagcccgugcugacccaaccuccgagcgucuccggcgcccccgggcagagaguuacaaucucuugcacgggaagcuccucuaacauuggcgcuggguacgacgugcacugguaucagcagcucccuggaaccgcccccaagcugcuuaucuacgagaauaacaaacggccuagcggcauucccgaucgcuucuccgggucuaagagcggaacauccgcgacccugggcaucacaggccuccaaaccggggacgaagcugauuauuacuguggaacaugggacaauagccugucuaccggcgggguguuuggaacgggcaccaaagucacagugcuu

SEQ ID NO: 39690 - RNA, 333 nt, Artificial Sequence
  derived and/or modified sequence opt5 from anti-HIV-1_LightChain
cagagcgugcugacccaacccccuucccucucugccgcuccgggccagagaaucacaauuagcugcuccgggucuagcuccaacaucggaaauaacuacgucucuugguaucagcaguuccccggcacggccccuaagcugcuuauuuacgagaauaacaaacggcccagcgggaucccugaccgcuuuuccgcgagcaagucuggaaccuccgcuacacugggcauuaccgggcuccaaacaggagaugaagccaauuauuacuguggcaccuggcacagcucucuguccgccggcgggguuuucggaacaggcaccaaagugacggugcuu

SEQ ID NO: 39691 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuucgggucccgguuuaacgugggaacgucuagcguguccugguaccagcagcuccccggcaccgccccuaagcugcuuauugacgcgaauggggagcgccccucuggaaucccugauagauucagcggcuccaaaagcgggacaucugcuacccugggaauuacaggccuccaaaccggcgacgaagccgauuauuacugugggacaugggacuccagccugucugccggaggcgucuuugggaccggaacgaaggugaccguucuu

SEQ ID NO: 39692 - RNA, 333 nt, Artificial Sequence
  derived and/or modified sequence opt5 from anti-HIV-1_LightChain
cagagcgugcugacccaacccccuuccgucucugccacaccgggccagaagguuacgaucagcugcuccgggucuagaagcaacauuggaucccacuacgugucuugguaucagcaguuccccggcaccgcuccuaaacuccugaucuacgacaauaacaagcggcccagcgggauuccugaucgcuuuuccggaagcaaaucuggcacauccgccacccuugggaucacaggacugcaaaccggcgacgaggcggauuauuacuguggcacauggcauagcucucucuccgcugggggaguguucggcaccgggacgaaggucaccgugcug

SEQ ID NO: 39693 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcucuaaucacguuuacugguaucagcagcuccccgggaagaccccuaaacugcuuaucuaccggaacaaucaacgccccagcggcauuccugacagauucuccggaagcaagucugggacauccgcuacccugggaaucacaggccuccagaccggcgaugaggccgacuauuacugugggacaugggauagcucucuguccaccggaggcguguuugggacgggaaccaaagugacaguccuu

SEQ ID NO: 39694 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcgccaacauuggaaauaacuacguguccugguaucagcaguuccccggcacggggccuagacucaucauuuacgagucuaauaaacggcccagcggaaucuccgaccgcuuuagcggcucucaauccgaugcggcugccacccuggacauuacagggcuucagaccggagaugaagccgacuauuacuguggcacaugggauagcucucuguccgcuggcgggguguucggaaccggcacaagagucaccgugcuc

SEQ ID NO: 39695 - RNA, 336 nt, Artificial Sequence
  derived and/or modified sequence opt5 from anti-HIV-1_LightChain
cagagcgugcugacccaacccccuuccgucucuggcgccccggggcagacaguuacgaucagcugcaccggagacacauccaacauuggcgcugauuacagagugcacugguaucagcagcuccccgggaccgccccuaagcugcuuaucuacgagaauaacaaacggcccucuggcauuccugaccgcuucagcggauccaagucugggacaagcgcgacccugggaaucacaggccuccaaaccggcgaugaagcugacuauuacugugggacgugggauaauucccugagcaccggaggcguguuugggacaggaaccaaagucacagugcuu

SEQ ID NO: 39696 - RNA, 333 nt, Artificial Sequence
  derived and/or modified sequence opt5 from anti-HIV-1_LightChain
cagagcgugcugacccaacccccuucccucucugccgcuccgggccagagagucacaguuagcugcuccgggucuagcuccaacaucggaaauaacuacgugucuugguaucagcagcugcccggcgccgcgccuaaacuucugauuuacaauaacaauauccggcccagcgggauuccugagcgcuucuccggaagcaagucuggcacguccgcuacccucgggaucacaggacugcaaaccggcgacgaaggcgauuauuacugugggacaugggacagaagccuuucugccggaggcguguuugggaccggaacaaaggucaccgugcug

SEQ ID NO: 39697 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcgggaauuacguuucuugguaucagcagcuccccggaaccgcuccuaagcugcuuaucagcgagaacaauaaacggcccuccggcauuccugaccgcuucagcgggucuaaguccggaacaagcgccacccugggcaucacaggccuccaaaccggggaugaagcggacuacuauuguggaacaugggauucuucccugagcgcuggcgggguguuuggaaccggcacgaaagugaccguccuu

SEQ ID NO: 39698 - RNA, 333 nt, Artificial Sequence
  derived and/or modified sequence opt5 from anti-HIV-1_LightChain
cagagccugcucacccaacccccuuccgugucugccgcuccgggccagaaggucacaaucagcugcuccgggucuagcuccaacauuggaaauaacuucguuucuugguaccagcagcugcccggcacggccccuaaacuucugaucuaugagaauaacaugagacccagcgggauuccugaccgguuuuccggaagcaagucuggcaccuccgcgacacucgggaucaccggacugcaaacaggcgaugaagcugacuacuauuguggcaccugggauagcucucuuuccgccgggggaguguucggcacagggaccaaagugacgguccug

SEQ ID NO: 39699 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggacgucuagcaacauugccaauuacuauguguccugguacagacagcuccccggaaccgcgccuaaacugcuuaucuaugagaacaauaagcggcccucuggcauuccugaccgcuucagcggguccaaaagcggaacaucugcuacccugggcaucacagggcuccagaccggagaugaagccgacuacuauuguggcacaugggauuccagccugucugccggcgggguguuuggaaccggcacgaaggucaccgugcuu

SEQ ID NO: 39700 - RNA, 333 nt, Artificial Sequence
  derived and/or modified sequence opt5 from anti-HIV-1_LightChain
cagcccgugcugacccaaccuccgagcgucuccggcgcccccgggcagagaguuacaaucucuugcagcggauccucuagcaacauuggcaauaacgacguguccugguaccaacaggugccugggacggcucccaagcuccugaucuaugagaauaacaaacggccuucuggcauucccgaucgcuucagcggauccaagagcgggaccucugccacacuuggaaucaccggccugcagacaggcgacgaagcggauuacuauugugggaccugggacacaucccucagcgcuggaggcgucuuugggaccggaacgaaagugaccguucug

SEQ ID NO: 39701 - RNA, 333 nt, Artificial Sequence
  derived and/or modified sequence opt5 from anti-HIV-1_LightChain
cagcuggugcucacccaacccccuagcgucuccgccgcuccgggccagagaguuacaaucucuugcuucgggagccgguuuaacgugggaacguccucugugagcugguaccagcagcugcccggcaccgccccuaaacuucugauugacgcgaauggggagcgccccuccggaaucccugauagauucuuuggcucugaaagcgggacauccgcuacccucggaauuacaggccugcaaaccggcgacgaggccgauuauuacugugggacauggcacagcucucuuuccgccggaggcgucuucgggaccggaacgaaggugaccguucug

SEQ ID NO: 39702 - RNA, 333 nt, Artificial Sequence
  derived and/or modified sequence opt5 from anti-HIV-1_LightChain
agcuacgagcugacccagcccccuuccgugucugccgcuccgggccaaaaggucacaaucagcugcuccgggucuagcuccaacauuggaaauaacuauguuucuugguaccagcagcuccccggcacggccccuaaacugcuuaucuaugaaaauaacaagagacccagcgggauuccugaccgguucuccggaagcaaaucuggcaccuccgcgacacuggggaucaccggacuccagacaggcgaugaggcugacuacuauuguggcaccugggauacaagccugucugccgggggaguguuuggcaccgggacgaaggugaccguccuu

SEQ ID NO: 39703 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuaccagcaacauuggcacauacuauguuuccugguaccagcagcuccccgggaccgcuccuaagcugcuuaucuaugagaauacaaaacggcccucuggcauuccugaccgcuucagcggauccaagagcgggaccucugccacacugggaaucaccggccuccaaacgggcgaugaaggggacuacuauuguggaaccugggauagaucccugagcgcgggcgggguguuuggaacaggcaccaaagugacaguccuu

SEQ ID NO: 39704 - RNA, 336 nt, Artificial Sequence
  derived and/or modified sequence opt5 from anti-HIV-1_LightChain
cagagcgcccugacccaacccgcuuccgugucugccagcccuggccaguccaucgcgauuucuugcacagggacgagcuccgacgucggaucuuacaacuauguuagcugguaccagcagcucccgggcaccgcucccaagcugcuuaucuaugagaauacaaaaagaccuuccgggauucccgaucgguucagcggaucuaaguccggcaccagcgccacacuggggaucaccggacuccaaacaggcgacgaagccgauuacuauuguggcaccugggaccgcucucuguccgcugggggaguguuuggcacggggaccaaagugacaguccuu

SEQ ID NO: 39705 - RNA, 330 nt, Artificial Sequence
  derived and/or modified sequence opt5 from anti-HIV-1_LightChain
cagagcgugcugacccaacccccuuccgucucugccgcuccgggccagagaguuacaaucagcugcuccgggggaucuagcaacauuggcaauaaccacguguccugguaccagcaucuccccgggcgggccccucagcugcuuaucuaugacacgacccaacgccccucuggcauuccugauagauucagcggauccaagagcgggacaucugcgacccugggaaucacaggccuccagaccggcgacgaggcugauuacuauugugggacaugggacuccagccugucuaccggaggcguguuugggacgggaaccaaagucacagug

SEQ ID NO: 39706 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcucuaaguacguuuguugguaucagcagcuccccgggaccgcuccuaaacugcuuaucuaccggaauaaccaacgccccagcggcauuccugacagauucuccggaagcaagucugggacauccgccacccugggaaucacaggccuccagaccggcgaugaggcggacuauuacugcgggacauggcacagcucucuguccgcuggaggcguguuugggaccggaacgaaagugaccguccuu

SEQ ID NO: 39707 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccggggacucuagcacguucgagaacgauuacguguguugguaucagcagcuccccggaaccgccccuaaacugcuuauuuacgacaauaacaagagacccuccggcaucccugaucgguuuucugggagcaaauccggaacaagcgcgacccugggcauuacagggcuccaaaccggagacgaagcugauuauuacugcggcacauggcacucuucccugagcgccggcgggguguucggaaccggcacgaaggucaccgugcuu

SEQ ID NO: 39708 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgggaauagcaacagacccuccggagugccugaccgguucagcggcucuaaguccgggaccagcgcgucucuggcuauuacaggacuccaagccgaggaugaagccgacuauuacuguggcaccugggauuccagccugucugcuggcggggucuuuggaacaggcaccaaagugacaguucuu

SEQ ID NO: 39709 - RNA, 333 nt, Artificial Sequence
  derived and/or modified sequence opt5 from anti-HIV-1_LightChain
cagagcgugcugacccaacccccuuccgucucugccgcuccgggccagacaguuacgaucagcugcuccgggucuagcuccaacauuggaucuaauaccgugaacugguaccagcagcuccccggcacagccccuaagcugcuuaucuaugagaauaacaaaagacccagcgggauuccugaccgguucuccggaagcaagucuggcaccuccgcgacacuggggaucaccggacuccaaacaggcgaugaagcugacuacuauuguggcaccugggauaauagccugucuaccgggggaguguuuggcacggggacaaaagucaccgugcuu

SEQ ID NO: 39710 - RNA, 336 nt, Artificial Sequence
  derived and/or modified sequence opt5 from anti-HIV-1_LightChain
cagagcgugcugacccaacccccuuccgucucuggcgccccggggcagagaguuacaaucuucugcacgggaagcuccucuaacgugggcgggggauacgacgugcacugguaucagcagcuccccggcaccgcuccuaagcugcuuauuuacgagaauaacaaacggcccagcgggaucccugaucgcuuuuccggaucuaagagcggcacauccgccacccugggcauuacagggcuccaaaccggagacgaagcggauuauuacuguggcacaugggacagcucucuguccgcugggggagucuucggcaccgggacgaaagugaccguucuu

SEQ ID NO: 39711 - RNA, 333 nt, Artificial Sequence
  derived and/or modified sequence opt5 from anti-HIV-1_LightChain
cagagcgugcugacccaacccccuuccgucucugccgcuccgggccagaagguuacacucagcugcuccgggucuagcuccaacaucggaaauaacucugugagcugguaccagcaguuccccggcacggccccuaaacugcuuauuuaugacuccgauaagagacccagcgggaucccugaccgguuuucuggauccaaaagcggcaccucugcgacacuggggauuaccggacuccaaacaggcgaugagggcgacuacuauugugggaccugggaucgcucccugagcgcuggaggcguguucgggacaggaaccaaggucacggugcuu

SEQ ID NO: 39712 - RNA, 333 nt, Artificial Sequence
  derived and/or modified sequence opt5 from anti-HIV-1_LightChain
cagagcgugcugacccaacccccuuccgccucuggcacaccggggcagaaggucacgaucagcugcuccggaucuagcucccagauuggcucuaacagcguuuacugguaucagcaacuccccgggaccacaccuaaacugcuuaucuacggaaauaaccagagacccuccggcauuccugaccgguucagcgggucuaaguccggaaccagcgcuacacugggcaucaccggccuccagacaggggaugaggccgacuauuacuguggaaccugggauucuucccugagcgcgggcgggguguuuggaacgggcaccaaagugacaguccuu

SEQ ID NO: 39713 - RNA, 336 nt, Artificial Sequence
  derived and/or modified sequence opt5 from anti-HIV-1_LightChain
cagagcgcccugacccaacccgcuuccgugucuggcagcccugggcaguccaucacaauuucuugcacgggaaccggcagcgacgucgggggauacaaccacguuuccugguaucagcagcauccgggcaaggcccccaaacuccugaucuacgauaauaacaagagaccuucugggauucccgaccgguucagcggauccaaaagcggcacaucugcgacccuuggcaucacagggcugcaaaccggagaugaggcugacuauuacuguggcacauggcacuccagccucucugccgggggaguguuuggcaccgggacgaaggugaccguccug

SEQ ID NO: 39714 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuccgggucuggaagcaacauuggcgaccgguucguguccugguaccagcaccuccccgggacggugccuaagcugcuuaucuaugauaaugagcaucgccccucuggcauuccugacagauuuagcggauccaaaagcgggaccucugccacacugggaaucaccggccuccagacaggcgaugaagcggacuacuauugugggaccugggauuccagccugucugcuggaggcgucuucgggacaggaaccaaggugacgguucuu

SEQ ID NO: 39715 - RNA, 333 nt, Artificial Sequence
  derived and/or modified sequence opt5 from anti-HIV-1_LightChain
cagagcgugcugacccaacccccuuccgucucugccgcuccgggccagaagaucacaauuagcugcuccgggucuagcuccaacaucggaaaaucuguugugagcugguacagacaguuccccggcacggccccuaagcuccugauuuaugacaccuacaaacggcccuccgggaucccugaucgcuuuagcggaucuaaguccggcacaagcgcgacccuugggauuacaggacugcagaccggcgacgaggcugauuauuacuguggcacauggcacucuucccucagcgccgggggaguguucggcaccgggacgaaagucaccgugcug

SEQ ID NO: 39716 - RNA, 333 nt, Artificial Sequence
  derived and/or modified sequence opt5 from anti-HIV-1_LightChain
cagcccgugcugacccaaccuccgagcgccuccggcacacccgggcagagagucacgaucucuugcagcggauccucuagcaacauuggcgggaauaccguuaacugguaccagcaguucccuggagcugcgccccggcuccugaucuaugaggacaauaagcgcccuuccggcauucccgauagauuuucugggagcaaauccggaacaagcgccacccuuggcaucacaggccugcaaaccggggacgaagcugauuacuauuguggaacaugggacucuucccucagcgccggcgggguguucggaaccggcacgaaggugaccguccug

SEQ ID NO: 39717 - RNA, 333 nt, Artificial Sequence
  derived and/or modified sequence opt5 from anti-HIV-1_LightChain
aacuucaugcugacccagccccacagcguguccgagucuccuggcaagacagucacgaucagcugcaccagauccucugggagcguugccuccaauuacgugcaaugguaucagcagcucccgggaacagcucccaaacugcuuauuuacgaaaacaauaagcggccuucuggcauccccgaccgcuuuagcggguccaaaagcggaaccucugccacacugggcauuaccgggcuccagacaggagaugaggcggacuauuacuguggcaccuggcauuccagccugucugcuggcgggguguucggaacgggcaccaaggucacagugcuu

SEQ ID NO: 39718 - RNA, 333 nt, Artificial Sequence
  derived and/or modified sequence opt5 from anti-HIV-1_LightChain
cagagcaugcugacccaacccccuuccgugucugccgcuccgggccagagagucacaguuagcugcuccgggucuagcuccaacaucggaucucacuucgugagcugguaccagcagcuccccggcacggccccuaagcugcuuauuuaugacaauuccaaccggcccagcgcgaucccugaucgcuuuucuggguccaaaagcggaaccucugcuacacugggcauuuccgggcuccauaccggagacgaggccgauuacuauugugccacaugggacaauagccugucuaccggcggcguguucgggacaggaaccaaggucacggugcuu

SEQ ID NO: 39719 - RNA, 333 nt, Artificial Sequence
  derived and/or modified sequence opt5 from anti-HIV-1_LightChain
cagagcgugcugacccaacccccuuccgucucugccgcuccgggccagaagguuaucauuagcugcuccgggggaucuagcaacaucggcaauaacuucguguccugguaccaccagcuccccgggacagccccuaaacugcuuauuuaugagaauacgaagagacccucuaaaaucccugcgcgguuuagcggauccaagagcggcaccucugcuacacuggggauuaccggacuccagacaggcgacgaagccgauuacuauuguggcaccugggacuccagccugucugccgggggaguguucggcacagggaccaaagucacggugcuu

SEQ ID NO: 39720 - RNA, 315 nt, Artificial Sequence
  derived and/or modified sequence opt5 from anti-HIV-1_LightChain
cagagccugcucacccaacccccuuccgugucugccgcuccgggccagaaggucacaaucagcugcuccgggucuagcuccaacauuggaaauaacuacguuucuugguaucagcagcugcccggcacggccccuaaacuucugaucuacgagaauaacaagagacccagcgggauuccugaccgguucuccggaagcaaaucuggcaccuccgcgacacucgggaucaccggacugcaaacaggcgaugaagcugacuauuacuguggcaccugggauagcucucuuuccgccgggggaguguuuggcacaggg

SEQ ID NO: 39721 - RNA, 336 nt, Artificial Sequence
  derived and/or modified sequence opt5 from anti-HIV-1_LightChain
cagagcgcccugacccaacccgcuuccgugucuggcagcccugggcaguccaucacaauuucuugcacgggaaccagcuccgacaucggcucuuacagcuucgucuccugguaucagcagcacccggggaaggcccccaaacucauuaucuacgauguuaacaagagaccuagcggcauucccgaccgguuuucuggauccaaaagcgggacaucugcgacccugggaaucacaggccuucaaaccggcgaugaggcugacuauuacugugggacaugggaucgcucccugagcgccggaggcguguucgggaccggaacgaaggugaccguccuc

SEQ ID NO: 39722 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggaaacuccucuaauauuggcgcuggguucgacgugcacugguaccggcaucuccccggaaccgccccuaagcugcuuaucuaugagaacacaaaacgccccagcggcauuccugauagauuuuccgggucuaagagcggaaccuccgcgacacugggcaucaccggccuccagacaggggacgaagcugauuacuauuguggaaccugggaccggagccugucugccggcgggguguucggaacgggcaccaaagucacagugcuu

SEQ ID NO: 39723 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggggaucuagcaacauuggcaauuacuauguguccugguaccuccagcugcccggggccgcgccuaaacuucugaucuaugacacggauaagagacccucuggcauuccugaccgguucagcggauccaaaagcgggaccucugcuacacucggaaucaccggccugcagacaggcgaugaggccgacuacuauugugggaccugggaucgcucccuuagcgccggaggcguguuugggacaggaaccaaggucacggugcug

SEQ ID NO: 39724 - RNA, 333 nt, Artificial Sequence
  derived and/or modified sequence opt5 from anti-HIV-1_LightChain
cagagcgugcugaccagacccccuuccgucucugccgcuccgggccaaaagguuacaaucagcugcuccgggcggucuagcaacauuggaaauaacuacguguccugguaucagcagcuccccggcgccgcgccuaaacugcuuaucuacgagaauaacaagcgccccucugggauuccugacagauucagcggauccaaaagcggcacgucugcuacccuggggaucacaggacuccagaccggcgaugaagccgacuauuacuguggcacaugggauuccagccugucugccgggggaguguuuggcaccgggacaaaggucaccgugcuu

SEQ ID NO: 39725 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggacgauuucuaacaucggagccaaucucgugagcugguacagacagcugcccggcaccgugccuacaguccuuauucacgagaacaauaaacggcccuccgggaucccugaccgcuucucuggaagcaaguccggcaccagcgcgacacuggggauuaccggacuccagacaggcgaugaagcugacuauuacuguggcaccuggcauucuucccugagcgccgggggaguguuuggcacggggaccaaaguuacagugcuu

SEQ ID NO: 39726 - RNA, 327 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuucgugucuugguaccagcagcuccccggcacggccccuaaacugcuuaucuaugagaauaccaagagacccagcgggauuccugaccgguuuuccggaagcaaaucuggcacauccgcgacccuggggaucacaggacuccaaaccggcgaugaagcugacuacuauuguggcacaugggaucgcagccugucugccgggggaguguucggcaccgggacgaaggucacc

SEQ ID NO: 39727 - RNA, 333 nt, Artificial Sequence
  derived and/or modified sequence opt5 from anti-HIV-1_LightChain
cagagcgugcugacccaaucccccucugucagcgccgcuccuggccagagaguuacaaucuccugcucugggggaagcuccaacauuggcucuaaugccgugagcugguaccagcagcucccggggacggcgcccaagcugcuuaucuauggagacaccaugcggccuuccggcauucccgaucgcuucagcgggucuaaauccggaacaagcgcuacccugggcaucacaggccuccaaaccggggacgaggccgauuacuauuguggaacaugggacagaucucuguccgccggcgggguguuuggaaccggcacgaaggucaccgugcuu

SEQ ID NO: 39728 - RNA, 333 nt, Artificial Sequence
  derived and/or modified sequence opt5 from anti-HIV-1_LightChain
cagagcgugcugacccaacccccuuccgucucugccgcuccgggccagcagguuacaaucagcugcuccgggacgaccucuaacauuggaacaaauuacgugagcugguaucagcaaaugcccccugccgcgcccaagcuccugaucuacgacaacaaaaagagaccuuccgauauucccgaccgguucucuggcagcaaauccgggaccagcgcuacacuuggaaucaccggccugcagacaggggaugaggccgacuauuacuguggaaccugggaucgcucucucuccgccggcggcguguuugggacgggaaccaaggucacagugcug

SEQ ID NO: 39729 - RNA, 333 nt, Artificial Sequence
  derived and/or modified sequence opt5 from anti-HIV-1_LightChain
cagagcguggucacccaaucccccucugccagcggcacaccugggcagagaguuaucauuuccugcucuggaagcuccucuaacaucggcaauauuuacgugagcugguaucagcagcugccggggacggcucccaagcuccugaucuacgagaacaauaaacggccuuccggcauucccgaccgcuucagcggaucuaaguccgggaccagcgccacacuuggaaucaccggccugcaaacaggcgaugaagcggacuauuacugugggaccuggcacucuucccucagcgcuggaggcguguuugggacaggaaccaaagucacggugcug

SEQ ID NO: 39730 - RNA, 333 nt, Artificial Sequence
  derived and/or modified sequence opt5 from anti-HIV-1_LightChain
cagagcgugcugacccaacccccuuccaugucugccgcuccgggccagaaggucacaaucagcugcuccgggucuacgagcauuaucggaaacaauuacauuuccugguaucagcagcuccccggcaccgccccuaaacugcuuaucuacgaggacaacaagagacccucugggauuccugaucgguucagcggauccaaaagcggcacaucugcgacccuggggaucacaggacuccaaaccggcgacgaagcugauuauuacuguggcacaugggaccgcucccugagcgccgggggaguuuuuggcaccgggacgaaggugaccgugcuu

SEQ ID NO: 39731 - RNA, 336 nt, Artificial Sequence
  derived and/or modified sequence opt5 from anti-HIV-1_LightChain
cagagcgcccugacccaacccccuuccgcuucuggcagcagagggcaguccgugaucauuucuugcacaggaacgagcuccgacgucggcguuuacaaccucgugucuugguaucagcagcugccggggaccgcccccaaacuucugaucuacgagaauaacaagcggccuagcggcauucccgaucgcuucuccggaagcaagucugggacauccgcgacccucggaaucacaggccugcaaaccggcgacgaagcugauuauuacugugggacauggcacagcucucuuuccgccggaggcguguuugggaccggaacgaaagucaccgugcug

SEQ ID NO: 39732 - RNA, 333 nt, Artificial Sequence
  derived and/or modified sequence opt5 from anti-HIV-1_LightChain
cagagcgugcugacccaacccccuuccaugucugccgcuccgggccagagcgucuccaucucuugcagcggguccucugacaacauugagagaaaucagguuaucuggcuccgccaggugcccggagccgcgccuacagugcugauuaucuucaacaaucggagacccagcggcgucccugaucgguuuuccgggagccgcucuggaacguccgcuacccuuggcauuacagggcugcaaaccggagacgaagccgauuacuauuguggcacaugggacagaagccucucugccggcgggguguucggaaccggcacaaagguuaccgugcug

SEQ ID NO: 39733 - RNA, 333 nt, Artificial Sequence
  derived and/or modified sequence opt5 from anti-HIV-1_LightChain
cagagcgugcugacccaacccccuuccgucucugccgcuccgggccagacaguuacgaucagcugcuccgggucuuucagcaacauugagaccaauuacguguccugguaucagcagcuccccggaacagccccuaagcugcuuaucuacgaaaacaccaaaagacccucuggcauuccugaccgguuuagcggguccaagagcggaacaucugcgacccugggcaucacagggcuccaaaccggagaugaggcugacuauuacuguggcacgugggaucgcucccugagcgccggcgggguguucggaaccggcacaaaagucaccgugcuu

SEQ ID NO: 39734 - RNA, 333 nt, Artificial Sequence
  derived and/or modified sequence opt5 from anti-HIV-1_LightChain
cagagccugcucacccaacccccuuccgugucugccgcuccgggccagaaggucacaaucagcugcuccgggucuagcuccaacauuggaucuaaauacguuuguugguaucagcagcugcccggcacggccccuaaacuucugaucuacgagaauaccaagagacccagcgggauuccugaccgguucuccggaagcaagucuggcacauccgcgacccucgggaucacaggacugcaaaccggcgaugaagcugacuauuacugcggcacaugggaucgcagccuuucugccgggggaguguuuggcaccgggacgaaagugaccguccug

SEQ ID NO: 39735 - RNA, 336 nt, Artificial Sequence
  derived and/or modified sequence opt5 from anti-HIV-1_LightChain
cagagcgcccugacccaacccagauccgugucuggcagcccugggcaguccgucacaaucucuugcacgggaaccacaagcgacguuggcggguacaacuauguguccugguaccagcagcucccgggaaccgcucccaagcugcuuauuuaugagaauaacaaacggccuucuggcauccccgaucgcuucagcggguccaagagcggaacaucugccacccugggcauuacaggccuccaaaccggggacgaagcggauuacuauuguggaacgugggacaauucccugagcaccggcgggguguuuggaacaggcaccaaagucacagugcuu

SEQ ID NO: 39736 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcacgggguucaccuccaacauuggacucaauuacgugucuugguaucaacaggugcccggcacaaccccuaagcuggucaucuuugagaacgaccggcgcuuccuugggauucccgauagauuuagcggauccaaaucuggcgccagcgcgacacuggggaucaccggacuccagacaggcgacgaagcugauuacuauuguggcaccugggacuccagccugucugccgggggaguguucggcacggggaccaagguuacagugcuu

SEQ ID NO: 39737 - RNA, 333 nt, Artificial Sequence
  derived and/or modified sequence opt5 from anti-HIV-1_LightChain
cagagcgugcuggcccaacccccuuccgucucugcugccccgggccagaagguuaccaucagcugcuccgggagaacaucuaacauuggaaauaacuacgugagcugguaucagcagcuccccggcacggcgccuaaacugcuuaucuacgagaauaacaagcggcccuccgggauuccugaccgcuucucuggaagcaaauccggcaccagcgcuacacuggggaucaccggacuccaaacaggcgaugaagccgacuauuacuguggcaccugggauacaucucuguccgccgggggaguguuuggcaccgggacgaaggucaccgugcuu

SEQ ID NO: 39738 - RNA, 333 nt, Artificial Sequence
  derived and/or modified sequence opt5 from anti-HIV-1_LightChain
cagagcgugcugacccaacccacauccgucucugccgcuccuggcagauggguuacggugagcugcuccgggacccggucuaacaucggagaccacagcguguccugguuccagcaucucccgggcgccgcgcccaagcugcuuauuuacgagaauaacaaacgcccuucugggauccccgauagauuuagcggauccaagagcggcacaucugcuacccuggggauuacaggacuccagaccggcgacgaagccgauuauuacuguggcacaugggacuccagccugucuaccgggggagucuucggcacggggaccaaagugacaguucuu

SEQ ID NO: 39739 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggagacaauuacgugucuugguaucagcaguuccccggcacggccccuaaacuccugaucagcgagaacaauaagagacccuccgggauuccugaucgguuuagcggaucuaaauccggcaccagcgcgacacuugggaucaccggacugcaaacaggcgacgaagcugauuacuauuguggcaccugggacucuucccucagcgccgggggaguguucggcacagggaccaaggucacggugcug

SEQ ID NO: 39740 - RNA, 333 nt, Artificial Sequence
  derived and/or modified sequence opt5 from anti-HIV-1_LightChain
caggcccugcucacccaacccccuagcguguccgcugccccgggccagaaggucacaaucucuugcagcggguccucuagcaacauuggaaauaacuacguuuccugguaucagcagcugcccggcacggcgccuaaacuucugaucucugagaauaacaagagacccagcgggauuccugaccgguucuccggaagcaaaucuggcaccuccgcuacacucgggaucaccggacugcaaacaggcgaugaagccgacuacuauuguggcaccugggauacaagccuuucugccgggggaguguuuggcaccgggacgaaggugaccguccug

SEQ ID NO: 39741 - RNA, 333 nt, Artificial Sequence
  derived and/or modified sequence opt5 from anti-HIV-1_LightChain
cagcuggugcucacccaacccccuagcgccuccggcacaccggggcagagagucacgaucucuugcagcggauccaccucuaacauuggcacauacuauguuuacugguaucagcugcuucccgggaccacaccuaaggugcugaucuacgcuaaugaccagcggcccagcggcauuccugaucgcuucuccggaucuaaaagcgggaccuccgccacacucggaaucaccggccugcaaacgggcgacgaggcggauuauuacugugggaccugggacagcucucuuuccacaggaggcguguuugggaccggaacaaaggucaccgugcug

SEQ ID NO: 39742 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggacgucuagcaacauuggaaauaacuucguguccugguaccagagacuccccggcaccgccccuaaacugcuuaucuuugagaaugacaagcggcccucugggauuccugaucgcuucagcggauccaaaagcggcacaucugcgacccuggggaucacaggacuccagaccggcgacgaagcugauuauuacuguggcacaugggacagaucccugagcgccgggggaguguuuggcaccgggacgaaggucaccgugcuu

SEQ ID NO: 39743 - RNA, 333 nt, Artificial Sequence
  derived and/or modified sequence opt5 from anti-HIV-1_LightChain
cagagcgugcugacccaaucccccucugucagcgccacaccuggccagagaguuacgaucuccugcucugggaacaccagcaauauuggaaagaacuucguguccugguaccagcaguuuccgggcacagcucccaaacuccugaucuaugacaaugauaagcggccuucugggauucccgaccgcuucagcggauccaaaagcggcaccucugccacacuugggaucaccggacugcaaacaggcgaugaggcggacuacuauuguggcaccugggauuccagccucucugcugggggaguguuuggcacggggaccaaggucacagugcug

SEQ ID NO: 39744 - RNA, 333 nt, Artificial Sequence
  derived and/or modified sequence opt5 from anti-HIV-1_LightChain
cagagcgugcugacccaacccccuuccgucucugccgcuccgggcagagagguuaucauuagcugcuccgggucuagcuccaacaucggaaauaaccacgugucuugguaccagcagcuccccggcacagccccuaaggugcugauuuaugaaagcaauaaacggcauuccgggauccccgaccgcuucagcggaucuaaguccggcacgagcgcgacccuugcuauuacagggcugcagaccggagaugaggccgacuacuauuguggcgccugggauucuucccucagcgcuggcggggucuuuggaacaggcaccaaagugacaguucug

SEQ ID NO: 39745 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcgacucuaccguuaauugguaccagcagcuccccgggacagcuccuaagcugcuuaucuaugagaacaccaaacggcccagcggcauuccugaucgcuucuccggaagcaagucugggacauccgccacccugggaaucacaggccuccaaaccggcgacgaagcggauuacuauugugggacgugggacagaagccugucugcuggaggcguguuugggaccggaacaaaagugaccguccuu

SEQ ID NO: 39746 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuacgagcaacauuggaaauaacuacguguccugguaucagcagcuccccggcaccgccccuaaacugcuuaucuacgagaauaacagacaacccucugggauuccugaccgguucagcggauccaagagcggcacaucugcgacccuggggaucacaggacuccagaccggcgaugaaggcgacuauuacugugggacaugggaucgcucccugagcgcuggaggcguguuugggaccggaacgaaagucaccgugcuu

SEQ ID NO: 39747 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaucuaauuacgugagcugguaucagcagcuccccggcacggccccuaaacugcuuaucuacgagaacaauaagagacccuccgggauuccugaccgguucagcggaucuaaauccggcaccagcgcgacacuggggaucaccggacuccaaacaggcgaugaagcuguguauuacuguggcaccugggacucuucccugacagccgggggagucuuuggcagcgggaccaaggugacgguucuu

SEQ ID NO: 39748 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcauuggauccucuagcaacaucggcgcugacuaccgggugcacugguaucagcagcuccccgggacggccccuaagcugcuuauuuacgagaauaacaaacgccccuccggaaucccugauagauucucuggcagcaaguccgggaccagcgcgacacugggaauuaccggccuccaaacaggcgacgaagcugauuauuacugugggaccugggacucuucccugagcacaggaggcguguuugggaccggaacgaaagucaccgugcuu

SEQ ID NO: 39749 - RNA, 336 nt, Artificial Sequence
  derived and/or modified sequence opt5 from anti-HIV-1_LightChain
cagagcgugcugacccaacccccuuccgucucuggcgccccggggcagagaaucacaguuagcugcacgggaaccuccucuaacauuggcgcucccuacgacgugaauugguaucagcagcucccugggacagcccccaagcugcuuaucuacgagaacaccaaacggccuagcggcauucccgaucgcuucuccggaucuaagagcgggacauccgcgacccugggaaucacaggccuccaaaccggcgacgaagcugauuauuacugugggacgugggacagaagccugucugccggaggcguguuugggaccggaacaaaagucaccgugcuu

SEQ ID NO: 39750 - RNA, 333 nt, Artificial Sequence
  derived and/or modified sequence opt5 from anti-HIV-1_LightChain
cagagcgugcugacccaacccccugccauguccgcugccccgggccagucugucacaaucagcugcuccgggucugcguucaacauugagagacaccagguuacguggcuccggcaucugcccggaaccgcuccuacaagcgugaucauuaugaauaaccagcgccccuccggcgugccugacagauuuucugggagccgguccggaaccagcgccacacuuggcaucaccgggcugcaaacaggagaugaaggcgacuacuauuguggcaccugggaucgcucucucuccgccgggggagucuucggcacggggaccaaggugacaguucug

SEQ ID NO: 39751 - RNA, 333 nt, Artificial Sequence
  derived and/or modified sequence opt5 from anti-HIV-1_LightChain
cagagcgugcuggcccaacccccuuccgcuucuggcaccccggggcagagagucacaaucagcugcuccggaucugccagcaacauuggcuucaauuccguuacgugguaccagcagcuccccgggaccgcgccuacagugcugaucuauggaaacgaccuucggcccucuggcauuccugaucgcuuuagcggguccaagagcggaaccucugcuacacugggcaucaccggccuccaaacaggggacgagggagauuacuauuguggcaccugggacagaucccugagcgccgggggaguguucggcacggggaccaaagucacagugcuu

SEQ ID NO: 39752 - RNA, 336 nt, Artificial Sequence
  derived and/or modified sequence opt5 from anti-HIV-1_LightChain
cagagcgcccugacccaacccgcuuccgugucuggcagcccuggggaguccaucacaauuucuugcacgggaaccagaagcgacaucggcaacuacgccuaugucuccugguaccagcagcucccggggacagcgcccaagcugcuuauuucugaaaauaacaaacggccuagcggaauccccgaucgcuucuccggcagcaagucugggaccuccgcuacacugggaauuaccggccuccagacaggcgacgaggccgauuauuacugugggaccugggacagcucucuguccgccggaggcguuuuugggacgggaaccaaagugacagugcuu

SEQ ID NO: 39753 - RNA, 333 nt, Artificial Sequence
  derived and/or modified sequence opt5 from anti-HIV-1_LightChain
cagagcgugcugacccaacccccuuccgucucugccccgcccggccagaagguuacaaucagcugcuccgggacgaccucuaacauuggaagcaauuacguggcuugguaucagcagcucccuggcacagcccccaaacugcuuaucuacgacaacgauaagagaccuuccgggauucccgaccgguucucuggaagcaaauccggcaccagcgcgacacuggggaucaccggacuccaaacaggcgaugaggcugacuauuacuguggcaccugggaucgcucucuguccgccgggggaguguuuggcacggggaccaaggucacagugcuu

SEQ ID NO: 39754 - RNA, 333 nt, Artificial Sequence
  derived and/or modified sequence opt5 from anti-HIV-1_LightChain
cagagcgugcugacccaaucccccucugucagcggcacaccugggcagagaguuacgaucuucugcuccggaucugacagcgauauuggcaucaacuccgugucuugguaccagcagcucccggggaccgcccccaagcugcuuauuuaugacaauaacaaacggccuagcggaauccccgaucgcuuuuccggcagcaagucugggacauccgcuacccugggaauuacaggccuccaaaccggcgacgaggccgauuacuauugugggacaugggacagaagccugucugcgggaggcguguucgggaccggaacgaaagucaccgugcuu

SEQ ID NO: 39755 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggaacucuagcaauauuggaaacaauuacguguccugguaucagcaccuccccggcacggccccuaaacugcuuaucuacgagaacaccaagagacccucugggauuccugaccgguucagcggauccaaaagcggcacaucugcgacccuggggaucacaggacuccagaccggcgaugaagcugacuauuacuguggcacaugggaucgcucccugagcgccgggggaguguuuggcaccgggacgaaggucaccgugcuu

SEQ ID NO: 39756 - RNA, 333 nt, Artificial Sequence
  derived and/or modified sequence opt5 from anti-HIV-1_LightChain
cagagccugcucacccaacccccuuccgugucugccgcuccgggccagaaggucacaaucagcugcuccgggggaaacucugacauuggcaaaaauuucguuagcugguaccagcagcugcccgggacggccccuaaacuucugaucuaugagaacaauaagagacccuccggcauuccugaucgguuuucuggaagcaaguccgggaccagcgcgacacucggaaucaccggccugcaaacaggcgacgaagcugauuacuauugugggaccugggacaacucucuuuccacaggaggcguguucgggaccggaacgaaagugaccguccug

SEQ ID NO: 39757 - RNA, 333 nt, Artificial Sequence
  derived and/or modified sequence opt5 from anti-HIV-1_LightChain
cagagcgugcugacccaacccccuuccgucucugccgcuccgggccagaagguuaucauuagcugcuccgggucuagcuccaacaucggcaaaaauuacguggccugguaucagcagcuccccggaacagcgccuaagcugcuuguguacgagaacacgaauagacccucugggauuccugaccgguucagcggauccaaaagcggcaccucugcuacacuggggaucaccggacuccaaacaggcgaugaagccgacuauuacuguggcaccugggauuccagccugucugccgggggagucuuuggcacagggaccaaggugacgguucuu

SEQ ID NO: 39758 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuaugagcgacauuggacucaaccccguguccugguacagacagcugccugaggcgcccccucaccuucugaucuucgauaaugacgaacggcccucuggcacggccgggcgcuuuagcgcuuccaaaagcggaaccucugccacacucgauauuaccggccugcagacaggggacgaggccgauuauuacuguggaaccugggacuccagccuuucugcuggcggcguguucgggacaggaaccaaggucacggugcug

SEQ ID NO: 39759 - RNA, 336 nt, Artificial Sequence
  derived and/or modified sequence opt5 from anti-HIV-1_LightChain
cagagcgcccugacccaacccgcuuccgugucuggcagcccugggcaguccaucacaauuucuugcacgggaaccagcuccgacgucggcucuuacaaccucguuagcugguaucagcaguacccggggagagcccccaagcugcuuaucuaugagaauaacaaacggccuuccggcauucccgaucgcuucagcggaucuaaguccgggacaagcgcgacccugggaaucacaggccuccaaaccggcgacgaagcugauuacuauugugggacaugggacaauucucuguccaccggaggcguguuugggacgggaaccaaagugacaguccuu

SEQ ID NO: 39760 - RNA, 333 nt, Artificial Sequence
  derived and/or modified sequence opt5 from anti-HIV-1_LightChain
cagagccugcucacccaacccccuuccgugucugccagcccgggccagaaggucacaaucuccugcucugggacgagcuccaacauuggaaauaacuacguuucuugguaucagcaguuccccggcaccgcuccuaaacugcuuaucuacgagaauaacaagagaagcuccgggauucccgaccgguuuagcggaucuaaauccgauacaagcgccacccugggcaucacagggcuccaaaccggagacgaagcggauuauuacuguggcacaugggaccgcucucuguccgcuggcgggguguucggaaccggcacgaaggugaccguccuu

SEQ ID NO: 39761 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggacggcgcuccaacauuggcgcuggguacgacgugcacugguaucagcagcuccccggaaccgccccuaagcugcuuaucuacgagaauaacaaaagacccucuggcauuccugaucgguucagcggguccaagucuggaacaagcgcgacccugggcaucacaggccuccaaaccggggacgaagcugauuauuacuguggaacaugggacaccucccugagcgccggcgggguguuuggaacgggcaccaaagucacagugcuu

SEQ ID NO: 39762 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuccgggucuagcuccaacauuggaaauaacuucgugucuugguaccaguuuuuccccggcacggccccuaagcucgugaucuaugagaaugacaaacggcccagcgggaccccugaucgcuuuuccggaagcaagucuggcacauccgcgacccuggcuauuaucgggcuucagacaggagacgaaggcgauuacuauuguggcaccugggacaacagccugucuacagggggagucuucggcaccgggacgaaagugaccguucuc

SEQ ID NO: 39763 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuccgggggaucuagcaacauuggcaauaaccacguguccugguaccagcagcuccccgggacggccccuaagcugcuuaucucugagaauaacaaacggcccagcggcauuccugaccgcuucuccggaagcaagucugggaccuccgcgacacugggaaucaccggccuccaaacaggcgaugaagcugacuauuacugugggaccugggauagcucucuguccgccggaggcguguuugggacaggaaccaaagucacggugcuu

SEQ ID NO: 39764 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaagagacuucgugucuugguaccaacaggugcccggcacggccccuaaacuccugaucuaugauaaugacaagcggcccagcgggauuccugaucgcuuuuccggaagcaaaucuggcaccuccgcgacacuugggaucaccggacugcagacaggcgacgaggcugauuacuauuguggcaccugggacagcucucucuccgccgggggagucuucggcacagggaccaaggugacgguucug

SEQ ID NO: 39765 - RNA, 336 nt, Artificial Sequence
  derived and/or modified sequence opt5 from anti-HIV-1_LightChain
cagaccguggucacacaacccccuagcguuuccggcgccccggggcagacggcuaccaucucuugcacaggaagcuccucuaacauuggcgccgacuacgaugugcacugguaucagcagcugcccgggaccgcgccuaagcuccugaucuacgacaauaacaaaagacccagcggcauuccugaucgguucuccggaucuaagagcgggacauccgcuacccuuggaaucacaggccugcaaaccggcgacgaggccgauuauuacugugggacgugggaccgcagccucucugccggaggcguguuugggaccggaacaaaagucaccgugcug

SEQ ID NO: 39766 - RNA, 333 nt, Artificial Sequence
  derived and/or modified sequence opt5 from anti-HIV-1_LightChain
aacuucaugcugacccagcccccuagcgccuccggcacaccggggcaaagagugacgaucucuugcagcggauccucuagcaauauuggcuccaacuacgucuauugguaccagcagcuccccgggaccacaccuaagcugcuuaucuaucggaauaaccagcgccccucuggcauuccugacagauuuagcggauccaaaagcgggaccucugcuacacugggaaucaccggccuccaaacaggcgaugaggccgacuacuauugugggaccugggauuccagccugucugcgggaggcguuuucgggacgggaaccaaggugacagugcuu

SEQ ID NO: 39767 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagccccaacauuggaaauaacuuccucuccugguaccagcagcugccuggcacggcccccaaacuucugaucuaugagaauaccaagagaccuucugggauucccgaccgguuuagcggauccaaaagcggcacaucugcgacccucgggaucacaggacugcaaaccggcgaugaagcugacuacuauuguggcacaugggaucgcucccuuagcgccgggggaguguucggcaccgggacgaaggugaccguccug

SEQ ID NO: 39768 - RNA, 333 nt, Artificial Sequence
  derived and/or modified sequence opt5 from anti-HIV-1_LightChain
cagagcgugcugacccaaucccccucugucagcgccgcuccuggccagaagguuacaaucuccugcucugggagcuccucugacauuggaaacaauuucgugagcugguaccagcagcucccgggcacggcccccaaacugcuuaucuaugagaacaauaagagaccuuccgggauucccgaucgguuuagcggaucuaaauccggcaccagcgcgacacuggggaucaccggacuccaaacaggcgacgaagcugauuacuauuguggcaccugggacucuucccugagcgccgggggaguguucggcacagggaccaaggucacggugcuu

SEQ ID NO: 39769 - RNA, 333 nt, Artificial Sequence
  derived and/or modified sequence opt5 from anti-HIV-1_LightChain
caguucuuucugacccaacccccuagccucuccgccacaccgggccagagagugucuaucagcugcuccgggggaggcucuaacauugcuaauaacgacgucuucugguuucagcaguuccccggggccggaccucggcugcuuaucuacgauaaucugaagcgccacuauggcacgcccgacagauuuagcggguccaaaucuggaaccagcgcgacacucggcauuaccggccugcaaacaggggaugaggcugacuacuauuguggaaccugggauaacucccuuagcacaggcgggguuuucggaaccggcacgaaggugaccgugcug

SEQ ID NO: 39770 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuggacccaacauuggcagcaauuccgugucuugguaccagcacuucccugggacggcccccaaacuccugaucuaugacaacaauaagagaccuagcggcauucccgaucgguuuuccggaagcaaaucugggaccuccgcgacacuuggaaucaccggccugcagacaggcgacgaggcugauuacuauugugggaccugggaccgcagccucucugccggaggcguguucgggacaggaaccaaggucacggugcug

SEQ ID NO: 39771 - RNA, 333 nt, Artificial Sequence
  derived and/or modified sequence opt5 from anti-HIV-1_LightChain
cagagcgugcugacccaaucccccucugccagcggcacaccugggcagagagucacgaucuccugcucuggaagcuccucuaacauuggcagcaauaccguuuccugguuccagcaccucccggggacagcucccaagcugcuuaucuacgagaacaauaaacggccuagcggcauucccgaccgcuuuucuggauccaagagcgggaccucugccacacugggaaucaccggccuccagacaggcgaugaagcggacuauuacugugggaccuggcauuccagccugucugcuggaggcguguucgggacgggaaccaaagugacaguccuu

SEQ ID NO: 39772 - RNA, 333 nt, Artificial Sequence
  derived and/or modified sequence opt5 from anti-HIV-1_LightChain
cagagcgugcugacccaacccccuuccgucucuggcgccccggggcagaacguuaucauuagcugcuccggaucuagcuccaauaucggcaagaacuacguggcuugguaucagcagcuccccgggacagccccuaaaauugugaucuacgagacgaccaauagacccucuggcauuccugcgcgguucagcggauccaagagcgggacaucugcuacccugggaaucacaggccuucaagccggcgacgaagccgauuauuacugugggaccugggacuccagccugaacgcuggaggcgucuuugggacaggaaccaaagugacgguucuc

SEQ ID NO: 39773 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuuccucucuugguaccagcaucugcccggcacggccccuagacuucugaucuaugacaaugaucagcggcccagcgggauuccugaccgcuuuuccggaagcaaaucuggcaccuccgcgacacucgggaucaccggacugcaaacaggcgaugaggcugacuacuauuguggcaccuggcacagcucucuuuccgccgggggaguguucggcacagggaccaaggugacgguccug

SEQ ID NO: 39774 - RNA, 333 nt, Artificial Sequence
  derived and/or modified sequence opt5 from anti-HIV-1_LightChain
cagagcgugcugacccaacccccuuccgccucuggcacaccggggcagaaggucacgaucagcugcuccggaucuagcuccaacauuggcaauaacuacguuucuugguaucagcagcuccccgggaccgcuccuaaacugcuuaucuacgagaauaacaagagacccagcggcauuccugaccgguucuccggaagcaaaucugggacauccgccacccugggaaucacaggccuccaaaccggcgaugaagcggacuauuacugugggacaugggauagcucucuguccaccggaggcguguuugggacgggaaccaaggugacaguccuu

SEQ ID NO: 39775 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggacgaccucuaacauuggaaaucacuacgugagcugguaucagcaguuccccggcacagccccuaaacucaucauuuacgagaccgacagacggcccuccgggaucccugcgcgcuuuucuggaagcaaguccggcacaagcgcuacccuggccauugccgggcuucaaacaggagaugaagcugacuauuacuguggcaccugggauucuucccugagcacgggcgggguguucggaaccggcacaaaagucaccgugcuc

SEQ ID NO: 39776 - RNA, 333 nt, Artificial Sequence
  derived and/or modified sequence opt5 from anti-HIV-1_LightChain
cagcuggugcucacccaacccccuagcgucuccgccgcuccgggccagaagguuacaaucucuugcagcggguccucuagcaacauuggaaauaacuacguguccugguaucagcagcugcccggcacggccccuaaacuucugaucuacgagaauaacaagagacccucugggauuccugaccgguucagcggauccaaaagcggcaccucugcgacacucgggaucaccggacugcaaacaggcgaugaagcugacuauuacuguggcaccugggauuccagccuuucuacagggggaguguuuggcaccgggacgaaggucaccgugcug

SEQ ID NO: 39777 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuccgggggaucuagcaacauuggcaauaaccacguguccugguaccagcaucuccccgggcgggccccucagcugcuuaucuaugacacgacccaacgccccucucggauuccugauagauucagcggauccaagagcggcacaucugcgacccuggggaucacaggacuccagaccggcgacgaggcugauuacuauuguggcacaugggacaauucccugagcaccgggggaguguuuggcacggggaccaaagucacagugcuu

SEQ ID NO: 39778 - RNA, 333 nt, Artificial Sequence
  derived and/or modified sequence opt5 from anti-HIV-1_LightChain
cagagcgugcugacccaacccccuuccgucucugccgcuccgggccagaagaucacaauuagcugcuccgggucuagaagcaacaucggaaauaacuacguuuccugguaucagcaguuccccggcacggccccuaaacuccugauuuacgacaauaaccaacggcccucucgcaucccugauagauuuagcggguccaagagcggaaccucugcgacacuuggcauuaccgggcugcagacaggagacgaggcugauuauuacuguggcaccugggacuccagccucucugccggcgggguguucggaacaggcaccaaagugacgguccug

SEQ ID NO: 39779 - RNA, 321 nt, Artificial Sequence
  derived and/or modified sequence opt5 from anti-HIV-1_LightChain
cagagcgugcugacccaacccccuuccgucucugccgcuccgggccagagaguuacaaucagcugcuucgggucccgguuuucuagcguguccugguaccagcagcuccccggaacggccccuaagcugcuuauuuaucccaacggcgagcgcccuucugggauccccgacagauucuuuggaagcgaauccggcaccagcgcgacacuggggauuaccggacuccaaacaggcgaugaggcugacuacuauugugccaccugggauucuucccugagcgccggcgggguguucggaacaggcaccaaacuuacgguccug

SEQ ID NO: 39780 - RNA, 333 nt, Artificial Sequence
  derived and/or modified sequence opt5 from anti-HIV-1_LightChain
cagagcgugcugacccaacccccuucccucucugccgcuccgggccagaaggucacaaucagcugcuccgggucuagccugaacauuggaaaucacuacguuuccugguaucaacaggugcccggcacggccccuaaacuucugaucuacgaggacaacaagagacccucugggauuccugaucgguucagcggauccaaaagcggcaccucugcgacacucgggaucaccggacugcagacaggcgacgaagcugauuauuacuguggcaccuggcauuccagccuuucugccgggggaguguuuggcacagggaccaaggucacggugcug

SEQ ID NO: 39781 - RNA, 333 nt, Artificial Sequence
  derived and/or modified sequence opt5 from anti-HIV-1_LightChain
caguucgugcugacccaacccccuagcgucuccgccgcuccgggccagaagguuacagugucuugcagcgggacgaccuccgacaucggagagaacuacgugucuugguaucagaaauuucccgaagccgcgccuaagcuccugauuuacgauaaugacaaaagacccagcggcaucccugaucgguucuccgggucuaagagcggaacauccgcuacccuuggcauuacagggcugcagaccggagacgaggccgauuauuacuguggcacaugggaccgcagccucucugccggcggggucuuuggaaccggcacgaaagugaccguucug

SEQ ID NO: 39782 - RNA, 333 nt, Artificial Sequence
  derived and/or modified sequence opt5 from anti-HIV-1_LightChain
cugagcgugcucacccagcccccuuccgucucugccgcuccgggccaacagguuacaaucagcugcuccgggacgaccucuaacauuggaacaaauuacgugagcugguaucagcagaugcccccuaccgcccccaagcugcuuaucuacgagaacaauaaaagaccuuccggcauucccgaccgguucucugggagcaaguccggaacaagcgcgacccugggcaucacagggcuccaaaccggagaugaagcugacuauuacuguggcacgugggauucuucccugagcgccggcgggguguuuggaaccggcacaaaagucaccgugcuu

SEQ ID NO: 39783 - RNA, 336 nt, Artificial Sequence
  derived and/or modified sequence opt5 from anti-HIV-1_LightChain
cagagcaugcugacccaacccccuuccgugucuggcgccccggggcagagagucacaaucagcugcacgggaucccggucuaacauuggcgcuggguacgacguucacugguaucuccagcugcccggaaccgccccuaaacuucugaucuacgagaauaacaagcgccccagcggcauuccugauagauucuccgggucuaagagcggaacauccgcgacccucggcaucacaggccugcagaccggggacgaagcugauuauuacuguggaacaugggacaauagccuuucuaccggcgggguguuuggaacgggcaccaaagugacaguccug

SEQ ID NO: 39784 - RNA, 333 nt, Artificial Sequence
  derived and/or modified sequence opt5 from anti-HIV-1_LightChain
cagagcgugcugacccaacccccuuccgucucugccacaccgggccagaagguuacgaucagcugcuccgggucuagaagcaacauuggaucccacuacgugucuugguaucagcaguuccccgagagcgcuccuacccuccugaucuacgaaaauguggagcggcccuccggcauuccugaccgcuuuagcgggucuaaauccggaacaagcgccacccuuggcaucacagggcugcaaaccggagaugaagcggacuauuacuguggcacaugggauucuucccucagcgcuggcggggucuucggaaccggcacgaaggugaccguucug

SEQ ID NO: 39785 - RNA, 333 nt, Artificial Sequence
  derived and/or modified sequence opt5 from anti-HIV-1_LightChain
caguucuuucugacccaacccccuagccucuccgccacaccgggccagagagugucuaucagcugcuccgggggaggcucuaacauugcuaauaacgacgucuucugguuucagcaguuccccggggccggaccucggcugcuuaucuacgauaaucugaagcgccacuauggcacgcccgacagauuuagcggguccaaaucuggagcgaccggcacacucgagauuaccgaaguucaaacagcugaugaggccgacuacuauuguggcaccugggauagcucccugagcgccgggggaguguucggcacagggaccaaggugacgguccuu

SEQ ID NO: 39786 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggggaucuagcaacauuggcgacaauuccgugucuugguaccagcagcuccccgggacggccccuaaacugcuuaucuaugagaacaauaagagacccagcggcauuccugaucgguucuccggaagcaaaucugggaccuccgcgacacugggaaucaccggccuccaaacaggcgacgaagcugauuacuauugugggaccugggacagcucucuguccacaggaggcguguuugggaccggaacgaaggucaccgugcuu

SEQ ID NO: 39787 - RNA, 333 nt, Artificial Sequence
  derived and/or modified sequence opt5 from anti-HIV-1_LightChain
cagagcgugcugacccaacccccuuccgucucugccgcuccgggccagacaguuacgaucagcugcuccgggucugccagcaacauuggaagaaauuccgugucuugguaccaguaugugcccggcgcggcuccuaagcggcucaucuacgagaacaauaaacgccccagcgggauuccugacagauucuccggaagcaagucuggcaccuccgccacacuggggaucaccggacuucagacaggcgaugaagccgacuauuacuguggcaccugggauacaagccugucugcugggggagucuuuggcaccgggacgaaagugaccguucuc

SEQ ID NO: 39788 - RNA, 333 nt, Artificial Sequence
  derived and/or modified sequence opt5 from anti-HIV-1_LightChain
cagagcgugcuggcccaacccccuuccgucucugcugccccgggccagaagguuaccaucagcugcuccgggagaacaucuaacauuggaaauuacuucgugagcugguaucagcaguuucccggcacggcgccucggcuccugaucuacgacaacgaucaacgccccuccgggauuccugacagauucucuggaagcaaauccggcaccagcgcuacacuugggaucaccggacugcagacaggcgaugaggccgacuauuacuguggcaccugggauucuucccucagcgccgggggaguguuuggcacagggaccaaggucacggugcug

SEQ ID NO: 39789 - RNA, 333 nt, Artificial Sequence
  derived and/or modified sequence opt5 from anti-HIV-1_LightChain
cagagcgcccugacccaacccgcuuccgugucugccgcgccuggccagaaggucacaaucagcugcuccgggucuagcuccaacauuggaaauaucuacguuucuugguaucagcagcucccgggcacggcucccaaacugcuuauuuacgagaacaauaagagaccuagcgggauccccgaccgguucuccggaagcaaaucuggcaccuccgccacacuggggauuaccggacuccaaacaggcgaugaagccgacuauuacuguggcaccuggcacagcucucuguccgcugggggaguguuuggcacagggaccaaggugacgguccuu

SEQ ID NO: 39790 - RNA, 333 nt, Artificial Sequence
  derived and/or modified sequence opt5 from anti-HIV-1_LightChain
cagagcgugcugacccaacccccuuccgucucugccacaccgggccagagaguuacggugagcugcuccgggucuagcuccaacaucggaaaucacuacgugucuugguaucagcagguccccggcaccgcuccuaagcuccugauuuacgacaacagcaaucggcccuccgggaucccugaucgcuucagcggaucuaaauccggcacaagcgccacccuugggauuacaggacugcaaaccggcgacgaggcggauuauuacuguggcacaugggacucuucccucagcgcugggggaguguuuggcaccgggacgaagguuaccgugcug

SEQ ID NO: 39791 - RNA, 333 nt, Artificial Sequence
  derived and/or modified sequence opt5 from anti-HIV-1_LightChain
cagagcgugcugacccaacccccuucccucucugccgcuccgggccagagagucacaguuagcugcuccgggucuagcuccaacaucggagacaauuacgugucuugguaucagcagcugcccggcgccgcgccucggcuucugauuuacgauaacagcauccgccccuccgcuauuccugccagauucagcgggucuaaguccggaacgagcgccacccucgcuaucacaggccugcaaaccggggacgaggccgauuauuacuguggaacaugggacucuucccuuagcgcuggcggcguguuugggaccggaacaaaagucaccgugcug

SEQ ID NO: 39792 - RNA, 336 nt, Artificial Sequence
  derived and/or modified sequence opt5 from anti-HIV-1_LightChain
cagagcgcccugacccaacccgcuuccgugucuggcagcccugggcaguccaucacaauuucuugcacgggaaccagcuccgacgucggcggguacgauuauguuucuugguaccuccagcugccgggaacagcccccaaacuucugaucuaugagaacaauaagagaccuagcggcauucccgaccgguucuccgggagcaagucuggaaccuccgcgacacucggcaucaccggccugcagacaggggaugaagcugacuacuauuguggaaccugggauagcucucuuuccgccggcgggguguuuggaacgggcaccaaagugacaguccug

SEQ ID NO: 39793 - RNA, 333 nt, Artificial Sequence
  derived and/or modified sequence opt5 from anti-HIV-1_LightChain
cagagcgugcugacccaacccccuuccgucucugccgcuccgggccagagaguuacagugagcugcuccgggucuagcuccaacaucggaaauaacuacgugucuugguaucagcaguuccccggcacggccccuaagcucgucauuuacgacaccgauaaacggcccagcgggaucccugaccgcuuuuccggaagcaagucuggcacauccgcgacccuggggauuacaggacuucaaaccggcgaugaggcugacuauuacugugccacaugggauagcucucuguccgccggcgggguguucggaaccggcacgaaaguuaccgugcuc

SEQ ID NO: 39794 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggaaacuccucuaauauuggcgcuggguacgacgugcacugguaucagcagcuccccggaaccgccccuaagcugcuuaucagcgagaacaauaaacggcccuccggcauuccugaucgcuucucugggagcaaguccggaacaagcgcgacccugggcaucacaggccuccaaaccggggacgaagcugauuacuauuguggaacaugggacucuucccugagcgccggcgggguguuuggaaccggcacgaaagucaccgugcuu

SEQ ID NO: 39795 - RNA, 333 nt, Artificial Sequence
  derived and/or modified sequence opt5 from anti-HIV-1_LightChain
cagagcgugcugacccaacccccuuccgccucuggcacaccggggcagagagucacgaucagcugcuccggaucuagcuccaacauuggcucuaauuacguugacugguaucagcagcuccccgggaccgcuccuaagcugcuuaucuacgagaacaauaaacggcccagcggcauuccugaucgcuucuccggaagcaagucugggacauccgccacccugggaaucacaggccuccaaaccggcgacgaagcggauuauuacugugggacauggcacagcucucuguccgcuggaggcguguuugggaccggaacgaaagugaccguccuu

SEQ ID NO: 39796 - RNA, 333 nt, Artificial Sequence
  derived and/or modified sequence opt5 from anti-HIV-1_LightChain
cagagcgugcugacccaacccccuuccgucucugccacaccgggccagacgguuaccaucagcugcuccgggucuagcuccaacauuggaaauaacuaccucucuugguauagacagcugccccggacagcuccuaaacuucugaucuacgagaauaaccgcagacccagcggcgugccugcccgguucuccgggagcaagucuggaaccuccgcgacacucgcuauuaccggccugcagacaggggacgaagccgauuauuacuguggaaccugggacagcucucuuuccgccggcggcguguuugggacgggaaccaaggucacagugcug

SEQ ID NO: 39797 - RNA, 321 nt, Artificial Sequence
  derived and/or modified sequence opt5 from anti-HIV-1_LightChain
cagagcgugcugacccaacccccuuccgucucugccgcuccgggccagagaguuacaaucagcugcuucgggucccgguuuucuagcguguccugguaccagcagcuccccggaacggccccuaagcugcuuauuuaucccaacggcgagcgcccuucugggauccccgacagauucuuuggaagcgaauccggcaccagcgcgacacuggggauuaccgcugugcaaacaggagaugaggccgacuacuauuguggcaccugggaugacucucucuccacaggcggggucuucggaaccggcacgaaagugaccguucug

SEQ ID NO: 39798 - RNA, 333 nt, Artificial Sequence
  derived and/or modified sequence opt5 from anti-HIV-1_LightChain
cagagcgugcugacccaacccccuuccgucucugccgcuccgggccagaagguuacacucagcugcuccgggacgucuagcaacaucggaaauaacuacguguccugguaucaacaggugcccggcgccgcgccuaaaguccugauuuacgagaaugacaagagacccucugggaucccugaucgguucagcggauccaaaagcggcaccucugcuacacuugggauuaccggacugcagacaggcgacgaagccgauuauuacuguggcaccugggaccgcucccucagcgccgggggaguguuuggcacagggaccaagguuacggugcug

SEQ ID NO: 39799 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuaacagcaauauuggaaacaauuacguguccugguaucagcagcuccccggcacggccaccaaacugcuuaucuacgagaacgacaagagaccuucugggauucccgaucgguucagcggauccaaaagcggcacaucugcgacccuggggaucacaggacuccaaaccggcgacgaagcugauuauuacuguggcacauggcacuccagccugucugccgggggaguguuuggcaccgggacgaaggucaccgugcuu

SEQ ID NO: 39800 - RNA, 333 nt, Artificial Sequence
  derived and/or modified sequence opt5 from anti-HIV-1_LightChain
cagagcgugcugacccaacccccuucccucucugccgcuccgggccagcaggucagcaucuccugccuggggagaucuagcaacauuggaacaaauuacguuuccugguaucagcaauuccccggcacggccccuaaacuucugaucuacgagaacaagaagcggcccucugaaauuccugaccgcuuuagcggguccaaaagcggaaccucugcgacacucggcaucaccgggcugcagcccggagaugaggcugacuauuacuguggcacaugggauuccagccuuucugccggcgggguguucggaaccggcacaaaggugaccguccug

SEQ ID NO: 39801 - RNA, 336 nt, Artificial Sequence
  derived and/or modified sequence opt5 from anti-HIV-1_LightChain
cagagcgcccugacccaacccccuuccgcuucuggcagcccggggcaguccgugacaaucucuugcacgggaaccagcuccgacgucggcgccuacaacucuguuagcugguaucagcagcuccccgggacagcgccuaagcugcuuauuuccgagaauaacaaaagacccagcggaaucccugaucgguucucuggcuccaagagcgggaccucugcuacacugggaauuaccggccuccaaacaggcgacgaagccgauuacuauugugggaccugggacuccagccugucugccggaggcguguuugggacgggaaccaaagugacaguccuu

SEQ ID NO: 39802 - RNA, 333 nt, Artificial Sequence
  derived and/or modified sequence opt5 from anti-HIV-1_LightChain
cagagcgcccugacccaacccccuuccgcuucuggcagcccggggcaguccgugacaaucucuugcagcggaggcuccucuaacauugggaauaaccacgucagcugguaccagcaucuccccggcagagccccucagcugcuuaucuaugacacgacccaacggcccucccgcauuccugauagauucagcggaucucgguccgggacaagcgcgacccuggcuaucacaggacuccagaccggcgacgaggccguuuacuauuguggcacaugggauaauucucuguccaccgggggaguguuuggcacggggaccaaggugacaguccuu

SEQ ID NO: 39803 - RNA, 333 nt, Artificial Sequence
  derived and/or modified sequence opt5 from anti-HIV-1_LightChain
cagagcgugcugacccaacccccuuccgucucugccgcuccgggccagagaguuacaaucagcugcuccgggggaacgucuaacauuggcaaugaguacgugagcugguaucagcagcuccccgggaccgccccuaagcugcuuaucuacgaaaacaauaaacggcccuccggcauuccugaccgcuucucuggaagcaaguccgggacaagcgcgacccugggaaucacaggccuccaaaccggcgaugaggcugacuauuacugugggacaugggauucuucccugagcgccggaggcguguuugggaccggaacgaaagucaccgugcuu

SEQ ID NO: 39804 - RNA, 333 nt, Artificial Sequence
  derived and/or modified sequence opt5 from anti-HIV-1_LightChain
cagagcgugcugacccaacccccuuccgucucugccgcuccgggccagagaguuacagugagcugcuccgggucuagcuccaacaucggaaauaacuacgugucuugguaucagcagcuccccggcgccgcgccuaagcugcuuauuuacgacacggauaaacggcccagcgggaucccugaccgcuucuccggaagcaagucuggcaccuccgcuacacuggggauuaccggacuccaaacaggcgaugaggccgacuauuacuguggcaccugggauagaagccugucugccgggggagucuuuggcacagggaccaaagugacgguucuu

SEQ ID NO: 39805 - RNA, 333 nt, Artificial Sequence
  derived and/or modified sequence opt5 from anti-HIV-1_LightChain
cagagccugcucacccaacccccuuccgugucugccgcuccgggccagaaggucacaaucagcugcuccgggggaaacucugacauuggcaaaaauuucguuagcugguaccagcagucccccggggccgcgccuagacugcuuaucuaugagaacgaucggcgccccucuggcauuccugacagauuuagcggauccaagagcgggacgucugcuacccugggaaucacaggccuccaaaccggcgaugaagccgacuacuauugugggacaugggaucggucccugagcgccggaggcguguucgggaccggaacaaaagugaccguccuu

SEQ ID NO: 39806 - RNA, 333 nt, Artificial Sequence
  derived and/or modified sequence opt5 from anti-HIV-1_LightChain
cagagcgugcugacccaacccccuuccgucucugccgcuccgggccagaagguuaacaucagcugcuccgggucuagcuccaauauuggcaaaaacuacgugucuugguaucagcagauccccggaacagccccuaaggugcucauuuacgagaauaacaaaagacccagcgggaucccugaccgguucuccggaagcaagucuggcacguccgcgacccuggggauugcuggacuucaaacaggcgaugaagccgacuauuacugugccaccugggauagcucucuguccgcuggcggggucuuuggaacaggcaccaaagugacaguucuc

SEQ ID NO: 39807 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauagacacgugucuugguaccagcagcuccccggcacggugccuaaacugcuuaucuaugagaccaacaagcggcccagcgggauuccugaccgcuucuccggaagcaaaucuggcacauccgccacccuggggaucacaggacuccaaaccggcgaugaagcggacuacuauuguggcacaugggauaauagccugucuaccgggggagucuuuggcacggggaccaaggugacaguucuu

SEQ ID NO: 39808 - RNA, 336 nt, Artificial Sequence
  derived and/or modified sequence opt5 from anti-HIV-1_LightChain
cagagcgugcugacccaacccccuuccgucucuggcgccccggggcagagaguuacaaucagcugcacgggauccucuagcaacauuggcgcuggguacgacgugcacugguaucagcagcuccccggaaccgccccuaagcugcuuaucuucggccaugauaaacggcccuccgggauuccugaccgcuuuucuggaagcaaguccggcacaagcgcgacccugggcaucacagggcuccaaaccggagaugaggcugacuacuauuguggcacaugggauucuucccugagcgccgggggaguguucggcaccgggacgaaagucaccgugcuu

SEQ ID NO: 39809 - RNA, 333 nt, Artificial Sequence
  derived and/or modified sequence opt5 from anti-HIV-1_LightChain
cagagcgugcugacccaacuccccuccgccucuggccugccugggcagacagucacgaucagcugcuccggaucuaccagcuccauuggcucuaaccacguuuacugguaucaacagguggcugggacagccccgaaacuucugaucuacgagaauaacaagagacccagcggcauuccugaccgguucuccggaagcaagucugggaccuccgcgacacucggaaucaccggccugcagacaggcgaugaagcugacuauuacugugccaccugggauagcucucuuuccgccgggggaguguuuggcacggggaccaaagucacagugcug

SEQ ID NO: 39810 - RNA, 333 nt, Artificial Sequence
  derived and/or modified sequence opt5 from anti-HIV-1_LightChain
cagagcgugcugacccaaacacccuccgccucuggcgcuccugggcagggagucacgaucagcugcuccggcucuagcuccaacguugggagaaauuacgugucuugguaucagcagcucccgggaaccgcccccaagcugcuuauuuacgagaacacaaaacggccuagcggcauccccgaccgcuucuccgggagcaagucuggaaccuccgcgacacugggcauuaccggccuccaaacaggggaugaagcugacuauuacuguggaaccugggauagaagccugucugccggcgggguguuuggaacgggcaccaaagucacagugcuu

SEQ ID NO: 39811 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuacgugucuugguaucagcaguuccccggcacggccccuaaacuccugaucagcgacaauaacaagagacccuccgggauuccugaucgguuuagcgugucuaaauccggaaccagcgcgacacuuggcaucaccgggcugcaagcuggagacgaggccgauuacuauuguggcacaugggacucuucccucagcgccggcggggucuucggaaccggcacaaaggugaccguucug

SEQ ID NO: 39812 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuaacagcaauauuggaaacaauuacgugacgugguaucagcaguuccccggcaccgccccuaaagugcucaucuacgacaacuccagacggcccucugggauuccugaucgcuuuagcggauccaagagcggcacaucugcgacccuggggaucacaggacuucaaaccggcgacgaggcugauuauuacuguggcacaugggacuccagccugucugccgggggagucuucggcaccgggacgaaagugaccguucuc

SEQ ID NO: 39813 - RNA, 333 nt, Artificial Sequence
  derived and/or modified sequence opt5 from anti-HIV-1_LightChain
cagagcgugcugacccaacccccuuccgucucuggcgccccggggcagagaguuacaaucagcugcuccggaucuagcuccaacauuggcaauaacuacgugucuugguaucagcagcuccccgggacggcuccuaagcugcuuaucuacgagaauaccaaacggcccagcggcauuccugaccgcuucuccggaagcaagucugggacauccgccacccugggaaucacaggccuccaaaccggcgaugaagcggacuauuacugugggacaugggauagaagccugucugcuggaggcguguuugggaccggaacgaaagucaccgugcuu

SEQ ID NO: 39814 - RNA, 333 nt, Artificial Sequence
  derived and/or modified sequence opt5 from anti-HIV-1_LightChain
cagagcgugcugacccaacccccuuccgucucugccgcuccgggccagacaguuacgaucagcugcuccgggucuaccagcaacauuggacagaauuuccucuccugguuucagcacgugcccggcacagccccuaagcugcuuaucuacgagaacaauaaaagacccucugggauuccugaccgguucagcggauccaagagcggcaccucugcgacacuggggaucaccggacuccaaacaggcgaugaagcugacuauuacuguggcaccuggcauuccagccugucugccgggggaguguuuggcacggggaccaaagucacagugcuu

SEQ ID NO: 39815 - RNA, 333 nt, Artificial Sequence
  derived and/or modified sequence opt5 from anti-HIV-1_LightChain
aacuucaugcugacccagcccccuagcgccuccggcacaccggggcaaagagugacgaucucuugcagcggauccucuagcaauauuggcuccaaguacgucucuugguaucagcagcuccccgggaccgcuccuaaacugcuuaucuacgagaacacaaagcggcccagcggcauuccugaccgcuuuuccggaagcaaaucugggaccuccgccacacugggaaucaccggccuccagacaggcgaugaagcggacuauuacugugggaccugggauagaagccugucugcuggaggcguuuucgggacgggaaccaaggugacagugcuu

SEQ ID NO: 39816 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuacgugucuugguaucagcuccugcccggcacggccccuaaacuucugaucuacgagaauaacaagagacccagcgggauuccugaccgguucuccggaagcaaaucuggcaccuccgcgacacucgggaucaccggacugcagacaggcgaugaagcugacuauuacuguggcaccugggauaauagccuuucuacagggggaguguuuggcaccgggacgaaggucaccgugcug

SEQ ID NO: 39817 - RNA, 333 nt, Artificial Sequence
  derived and/or modified sequence opt5 from anti-HIV-1_LightChain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaaaucauuaucuacgacaauaacaagagacccagcgggauuccugaucgguucuccggaagcaaaucuggcaccuccgcgacacuggggaucaccggacuucaaacaggcgacgaggcugauuauuacuguggcaccuggcacagcucucuguccgccgggggaguguuuggcacagggaccaaggucacggugcuc

SEQ ID NO: 39818 - RNA, 333 nt, Artificial Sequence
  derived and/or modified sequence opt5 from anti-HIV-1_LightChain
cagagcgugcugacccaacccccuuccgccucugcuacaccgggccagagagucacgaucagcugcuccgggucuagcuccaacauuggaucuaagcacguuuacugguaucagaaacuccccggcaccgccccuaagcugcuuaucuacgagaauacaaaacggcccagcgggauuccugaccgcuucuccggaagcaagucuggcaccuccgcgacacuggggaucaccggacuccagacaggcgaugaagcugacuauuacuguggcaccugggauagaagccugucugccgggggaguguuuggcacggggaccaaagugacaguccuu

SEQ ID NO: 39819 - RNA, 432 nt, Artificial Sequence
  derived and/or modified sequence opt5 from anti-HIV-1_HeavyChain
caggcccaacugguggagagcggcgggggagucguucagcccggcagaucccuccggcugucuugcgcugccagcggguucaccuuuuccucuuacggaauccacugggugcgccaggcgccuggcaaggggcuugaauggguggcugucaugagcuccgacggaacauauaaauacuauggcgauucuaugaagggcagauucacgauuagccgggacaacuccaaaaauagccuguaccuccagaugaacucucugcgcgccguggauaccgccguuuauuacugugcuaaggaccuuggggagggagaaaaugaggaaugggccacagauuauuacgacuuuuccaucggcuacccggggcaagaucccagaggaguggucggcaccuucgacauuugggggcagggaacaauggugaccguuagcucu

SEQ ID NO: 39820 - RNA, 426 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcgacgauggauccaacaaauauuacgcugacucuguuaagggcagauucacaauuagccgggauaauuccaaaaacacgcuguaucuccagaugaauagccugcgcgccgaggacaccgccguguacuauugugcuaaggaucuuggcgaaucugagaacgaagagugggccuccgacuacuaugauuuugggagcgacuacccgggacaagaucccagagcugucgugggcgccuucugggggcagggaacaaugguuaccgugucuucc

SEQ ID NO: 39821 - RNA, 432 nt, Artificial Sequence
  derived and/or modified sequence opt5 from anti-HIV-1_HeavyChain
caggugcaacuggucgagagcggcgggggaguugugcaguccggcagaucucuccggcugagcugcgccgcuuccggguucaccuuuucugccuacgcgcuucacugggugcgccaggcucccggaaagggccuggaaugggucgccgugaucagcuaugacgggagagauaaagacuacgccgauuccguuaagggacgguucacaauuucucgcgacaacagcaaaaauacgcucuaucugcagaugaacucccuuagagcugaggauaccgccguguacuauugugcuaaggaccugggcgaaagcgagaaugaagagugggccucugauuacuaugacuuuggcuccgauuacccugggcaagacccgcgggcggucgugggagccuucgauaucuggggccaggggacaaugguuaccgugagcucu

SEQ ID NO: 39822 - RNA, 432 nt, Artificial Sequence
  derived and/or modified sequence opt5 from anti-HIV-1_HeavyChain
caggugcaacugguccagagcggcgggggacucguucagcccggcagaucccugcggcuuucuugcguggccagcggguuccgcuuuuccuuccacggaaugcauugggugagacaggcuccuggcaaggggcuggagugggucgccgugguuucugacgauggaagcgaccaaaaauacguggauuccgucaagggccggcucaccaucucucgcgacaacagcaaaaauacaguguaucugcagaugaacucccuuagagcggaagauacggcuguuuacuauugugccaaggaccugggcgagagcgaaaaugaggaaugggccucugauuacuaugacuuuggguccgauuacccgggacaggacccccgggcuguggucggcgccuucgauauuugggggcagggaaccauggugacagugagcucu

SEQ ID NO: 39823 - RNA, 432 nt, Artificial Sequence
  derived and/or modified sequence opt5 from anti-HIV-1_HeavyChain
gaggugcaccuggucgaaagcggcgggggaguugugcagcccggcagaucccuccggcugucuugcgccgcuagcggguucaccuuuaacuccuacgccaugaucugggugcgccaagcgccuggaaagggccuugagugggucgcugugauuucuuaugacgggaauaacaaauacuaugccgauagcguuaagggaagauucacaaucucccgggaaaauucuaaaaacacgcuguaccuccagaugaauagccugcgcgccgaggacaccgcuguguaucauugugccaaggaucuuggcgaauccgagaacgaggaaugggcuagcgacuacuaugauuuuggcagagacuacccggggcaggauccccggggagucgugggcacauucgacauuugggggcacggaaccaugguuacagugucuucc

SEQ ID NO: 39824 - RNA, 432 nt, Artificial Sequence
  derived and/or modified sequence opt5 from anti-HIV-1_HeavyChain
caggugcaacuggucgagagcggcgggggaguugugcggcccggcgggucccuccggcugucuugcaccgccagcggauuccacuuuaacaaguacggcaugaauugggugcgccaggcuccugggaaaggacuugcccuggucgcguucauccaguccggcgcuucuuauaacuacuaugccgacagcgugaagggcagauuuacaauuucccgggauaauucuaaaaacacgcucuaccugcagaugaauagccuucgcgccgaagacaccgcuguuuauuacugugccaaggaucugggggacuccgagaacgaagagugggcuagcgauuauuacgacuucggaagagauuacccgggccaagaccccagagggguggucggagccuuugauaucuggggccaugggacaauggugaccguuucuucc

SEQ ID NO: 39825 - RNA, 432 nt, Artificial Sequence
  derived and/or modified sequence opt5 from anti-HIV-1_HeavyChain
caggugcaccuggucgagagcggcgggggaguugugcaacccggcaagucccucaccaucuacugcgccgugucugaguucacacugagcaacuaugcuaugcauugggucagacuuacgccugggaaaggacugcaguggguggccguuauuuccuacgacggcucuaauaaguauuacgcggauagcgugaaagggcgguuuaccaucucccgcgacaacucuaagaauacacucuaucugcagaugaacagccuuagagcugaagauaccgccgucuacuauugugccaaagaccugggagaauccgagaaugaagagugggcuagcgauuacuacgacuucggccgggauuauccgggccaggacccccgcggggugguuggaguguuugauauuuggggccaagggacaauggucaccgugucuucc

SEQ ID NO: 39826 - RNA, 432 nt, Artificial Sequence
  derived and/or modified sequence opt5 from anti-HIV-1_HeavyChain
gaggugcagcugcucgaaagcggcgggggagucguucaacccggcagaucccugcggcuuucuugcgccgcuagcggguucaccuuuuccacauacgcccugcacugggugcgccaggcgccuggaaagggccucgaguggguggcugucaucucuuaugacgggagcacgaaauucuacgccgauuccgugaagggaagauuuaccauuucucgggacaacagcaaaaauacacuguaucuucagaugaacucccugcgcgccgaagauaccgcuguuuacuauugugccaaggaccucggcgagagcgaaaaugaggagugggcuucugauuacuaugacuucggcuccgauuacccggggcaggaccccagagccguggucggagcguuugauaucuggggccaagggacaauggugaccguuagcucu

SEQ ID NO: 39827 - RNA, 432 nt, Artificial Sequence
  derived and/or modified sequence opt5 from anti-HIV-1_HeavyChain
caggugcaacuggucgagagcggcgggggaguugugcagcccggcgggucccuccggcugucuugcgccgcuagcggauucaccuuuuccucuuacggcaugcacugggugcggcaggccccugggaagggacuugaaugggucgcguucauccgcuaugacggcagcaauaaauacuaugcugauuccgugaagggcagauuuacaauuucucgggagaauagcaaaaacacgcuguaccuccagaugaacucccugcgcgccgaagacaccgccguuuaucauugugcuaaggaucuuggggagagcgaaaucgaggaguggacaucugacuacuaugauuucggaagagacuacccgggccaagaucccagagggguguuuggaaccuucgacauuuggggccacgggacaauggucaccguguccagc

SEQ ID NO: 39828 - RNA, 432 nt, Artificial Sequence
  derived and/or modified sequence opt5 from anti-HIV-1_HeavyChain
gaggugcagcuggucgaaagcggcgggggaguugugaagcccggcgggucccucagacugucuugcguggucagcggauucaccuuuuccaacgccuggaugucuugggugcggcaagcuccuggcaaagggcuugaguggguugccgugaucagcgacgauggauccaauaaguacuaugcggacucugucaaaggccgcuucacaauuagcagagauaacuccaagaauacgcuguaccuccagaugaacagccugcgggcugaagacaccgccguguauuacugugccaaagaucuuggcgagucugaaaaugaggagugggcuuccgacuauuacgauuuugggagcgacuauccgggacaggauccccgcgccguugugggcgcuuucgacaucugggggcagggaacaauggucaccgugucuucc

SEQ ID NO: 39829 - RNA, 432 nt, Artificial Sequence
  derived and/or modified sequence opt5 from anti-HIV-1_HeavyChain
caggugcaacuggucgagagcggcgggggaguugugcagcccggcgggucccuccggcugucuugcgccgcuagcggauucaccuuuuccacauacggcaugcacugggugcggcaggccccugggaagggacuugaaugggucgcguucauccgcuaugacggcagaaacaaaaauuacgcugauucugugaagggccgguuuacgauuagccgcgacaacuccaaaaauacccuguaucuccagaugaacucucugagagccgaggauacagccguuuacuauugugcuaaggaccuuggggaaagcgagaaugaagagugggccaccgauuacuaugacuucuccaucggauacccgggccaagaucccagagggguggucggaauuuuugacaucuggggccaggggacaauggugaccguuagcucu

SEQ ID NO: 39830 - RNA, 432 nt, Artificial Sequence
  derived and/or modified sequence opt5 from anti-HIV-1_HeavyChain
caggugcaccuggucgagagcggcgggggaguugugcaacccggcgggucccucagacugucuugcgccgcuagcggauucuccuuuucuaucuacggcaugcauugggugcggcaggccccugggaagggacuugaaugggucaccuucacacgcuaugacggcagcaacaaauacuauacggauuccgugaagggcagauuuaccauuucucgggacaauagcaaaaacacacuguaccuccagaugaacucccugcgcaccgaggauacagcgguuuauuacugugcuaaggaccuuggggaaagcgagaaugaagagugggccucugauuauuacgacuucggauccgauuacccgggccaggaccccagagccguggucggggcuuuugauaucuggggacaaggcaccauggugacaguuagcucu

SEQ ID NO: 39831 - RNA, 432 nt, Artificial Sequence
  derived and/or modified sequence opt5 from anti-HIV-1_HeavyChain
caggugcaacuggucgagagcggcgggggaguugugcagcccggcgggucccuccggcugucuugcgccgcuagcggauucaccuuuuccucuuacggcaugcacugggugcggcaggccccugggaagggacuugaaugggucgcguucauccgcuaugacggcagcaacaaauacuaugcugauccggugaagggcagauuuacaauuucccgggacaauucuaaaaacacgcuguaccuccagaugaauagccugcgcgccgaggauaccgccguuuauuacugugcuaaggaccuuggggaauccgagaacgaagagugggccagcgauuauuacgacuucggaagagauuaccccggccaagacccuagagggguggucggaguguuugauaucuggggccaggggacaaugguuaccgcuucuucc

SEQ ID NO: 39832 - RNA, 432 nt, Artificial Sequence
  derived and/or modified sequence opt5 from anti-HIV-1_HeavyChain
gagaugcagcugguggaaagcggcgggggacucguccaacccggcgggucccugagacuuucuugcgccgcuagcggauucaccuuuuccucuuacuggaugagcuggguucggcaggccccuggcaaggggcuggaguggguggcggugaucuccuaugacggaaacaauaaauacuaugcugauucugucaagggccgcuucacaauuagcagagaaaacuccaaaaauacgcucuaccugcagaugaacagccuucgggccgaggacaccgccguguauuacugugcuaaggaucugggcgaaucugagaaugaggaaugggccuccgacuauuacgauuuugggagcgacuacccgggacaggauccccgcggcguuguggggacauucgacaucuggggacacggcaccauggucacagugucuucc

SEQ ID NO: 39833 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuugugccaugcacugggugcgccaggcgccuggaaagggccuugaaugggucgcugugaucagcuacgacgggaacaauaaacauuaugccgauuccguuaagggaagauucacaauuucucgggacaacagcaaaaauacgcuguaccuccagaugaacucccugcgcgccgaggauauggcuguguauuacugcgccaaggaccuuggcgaaagcgagaaugaagagugggcuucugauuauuacgacuuuuggagagauuauccgggccaagacccccgggggugggucggaaccuucgauaucuggggccaggggacaauggugaccguuuccagc

SEQ ID NO: 39834 - RNA, 432 nt, Artificial Sequence
  derived and/or modified sequence opt5 from anti-HIV-1_HeavyChain
caggugcaacuggucgagagcggcgggggaguugugcagcccggccggucccuccggcugucuugcgccgcuagcggguucaccuuuuccaacuacggaaugcacugggugcgccaggccccuggcaaggggcuugaaugggucacagugaucucuagcgacggauccaaaaaguauuacgcggauucuguuaaaggcagauucacgauuagccgggacaauuccaagaacacccuguaucuccagaugaauggccugcgcgcugaugacacagccguguacuauugugccaaagaucuuggggacagcgagaacgaagagugggcuucugauuacuaugacuuuggaagagauuacccgggccaagaccccagaggggucgugggagccuucgauaucuggggccaugggaccaugguuacaguguccagc

SEQ ID NO: 39835 - RNA, 432 nt, Artificial Sequence
  derived and/or modified sequence opt5 from anti-HIV-1_HeavyChain
caggugcaacuggucgagagcggcgggggaguugugcagcccggcgggucccucagacugucuugcgccgcuagcggauucaccuuuuccucuuacggcaugcacugggugcggcaggccccugggaagggacuugaaugggucgcguucauccgcuaugacggcagcaacaaauacuaugcugauuccgugaagggcagauuuacaauuucucgggacaauagcaaaaacacgcuguaccuccagaugaacucccugcgcgccguugauaccgccguguauuacugugcuaaggaccuuggggagggagaaaaugaggaaugggccacagauuauuacgacuucagcaucggcuacccggggcaagaucccagaggagucgugggcgcuuuugacauuugggggcagggaaccaugguuacagugucuucc

SEQ ID NO: 39836 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuucgcaacuacggaaugcacugggugagacaguccccuggcaaggggcuugaaugggucgccgugaucucuuaugacggaaaaauuaucaauuacauugauuucguuaagggccgguuuacaaucagccgcgagaacuccaaaaauacgcuguaucuccagaugaacucucugagagcggaagacaccgcuguguacuauugugccaaggaucuuggcgagagcgaaaaugaggagugggccuccgacuacuaugauuucgggagcgacuacccgggacaagauccccggggcgucguggggacauuugacauuuggggacauggcaccaugguuacagugucuucc

SEQ ID NO: 39837 - RNA, 432 nt, Artificial Sequence
  derived and/or modified sequence opt5 from anti-HIV-1_HeavyChain
gaggugcagcugcucgaaagcggcgggggacugguccaacccggcagaucccuucggcugucuugcgccgcuagcggguucaccuuuuccucuuacguuaugcacugggugcgccaggccccuggaaagggccucgaguggguggcggucaucagcuaugacggguccaacaaacauuacgcugauucugugaagggaagauucacaauuagccgggacaauuccaaaaacacgcuguaucuucagaugaauagccugcgcgccgaagauaccgccguuuacuauagagcuaaggaccucggcgagucugaaaacgaggagugggccuccgauuacuaugacuuuggccgggauuacccggggcaggacccccgcggaguggucggcgugcuguacaucugggggcaaggaacaaugguuaccgugagcucu

SEQ ID NO: 39838 - RNA, 432 nt, Artificial Sequence
  derived and/or modified sequence opt5 from anti-HIV-1_HeavyChain
gaggugcagcuggucgaaagcggcgggggacucguuaagcccggcgggucccugagacuuucuugcgccgcuagcggauucaccuuuuccacauacucuaugcacugggugcggcaagccccuggcaaagggcuggaguggguggcggucaucagcuaugacggaaacaauaaguacuaugcugauuccgugaaaggccgcuucacgauuucuagagaaaacagcaagaauacccucuaccugcagaugaacucccuucgggccgaggacacagccguuuaucauugugcuaaagaucugggcgaaagcgagaaugaggaaugggccucugacuacuaugauuuugggcgcgacuacccgggacaggaucccagaggcguggucgggaccuucgacaucuggggacacggcacaauggugaccguuuccagc

SEQ ID NO: 39839 - RNA, 432 nt, Artificial Sequence
  derived and/or modified sequence opt5 from anti-HIV-1_HeavyChain
caggugcaacuggucgacagcggcgggggaguugugcagcccggcagaucccuccggcuguucugcgccgugucuggguuuaccuucagcacauacacgaugcacuggguccgccaggcuccuggaagaggccuugaguggguggccguuaucuccuaugaugggucuaccaaguacuaugcggacagcgugcagggacgguuuacaauuucccgcgauaacucuaaaaauacccuguaccuccaaaugaacagccugagagcugaagacacagccgucuauuacugugccaaggaucuuggcgaguccgaaaaugaggaaugggcuagcgacuauuacgauuucggcucugacuacccggggcaggauccccgggccgugguuggagcuuuugacaucuggggccaggggaccauggugacagucuccagc

SEQ ID NO: 39840 - RNA, 426 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcuacgacggaaacaauaaauauuacgcugauuccguuaagggcagauuuacaauuucucgggagaacagcaaaaauacgcuguaucuccagaugaacucccugcgcccggaagacaccgccguguacuauugugccaaggaucuuggcgagagcgaaaaugaggagugggcuucugacuacuaugauuucgggagagacuaccccggacaagauccucggggcgucguggggacauuugacaucuggggacauggcaccaugguuacagug

SEQ ID NO: 39841 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucauguuuucccgcuacggaaugcacugggugagacaggccccuggcaaggggcuugaaugggucgcggugaucucucaugacggaagcaacaaauauuacgcugauuccguuaagggccgguucauuaucucucgcgacaauagcaaaaacacccuguaucuccagaugaacucccugagagccgaugacacagccguguacuauugugcuaaggaucuuggcgagagcgaaaaugaggaaugggccucugacuacuaugauuuuuggauuggguacccgggacaagacccccggggcgucgugggggcuuucgauaucuggggacagggcacgaugguuaccguguccagc

SEQ ID NO: 39842 - RNA, 432 nt, Artificial Sequence
  derived and/or modified sequence opt5 from anti-HIV-1_HeavyChain
caggugcaacuggucgagagcggcgggggaguugugcagcccggcgggucccucagacugucuugcgccgcuagcgccuucaccuuuuccucuuacggaaugcacugggugcggcaggcgccuggcaaggggcuugaaugggucgcuuucauccgcuaugacggaagcaacaaauacuaugccgauuccgugaagggcagauuuacaauuucucgggacaauagcaaaaacacgcuguuccuccagaugaacucccugcgcgccgaggauauggcuguuuacuauugugccaaggaccuuggcgaaagcgagaaugaagagugggcuucugauuacuaugacuuuuggagagauuacccggggcaagacccccggggaugggugggcaccuucgauaucugggggcagggaacaauggucaccguguccagc

SEQ ID NO: 39843 - RNA, 426 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcuacgacggauccaacaaauauuacguugauucugugaagggcagauuuacaauuagccgggacaauuccaaaaacacgcuguaucuccagaugaauagccugcgcgcugaggauaccgccgucuacgccaaggaccuuggcgaaucugagaacgaagagugggcuuccgauuauuacgacuucgggagcgauuauccgggacaagaccccagaggcgugguugggacauuugauaucuggucucagggaaccauggugacagucuccagc

SEQ ID NO: 39844 - RNA, 432 nt, Artificial Sequence
  derived and/or modified sequence opt5 from anti-HIV-1_HeavyChain
caggugcaacuggucgagagcggcgggggaguugugcagcccggcgggucccuccggcugucuugcgccgcuagcggauucaccuuuuccacauacggcaugcacugggugcggcaggccccugggaagggacuugacugggucgcguucauccgcuaugauggcucucauaaauacuaugcugacagcgugaagggcagauuuacgauuucccgggaaaacucuaaaaauacccuguaccuccagaugaacagccugcgcccggaggauacagccguuuauuacugugccaaggaccuuggggaauccgagaaugaagagugggcuagcgauuauuacgacuucggaagagauuaccccggccaagacccuagagggguggucggaaccuuugauaucuggggccacgggacaauggugaccguuucuucc

SEQ ID NO: 39845 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccggagauuacuaugccgacucuguuaaaggcagauucacaauuagccgggauaacuccaagagcacgcuguaccuccagaugaacucucugcgcccggaggacaccgccguguauuacugugcuaaagaucuuggcgaauccgagaaugaagagugggccagcgacuauuacgauuuugggagagacuaccccggacaagauccucggggcgucguggggacauucgacaucuggggacauggcaccaugguuacagugucuucc

SEQ ID NO: 39846 - RNA, 432 nt, Artificial Sequence
  derived and/or modified sequence opt5 from anti-HIV-1_HeavyChain
caggugcaccuggucgagagcggcgggggaguugugcaacccggcgggucccucagacugucuugcgccgcuagcggauucaccuuuuccacauacggcaugcagugggugcggcaggccccugggaagggacuugaaugggucgcguucaucaaaaacgacggcacgaaugaguuuuauggcgauucugugaaggggcgcuucaccauuagcagagacaacuccaaaaauacaguuucucugcauauggauagccuccggccggaagacaccgcucuguacuauugugccaaggaucuuggagaguccgaaaacgaggagugggccagcgacuacuaugauuuuggcucugacuaccccgggcaggauccucgcgcuguggucggagccuucgacaucuggggccaagggacaauggugaccguuuccagc

SEQ ID NO: 39847 - RNA, 432 nt, Artificial Sequence
  derived and/or modified sequence opt5 from anti-HIV-1_HeavyChain
caggugcaacuggucgagagcggcgggggaguugugcagcccggcgggucccucagacugucuugcguggccagcggauucaccuuuuccucuuacggcaugcacuggguccggcaggcuccugggaagggacuugaauggguggccuucauccgcuaugacggcagaaacaaauacuaugcggauagcguuaagggccgguuuacaauuucccgcgacaaaucuaagaauacgcugugucuccagaugaacagccugagaguggaggauaccgcugucuacuauugcgccaaagaccuuggggauuccgaaaaugaggaaugggccagcgacuacuaugauuucggacgggacuacccgggccaagauccccgcggggugguuggagcuuuugacaucuggggccaugggacaauggugaccgucucuucc

SEQ ID NO: 39848 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuauagagauucuguuaagggccgguucacaauuagccgcgacaauuccaaaaacacgguguaccugcagaugaauagccucagagcugaggauaccgccgucuauuacugugccaaggaccugggcgaaucugaguccgaagagugggcuagcgauuauuacgacuuugggcgggauuacccgggacaagacccccgcggcgugguuggggcccuugauaucuggggacagggcauuauggugacagucucuucc

SEQ ID NO: 39849 - RNA, 432 nt, Artificial Sequence
  derived and/or modified sequence opt5 from anti-HIV-1_HeavyChain
gaggugcagcuggucgaaagcggcgggggaaugguucaacccggcagaccucuccggcuguccugcgccgcuucuggguucaucuuuagcggauucggccuucacugggugcgccaggccccggggaagggacuggaguggguggcguccauuucuuacgacggcggcaacaaauauuacgcugauagcgucagagggcgguuuaccaucucccgcgacaauucuaagaacacacucuaucugcagaugaauagccuuagagccgaagauacggccguguacuauugugcuaaagaccugggagaguccgaaaacgaggagugggccagcgauuacuaugacuucggcucugauuaccccgggcaggacccucgggcuguugugggagccuuugauauuuggggccaagggaccauggucacaguguccagc

SEQ ID NO: 39850 - RNA, 432 nt, Artificial Sequence
  derived and/or modified sequence opt5 from anti-HIV-1_HeavyChain
gaggugcagcuggucgaaagcggcgggggaguugugcggcccggcgggucccuccggcugucuugcgccgcuagcggauucaccuuuaacgacuacggcauggccugggugcgccaagcgccugggaagggacuugagugggucgcugauaucuccuaugacggcucuaauaaauacuaugccgauagcgugaagggcagauucacaauuucccgggacaacucuaaaaauacgcuguaccuccagaugaacagccugcgcgccgaagauaccgcuguuuauuacugugccaaggaccuuggggaguccgaaaaugaggagugggcuagcgauuauuacgacuuuggaagagauuacccgggccaggaccccagagggguggucggagccuucgauaucuggggccaggggacaauggugaccguuucuucc

SEQ ID NO: 39851 - RNA, 429 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugguuagcuaugacgaguccaaauacuaugcugauucugugaagggaagauucacaaucagccgggacaacuccaaaaauacgcuguaccuccagaugaacagccugcgcgccgaagauauggccgucuauuacugugcuaaggaccuuggcgagucugaaaaugaggagugggccuccgauuauuacgaauuuuggagagacuacccgggccaagauccccgggggugggugggaaccuucgacauuuggggccaggggacaaugguuaccgugagcucu

SEQ ID NO: 39852 - RNA, 432 nt, Artificial Sequence
  derived and/or modified sequence opt5 from anti-HIV-1_HeavyChain
caggugcaacuggucgagcccggcagagggguugugcacccuggaggcagccuccggcuguccugcgugaccucuggguucacauuugaaaacuucccgaugcauuggguccgccaggcccccggaaagggccuugaguggguggcucugaucagcuacgacggguccgauaaauauuacucugacagcguuaagggaagauuuacgauuucccgggauaauucuaaaaacacccucuaucugcagaugaauagccuucgcgccgaagacacagcgguguacuauugugcuaaggaucugggcgaguccgaaaacgaggagugggccagcgacuacuaugauuucggcucugacuacccugggcaggaucccagaggagucgugggcaccuuugacaucugggggcacggaacaaugguuaccguguccagc

SEQ ID NO: 39853 - RNA, 432 nt, Artificial Sequence
  derived and/or modified sequence opt5 from anti-HIV-1_HeavyChain
caggcccaacugguggagagcggcgggggagucguucagcccggcagaucccuccggcugucuugcgcugccagcggguucuccuuugcgacccacgcuaugcauugggugcgcagaucuccuggaaagggccuugaauggguggccacaaucagcuacgggggcaaaaacgaguauuacgccgacuccgucaagggacgguucacgauuucucgcgaaaauagcaaaaacacccuguaucuccagaugaacucccugagagcugaggauacagccguguacuauugugcuaaggaccuuggcgaaagcgagaaugaggaaugggccucugauuacuaugacuuuggguccgauuacccgggacaggacccccggggcguuguggggaccuucgauaucuggggacacggcacaauggucaccgugagcucu

SEQ ID NO: 39854 - RNA, 432 nt, Artificial Sequence
  derived and/or modified sequence opt5 from anti-HIV-1_HeavyChain
gccgugcagcuggucgagagcggcgggggacucguuaagcccggcgggucccugagacuuucuugcgcugccagcggauucaccuuuuucaacacauggauguccugggugcggcaaucuccuggcaaagggcuggaauggguggcggacaucagcuacgauggauccaauaaguauuacgcugacucugucaaaggccgcuuuacgauuagcagagauaacuccaagaauacccucuaucugcagaugaacagccuucgggccgaggacacagccguguacuauugugcuaaagaucugggcgaaucugagaaugaagagugggccuccgacuacuaugauuucgggcgcgacuacccgggacaggaucccagaggcguugugggggucuuugacaucuggggacagggcaccauggugacaguuagcucu

SEQ ID NO: 39855 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuaugcugauucuguuaagggcagauucacaauuagccgggacaauuccaaaaacacgcuguaccuccagaugaauagccugcgcgccgaggauaccgccguguauuacugugcuaaggaccuuggcgaaucugagaacgaagagugggccuccgauuauuacgacuuugggagcgauuacccgggacaagaccccagagcugucgugggcgccuucgauaucugggggcagggaacaaugguuaccgugucuucc

SEQ ID NO: 39856 - RNA, 432 nt, Artificial Sequence
  derived and/or modified sequence opt5 from anti-HIV-1_HeavyChain
caggugagacuggucgagagcggcgggcggguugugcaacccggaggcucccuccgccugucuugcguggccagcggguucaccuuuuccucuuacggaauccacugggucagacaggcuccuggcaaggggcuugaaugggugacauucauuuggcaugacggacgggauacguauuacgccgacgcgguuaaaggccgcuuuaccaucagcagagauaacuccaagaauacacuguaucuccagaugaacucucugcgggcugaggacaccgccguguacuauugugccaaagaucuuggcgaaagcgagaaugaagagugggcuacagacuacuaugauuucuggaccggguacccgggacaggacccccgcgccgucgugggcgcuuuugauauuugggggcaaggaacaaugguuaccguguccagc

SEQ ID NO: 39857 - RNA, 432 nt, Artificial Sequence
  derived and/or modified sequence opt5 from anti-HIV-1_HeavyChain
caggugcaccuggucgagagcggcgggggaguugugcaacccggcagaucccuccggaucuacugcgccgugucugaguucaccuuucgcaacuaugcuaugcauugggucagacuggccccugggaagggacuucaguggguggcgguuauuagcuacgacggcuccaauaaauauuacggggauucugugaagggacgguucacaaucagccgcgacaacuccaaaaauacgcuguaucuccagauggauucucugagagcugaagacaccgccgucuacuauugugccaaggaucuuggcgaaagcgagaacgaagagugggcuuccgacuacuacgauuuuggccgggacuauccggggcaggauccccgcggagugguuggcacauucgacauuugggggcacggaaccauggugacagucagcucu

SEQ ID NO: 39858 - RNA, 432 nt, Artificial Sequence
  derived and/or modified sequence opt5 from anti-HIV-1_HeavyChain
gaggugcagcuggucgaaagcggcgggggacucguuaagcccggcgggucccugagacuuucuugcgccgcuagcggauucaccuuuuccgacgccuggaugucuugggugcggcaagcgccuggcaaagggauggaguggguggcugucaucagcuacgauggauccaacaaguauuacgccgacucugugaaaggccgcuucacaauuagcagagauaauuccaagaacacgcuguaucuccagaugaauagccugcgggccguugacaccgcuguguacuauugugccaaagaucuuggcgaaggggagaacgaagagugggcuacagacuacuaugauuuuucuaucggauacccgggccaggacccccgcggggucgugggagccuucgauauuuggggccaggggaccaugguuacaguguccagc

SEQ ID NO: 39859 - RNA, 432 nt, Artificial Sequence
  derived and/or modified sequence opt5 from anti-HIV-1_HeavyChain
gaggugcaggucguugaaagcggcgggggacuggugaagcccggcgggucccucagacugucuugcgaggccagcggauucaccuuuuccaacgcuuggaugucuugggugcggcaagccccuggcaaagggcuugaaugggucgcggugaucagcuacgacggaaauaacaaguauuacgcugauuccguuaaaggccgcuucacaauuucuagagagaauagcaagaacacgcuguaucuccagaugaacucccugcgggccgaagacaccgccguguaccacugugcuaaagaucuuggcgagagcgagaaugaagagugggccucugacuauuacgauuuugggcgcgacuauccgggacaggaucccagaggcgucguggggacauucgacaucuggggacauggcaccaugguuacaguguccagc

SEQ ID NO: 39860 - RNA, 432 nt, Artificial Sequence
  derived and/or modified sequence opt5 from anti-HIV-1_HeavyChain
caggugcaacuggucgagagcggcgggggaguugugcagcccggcgggucccucagacugucuugcgccgcuagcggauucaccuuuuccucuuacggcauccacugggugcggcaggccccugggaagggacuugaaugggucgcguucauucgcagcgacgcuacaaacaaauauuacgccgauuccgugaagggcagauuuacgaucucucgggagaauagcaaaaacacccuguaucuccagaugaacucccugcgcgccgaagacacagcuguuuacuauugugccaaggaucuuggcgagagcgaaaaugaggagugggcuucugacuacuaugauuucggguccgacuacccgggacaagaucccagaggcguggucgggaccuuugacauuuggggacauggcacaauggugaccguuagcucu

SEQ ID NO: 39861 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcuacgacggaaacaauaaauauuacgcugauuccguuaagggcagauuuacaauuucucgggagaacagcaaaaauacgcuguaucuccagaugaacucccugcgcgccgaagacaccgccguguacuauugugcuaaggaucuuggcgagagcgaaaaugaggagugggccucugacuacuaugauuucggguccgacuacccgggacaagaucccagaggcgucguggggacauuugacaucuggggacauggcaccaugguuacagugagcucu

SEQ ID NO: 39862 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccaacuacgccauggacugggugcgccaggcgccuggaaagggccuugaaugggucgcugugaucucuuaugaugggagcaauaaauacuaugccgacuccguuaagggaagauucacaauuucucgggauaacagcaaaaauacgcuguaccuccagaugaacucccugcgcgccgaggacaccgcuguguauuacugugccaaggaucuuggcgaaagcgagaaugaagagugggcuacagacuauuacgauuuuuggaccggcuacccggggcaagaccccagagccgucgugggagcguucgauaucuggggccaggggacaaugguuaccgugucuucc

SEQ ID NO: 39863 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugguuagcuaugacgaguccaacaaauacuaugcuggaucugugaagggcagauucacaaucagccgggauaauuccaaaaacacgcuguaccuccagaugaauagccugcgcaccgaagacauggccgucuauuacugugccaaggaucuuggcgagucugaaaacgaggagugggcuuccgacuauuacgauuuugggagagaauacccgggacaagacccccggggcuggguggggacauucgauauuuggggacagggcaccaugguuacagugagcucu

SEQ ID NO: 39864 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuauguugauucugugaagggcagauucacaauuagccgggacaauuccaaaaacacgcuguaccuccagaugaauagccugcgcgcugaggauaccgccgucuauuacugugccaaggaccuuggcgaaucugagaacgaagagugggcuacagauuauuacgacuuuuccaucggguacccgggacaagaucccagaggcgugguugggauuuucgacaucuggggacagggcaccauggugacagucagcucu

SEQ ID NO: 39865 - RNA, 432 nt, Artificial Sequence
  derived and/or modified sequence opt5 from anti-HIV-1_HeavyChain
caggugcaacuggucgagagcggcgggggaguugugcagcccggcagaucccuccggcugucuugcgccgcuagcggguucaccuuuuccacaucuggaaugcacugggugcgccaggccccuggcaaggggauggaaugggucgcggugaucagcuacgacggauccaacaaauauuacgcugauucuguuaagggcagauucacgauuagccgggacaauuccaaaaacacccuuuaucugcagaugaauagccuccgcgccguggauacagccgucuacuauugugcuaaggaccugggcgagggggaaaacgaggaaugggccaccgauuacuaugacuuuucuaucggauacccgggccaagaucccagaggggugguuggagcuuucgacauuuggggccaggggacaauggugaccgucuccagc

SEQ ID NO: 39866 - RNA, 363 nt, Artificial Sequence
  derived and/or modified sequence opt5 from anti-HIV_C38-VRC18.02_HeavyChain
caggugagacugguccaaagcggcaaccagguucggaagcccggggccuccgugcgcaucucuugcgaggcuagcggauacaaauucauugaccacuuuauccauugggugagacaggucccuggccacgggcucgaauggcugggauggauuaauccgcggggcgggggagugaacuauucccgcucuuuccagggcaaacuuagcaugaccaugacaagagauaauuuugaggaaacggccuaccuggaccucuccaagcugaaccccggcgauaccgcgguuuauuucugugcucggggguuugccggauacgaguggucuuucaucuggggccaagggacacuugugauugucagcucc

SEQ ID NO: 39867 - RNA, 396 nt, Artificial Sequence
  derived and/or modified sequence opt5 from anti-HIV_44-VRC13.02_HeavyChain
caggugcaacugguccagagcggcaccgcccucaagucccccgggucuagcgcuaaacuguccugcacaguucuuggagacgaguucggcacguacuuuaucucuuggauuagacaggccccugggcagggacuggaaugggugggcgggaucgugccgcacagccaacuccaguccucugcgcagaaguuccauggacggauuaucauuagcgcuggcgccggcgucacacccccugugguuucccugcagcuuaccaaccugaccuuugaggauacagggaccuauuucugugcccgcgaaagaggacggcaccgcgaccccaaaacaggcgaugcucucagagggcgguacuuugacuucuggggacgcggcaccgggcugagagugagcacg

SEQ ID NO: 39868 - RNA, 321 nt, Artificial Sequence
  derived and/or modified sequence opt5 from anti-HIV-1_LightChain
gacaucaagcugacccagagccccgccuuccucuccgcuucugugggcgagagagucacauuuacgugccgggccagccaagauauuucccacgaccugguuugguuccagcagaaagcggggcgcgcuccuucucuucugauguuuuacggaagcacccucgaaagaggcgugccgccccgguucuccgggcgcagaucuggaacagaguuuaccgugacaaucgauagccugcagccugaagacgucggcaccuauuacugucaacagcuuuccgccuucccccugacauuugggggaggcaccacgguggauauuaag

SEQ ID NO: 39869 - RNA, 321 nt, Artificial Sequence
  derived and/or modified sequence opt5 from anti-HIV-1_LightChain
gacaucaagaugacccagagccccgccuuccuguccgcuucugugggcgagagagucacauuuacgugccgggccagccaagauauuucccacgacguugugugguuccagcagaaaucugggagcgcgccuaagcuccugauguuuuacggauccacccuugaacgcggcgugccgcccagauucucugggcggcgcagcggaacagaguuuaccgucacaaucgauggccugcagccugaagacguggggaccuauuacugucaacagcucuccgcuuucccccugacauuuggaggcggcaccacgguugauauuaaa

SEQ ID NO: 39870 - RNA, 321 nt, Artificial Sequence
  derived and/or modified sequence opt5 from anti-HIV-1_LightChain
gacaucaagcugacccagagccccgccuuccucuccgcuucugugggcgagagagucacauuuacgugccgggccagccaagauauucgccacgaacugguuugguaccagcagaagccugggagaggaccgaaacuucugaucuauuacggcuccacccucgaagggggagugcccucucgguucagcggccgcagauccgggacagaguuuaccgugacaauuucuagccugcagccugaggacgucggaaccuauuacugucaacagcuuaacuccuucccccugacauuuggcggcgggaccacgguggauauccgg

SEQ ID NO: 39871 - RNA, 321 nt, Artificial Sequence
  derived and/or modified sequence opt5 from anti-HIV-1_LightChain
gacauccagcugacccaaagccccuccuuccucucugccagcgugggcgauagagucuccauuacaugccgggcuucucaggggaucaagcacgagcuggccugguaccagcagaaaccuggacgcgcgccgagccuucugauuuauuacgcuuccacgcucgccagaggcguucccucucgguuuagcgccuccuggagcgggacccuguucacacuuaccaucaauggacugcaaccugaagacuuugcuacauauuucugucagcagaugaacucucucccccugaccuuuggcgggggaacaaagauggaugugcgc

SEQ ID NO: 39872 - RNA, 321 nt, Artificial Sequence
  derived and/or modified sequence opt5 from anti-HIV-1_LightChain
gacauccagcugacccaaagccccuccuuccucucugccagcgugggcgauaaggucacaauuacgugcagagcuucccacgggguucggaacgagcuggccugguaccagcagaaaccuggaaaggcgccgaaucuucugaucuauuacgcuucuacccuccagagcggcgugcccucccgcuuuucugccacagggagcggaacccauuucacacugaccguguccagccuucaaccugaagacuuugccacauauuucugucagcacaugucuuccuacccccugaccuuuggcgggggaacgaaagucgagauuaag

SEQ ID NO: 39873 - RNA, 321 nt, Artificial Sequence
  derived and/or modified sequence opt5 from anti-HIV-1_LightChain
gacauccagcugacccaaagccccuccuuccucucugccagcgugggcgauaaggucacauuuacgugcagagcuucccaggggguucggaacgagcuggccugguaccagcagaaaccuggaaaggcgccgaaucuucugauuuauuacgcuucuacccuccaaagcggcgugcccucccgcuucucugccacagggagcggaacccacuuuucccugacagugagcucucuucagccugaagacuucgccaccuauuuuugucagcauauguccagcuacccccugacauucggcgggggaaccaaagucgagaucaag

SEQ ID NO: 39874 - RNA, 321 nt, Artificial Sequence
  derived and/or modified sequence opt5 from anti-HIV-1_LightChain
gacauccagcugacccaaagccccuccuuccucucugccagcgugggcgauaaggucacaauuacgugcagagcuucccaggggguucggaacgagcuggccugguaccagcagaaaccuggaaaggcgccgaaucuucugaucuauuacgcuucuacccuccaaagcggcgugcccucccgcuuuucugccacagggagcggaacccacuucacacugaccguguccagccuucagccugaagacuuugccacauauuucugucagcauaugucuuccuacccccugaccuuuggcgggggaacgaaagucgagauuaag

SEQ ID NO: 39875 - RNA, 366 nt, Artificial Sequence
  derived and/or modified sequence opt5 from anti-HIV-1_HeavyChain
agccaguaccuggcccaacccggcgcugagguggccaagccuggggcguccgucaaaguuucuugcaaggugcacggagacaacuucagaggccauuaucuccacugggugcggcaggcuccggggcagggacugcaguggaucggcgggauuaaucccuuuagcggagaagccgccuacggcaaacgcuucgagggcagacuucggcugacccgcgauacauccgucaacacggcuuauauggaacucgccaagcugaccccugacgauacagcuguguacuuuugugccagagacaaaaccuauaaugaugaguucacagcgauggacaucugggggcauggaaccacaguuauugugucuagc

SEQ ID NO: 39876 - RNA, 366 nt, Artificial Sequence
  derived and/or modified sequence opt5 from anti-HIV-1_HeavyChain
agccaguaccuggcccaacccggcgcugagguggccaagccuugggcguccgucaaaguuucuugcagagugcacggggacaacuuccggggauuuuaucuccauugggugcgccaggcuccgggccaggggcuggaauggaucggaggcauuaaucccuucagcggggaggccgccuacggaagacgguuugaaggccgccuuagacugacccgggauacauccaucaacacggcuuauauggaggucaccaagcucacaucugacgauaccgccguguacuucugugcucgcgacaaaacauauaaugaugaauuuaccgccauggacauuuggggccaggggacaaccguuaucgugagcucc

SEQ ID NO: 39877 - RNA, 366 nt, Artificial Sequence
  derived and/or modified sequence opt5 from anti-HIV-1_HeavyChain
agccaguaccuggcccaauccggcucugaggugaagaaacccggggcuagcgucaagguuuccugcagacuccacggagacaaauucggcgcccauuauauccacugggugcggcaggcgccugggcagggacuggaauggcuuggcuuuuuccauccggggaccggagaugcugugucugcccagaaguuucaaggccgcauuagccugacaagagacacguccaucucuaccggcuaccucgagguccggcgccugagcuccgaugacacagccguguauuacugugcuagagauaaaaccuauagcgacgaagccacagggauggauauuuggggacagggcaccacaguuaucgugucuucc

SEQ ID NO: 39878 - RNA, 366 nt, Artificial Sequence
  derived and/or modified sequence opt5 from anti-HIV-1_HeavyChain
agccuggagcucgugcaguccggcaccgaagucaagaaacccggggccucuguuaaggugagcugcaaacuguucggagacacaaucacguccggcccuauucacugggugagacaagcuccggggcagggacuugaguggaugggcuggaccaacccccauucuggggauacagccaccgcgccuaaguuucagggacgggucuacaugacaaaugacaaaaagaucaacaccgcuuuccuggaugugacacgccucgccagcgacgauaccgccauuuauuuuugugcuagagacauguacuauuccaaugaagccguuggcauggauguguggggccaggggacgaccgucucugugagcucc

SEQ ID NO: 39879 - RNA, 366 nt, Artificial Sequence
  derived and/or modified sequence opt5 from anti-HIV-1_HeavyChain
caggaggugcugguccaaagcggcgccgaaguuaagaaacccggggcuuccgugaaggugucuugcagagccuucggauacaccuuuacagcgcacgcucuccauuggguccggcaggccccuggccaggggcuggaguggcuuggauggaucaacccgcacagcggcgacacgaccacaucccagaaauuccaagggcgcguguauaugaccagagauaagucuauuaauacagccuaccuggaaguuacccggcucacaagcgacgauaccgcuaucuuuuauugugcccgcgacaaauacuauggagaugaggcugugggcauggacgucuggggccaggggacguccgugaccguuucuagc

SEQ ID NO: 39880 - RNA, 366 nt, Artificial Sequence
  derived and/or modified sequence opt5 from anti-HIV-1_HeavyChain
caggaggugcugguccaaagcggcgccgaaguuaagaaacccggggcuuccgugaaggugucuugcagagccuucggauacaccuuuacaggcaacgcgcuccacuggguccggcaggcuccugggcagggacuggaguggcuuggcuggaucaauccgcauagcggggacacgaccacaucccagaaauuccaaggacgcguguauaugaccagagauaaggccauuaacacagccuaccuggacguuacccggcucacaucugaugacaccgcuaucuauuacugugcccgcgauaaauauuacggcaaugaagcugugggcauggacgucugggggcagggaacgagcgugaccguuuccucu

SEQ ID NO: 39881 - RNA, 366 nt, Artificial Sequence
  derived and/or modified sequence opt5 from anti-HIV-1_HeavyChain
caggaggugcugguccaaagcggcgccgaaguuaagaaacccggggcuuccgugaaggugucuugcagagccuucggauacaccuuuacaggcaacgcgcuccacuggguccggcaggcuccugggcagggacuggaguggcuuggcuggaucaauccgcauagcggggacacgaccacaucccagaaauuccaaggacgcguguauaugaccagagauaagucuauuaacacagccuuucuggacguuacccggcucacaagcgaugacaccggcaucuacuauugugcccgcgauaaauacuauggcaaugaagcuguggggauggacgucuggggacagggcacguccgugaccguuucuagc

SEQ ID NO: 39882 - RNA, 303 nt, Artificial Sequence
  derived and/or modified sequence opt5 from anti-HIV_45_LightChain
agccugacccagucccccggcacacucucucugagcccuggggagacggccaucauuuccugcagaaccucucaauacggaagccuugcuugguaucagcagcggccgggccaggcgccccgccuggugaucuacuccgggucuacaagagccgcuggcauuccugaccgguucagcggaucccgcugggggcccgauuauaaccucaccaucagcaaucuggaaucuggagacuuuggcgucuacuauugucaacaguacgaguucuuuggccaggggacaaagguucagguggauauuaaa

SEQ ID NO: 39883 - RNA, 303 nt, Artificial Sequence
  derived and/or modified sequence opt5 from anti-HIV_45_LightChain
gugcugacccagagccccggcacacucucccugucuccuggggagacggccaccaucagcugcagaacaucccaauacggaucucuugcuugguaucagcagcggccgggccaggcgccccgccuggucauuuacagcggguccaccagagccgcuggaaucccugaccgguucucuggcagccgcuccgggcccgauuauacacucaccauuagcaaccuggaaucuggagacuuuggcguuuacuauugucaacaguacgaguucuuuggccaggggacaaaggugcagcaagauaauaaa

SEQ ID NO: 39884 - RNA, 303 nt, Artificial Sequence
  derived and/or modified sequence opt5 from anti-HIV_45_LightChain
gugcugacccagagccccggcacacucucccugucuccuggggagacggccaucauuagcugcagaaccucccaauacggaucucuugcuugguaucagcagcggccgggccaggcgccccgccuggugaucuacagcggguccacaagagccgcuggcauuccugaccgguucucuggaagccgcugggggcccgauuauaaccucaccaucuccaaucuggaaagcggagacuuuggcguuuacuauugucaacaguacgaguucuuuggccaggggacaaagguccagguggauauuaaa

SEQ ID NO: 39885 - RNA, 363 nt, Artificial Sequence
  derived and/or modified sequence opt5 from anti-HIV_45_HeavyChain
caggugagacugagccaauccggcgggcagaugaagaaacccggagagucuaugcggaucagcugccgcgccuccggcuacgaguucauugacuguacccucaacuggaucagacuggcuccugggcggcgcccggaauggaugggauggcuuaagcccagaggcggggccgucaauuaugcgcggguuuuucagggacgcgugacaaugacgagagauguguacucugacaccgcuuuccuggaacuccggagccugacagccgaugacaccgccgucuauuuuugcacacgcggcaaaaccguggauuacaacugggacuucgagcacguuggcccugggacacccgugaccgucuccucu

SEQ ID NO: 39886 - RNA, 363 nt, Artificial Sequence
  derived and/or modified sequence opt5 from anti-HIV_45_HeavyChain
caggugagacugagccaauccggcgggcagaugaagaaacccggagagucuaugcggaucagcugccaggccuccggcuacgaguucauugacuguacccucaacuggguccgccuggcuccugggagacggccggaauggaugggauggcuuaagccccgcggcggggccguuaauuaugcgagaaucuuucagggacgggugacaaugacgcgcgauguguacucugacaccgcuuuccuggaacucagaagccugacagccgaugacaccgccgucuauuuuugcacacggggcaaaaacugugauuacaauugggacuucgagcacgugggcccuggguaucccguuaccguguccccu

SEQ ID NO: 39887 - RNA, 375 nt, Artificial Sequence
  derived and/or modified sequence opt5 from anti-HIV_45_HeavyChain
caggugagacugagccaauccggcgggcagaugaagaaacccggagacucuaugcggaucagcugccgcgccuccggcuacgaguucauuaacuguccuaucaauuggauuagacucgcuccggggaagcggcccgaauggaugggauggaugaaaccucgcggcggggccgucucuuaugcgagacagcugcagggacggguuaccaugacacgcgauauguacagcgagacggcuuuucuugaacugagaucccucaccucugacgauacagccguguauuucugcacccggggcaaguacuguacagcccgcgacuauuacaacugggauuuugagcacuggggccaagggacccccgugacagucagcucc

SEQ ID NO: 39888 - RNA, 435 nt, Artificial Sequence
  derived and/or modified sequence opt5 from anti-HIV_cap256-206-252885_VR-Chain
caggagcaacugguggaaagcggcgggggagucguucccccuggcuccucucucacccugagcugcguggccucccgguucacauuuucugcuuucgggaugcacugggugcggcaggccccgggaaagggccuugagugggucgcgggggugagcuuuguuggaaucaaaaaguacuaugcugacuccgugaaaggccgcuucacgauuucuagagauaacagcaagaauacccuguuucuccagaugaacggccugcgcggggaagacacaggacuuuacuauugugucaaagauaugcgguaccuggagugcgaagagugggccuccgacuauuacgauuucggcaagcccaaucagccuugucucgacagaagaggggugagcggaaucucugccuuuuggggccaagggaccacaguuaccguguccagc

SEQ ID NO: 39889 - RNA, 438 nt, Artificial Sequence
  derived and/or modified sequence opt5 from anti-HIV_cap256-206-249183_VR-Chain
caggugcugcucgucgagagcggcgggggaguuguggaacccggcaccucccugacacuuucuugcgccgcuagcagauucacguuuuccaacuucgggaugcacugggugcggcaaaccccuggaggcgggcuggagugggucgccucuaucagcaaugaaggaaacaagaaauaccaugcggaguccguguggggccgcuuuauuaucucuagagacaauagcaagaacacaguuuuccuccacauguccagccugcggccggaugacucugcucuuuauuuuugugugcgcgauagacaggaagacgauugcgaggucuggugguccgacuacgaggccuucggccgggaaauucccugucgccaguauagagggcagggacuggccggcaucuuugauauuugggggcggggaaccauggugacaguuagcucu

SEQ ID NO: 39890 - RNA, 438 nt, Artificial Sequence
  derived and/or modified sequence opt5 from anti-HIV_cap256-206-220956_VR-Chain
cagaugaugcugguggagagcggcggggacgucguugaacccggaagaucccucacccugucuugcgccacaagccaauucacguuuuccaacuacggcaugcacugggugcggcaggcuccugggcgcggacuugaguggguggccucuaucagcaaugaaggcaacaagaaauaucaugcggaguccgucugggggagacugauuaucucucgggauaauagcaagaacacccucuuccugcacauguccagccuucgcgcugacgauucugcccuguacuuuugugugagagaccggcaggaagaugagugcgaggaauggugguccaauuauuacgccuucggacgcggcggcccguguagaaaauaucgggggcagggacucgcuggcauuuuugacguuugggggcgcggaacaauggugaccgucagcucu

SEQ ID NO: 39891 - RNA, 432 nt, Artificial Sequence
  derived and/or modified sequence opt5 from anti-HIV_cap256-206-220629_VR-Chain
caggagcaacugguggaaagcggcgggggagucguucccccuggcaagucccucaaacugucuugcguggccagcagauucuccuuuggggcuuucggaaugcacugggugcggcaggccccgggcaaggggcuugagugggucgcgggaaucucuuuugcuggcauuaaaaaguacuauggcgacagcgugaaagggcgcuucuacaucuccagagauaacucucagaauacccuguuucucgaaaugaacggacugcggggcgacgauacagcccgcuauuacuguguuaaggaccuuagagagcuggaaugcgaggagugggccagcgauuauuacgacuucgggaagccccagccuugucucgauucccggggagugagcggcauuucugcuaugugggggcccggaacgauggucaccguguccagc

SEQ ID NO: 39892 - RNA, 381 nt, Artificial Sequence
  derived and/or modified sequence opt5 from anti-HIV_cap256-206-200599_VR-Chain
caggagaagcugguggaaagcggcgggggagccguccaacccggcgggucccucagacugucuugcguugcuagcggauucaccuuuaacggcuucgggaugcacugggugcggcaggccccuggaaaaggccuugaguggguggcgacaaucuccuuuucuggcgucuacauuagccgcgaaaauuccaagaacacgcuguaucuccagaugaaugggcugagaggagaggacaccgcucuuuacuauugugccaaagaucugcgguaccucgaaugcggcgaguggucuacauauuacccgcagcccugucuggacacccgcggggugagcggaaucuccaacguuuggggcccugggacaagagugaccgucagcucu

SEQ ID NO: 39893 - RNA, 432 nt, Artificial Sequence
  derived and/or modified sequence opt5 from anti-HIV_cap256-206-186347_VR-Chain
caggagcugcucguggaaagcggcgggggagucguucccccuggcaagucccugaccaucucuugcguggccagcagauucacauuuuccgcuuucgggaugcacugggugcggcaagccccgggaaaaggccuucagugggucgcgucuauuagcuuugcugggacgaagaaauacuaugccgacuucgugaagggacgcuuuaccaucuccagagauaacucuaaaaauacaauuuuccugcagaugaacggccuccggggcgaggacaccgcccuguaccauuguguuaaggauaugcgccagcuugaaugcgaggaauggacaagcgacuauuacgauuuugggagaccccaaccuuguaucgaccggcgcggaguguccggcauuagcgcuaugugggggcccggaaccauggucacagugucuucc

SEQ ID NO: 39894 - RNA, 438 nt, Artificial Sequence
  derived and/or modified sequence opt5 from anti-HIV_cap256-206-186226_VR-Chain
cagaugcugcucguggagagcggcgggggagucguugaacccggcagaucccugacccuuucuugcgccacaagccaauucacguuuuccaacuacgggaugcacugggugcggcagaccccuggaacaggccuggaguggguggcuucuaucagcaaugaagggaacaagaaauaucauggagaggccgucuggggccgcuucauuaucuccagagacaauucuaagaaaacccucuuucugcacaugagcaaccuucgggcggaugacuccggccuguacuucugugugcgcgauagacaggaagacgagugcgaggaaugguggagcgauuauuacucuuuugggcggggaggcccgugucgcaaguaucaugggcagggacucgcuggcauuuucgacaucugggggagaggaacacugguuaccguguccagc

SEQ ID NO: 39895 - RNA, 435 nt, Artificial Sequence
  derived and/or modified sequence opt5 from anti-HIV_cap256-206-179686_VR-Chain
caggagcaacugguggaaagcggcgggggagucguucccccuuggaagucccucacccugucuugcgaggccagccgguucacauuuuccgcuuucggcaugcacugggugcggcaggccccggggaaaggacuugaauggguggcgggcaucucuuuugcugggauuaagaaauacuaugccgacagcgucaagggacgcuucuuuaucuccagagauaacucuaaaaaucgggugcugcucgagaugaacggccugcgcagagaagacacggcccgguacuucuguguuaaggaucuucgcgagcuggagugcgaagagugggcuagcgacuauuacgauuuuggcaagcccaaucagccuugucucgacagaagagggguguccggaauuagcgccauguggggccaggggaccauggucacagugucuucc

SEQ ID NO: 39896 - RNA, 417 nt, Artificial Sequence
  derived and/or modified sequence opt5 from anti-HIV_cap256-206-173707_VR-Chain
caggagaagcugguggaaagcggcgggggagccguccaacccggcgggucccucagacugucuugcguugcuagcggauucaccuuuaaaggcuucgggaugcacugggugcggcaggccccuggaaagggccuugaguggguggcgacaaucuccuuuucuggcgucaaaaaguacuaugggaacagcgcuaaaggacgcuucuuuauuuccagagacaaucugaagaacacgguguaccucgaaaugaauggccugcgcggggaggauaccgcccuuuauuacugugccaaggaccugcgguaucucgaaugcggagaguggucuacauacuauccgcagcccugucuggauaccagaggcguuagcgggaucuccaacguguggggaccuggcacaaaagucaccgugagcucu

SEQ ID NO: 39897 - RNA, 432 nt, Artificial Sequence
  derived and/or modified sequence opt5 from anti-HIV_cap256-206-173339_VR-Chain
caggagcugcucguggaaagcggcgggggagucguucccccuggcaagucccugaaacuuucuugcguggccagcagauucaccuuuggggcuuucggaaugcacugggugcggcaagccccgggcaaggggcuggagugggucgcgggaaucuccuuugcuggcacgaaaaacuacuaugccgacucugugaagggccgcuucacaauuagcagagauaaucccaaaaacacccucuuucugcagaugaaugggcuucggggagacgauacaggccuguacuauuguguuaaggacaugcgcgaacucgagugcgaacuguggaccuccgauuacuaugacuucgggagaccucagcccuguaucgaucagcggggagugucuggcauuagcgccaugugggggcaaggaacaauggucaccaucuccagc

SEQ ID NO: 39898 - RNA, 438 nt, Artificial Sequence
  derived and/or modified sequence opt5 from anti-HIV_cap256-206-172689_VR-Chain
cagaugaugcugguggagagcggcgggggagucguugaacccggcagaucccucacccugucuugcgccacaagccacuucacguuuuccaacuacgggaugcauugggugcggcaagcuccuggaggccgccuugaguggguggccucuaucagcaaugcggggaacaagaaauaucacggagacuccgucuggggcagacugauuaucucucgggauaauagcaagaacacccucuuccugcauauguccagccuucgcguggacgauucugcucuguacuuuuguguuagagaccggcaggaagaugagugcgaagaguggugguccgacuauuacgccuucggccgcgggggaccguguagaaaauaucggggccaggggcucgccggaauuuuugauaucuggggccgcgggacaauggugaccgucagcucu

SEQ ID NO: 39899 - RNA, 432 nt, Artificial Sequence
  derived and/or modified sequence opt5 from anti-HIV_cap256-206-162744_VR-Chain
caggagaagcugguggaaagcggcgggggagucguucccccuggcaaaucccucagacugucuugcguggccagcggguucaccuuuuccgcuuucggaaugcacugggugcggcaagccccgggcaaggggcuugagugggucgcgggaaucucuuuugcuggcauuaaaaacuacuaugccgacagcgugaagggccgcuucacaaucuccagagauaauucuaaaaacagccuguuucuccagaugaaugggcugcggggagacgauacggcccgcuacuauuguguuaaggacaugagagaacuugagugcgaagaguggaccuccgauuacuaugacuucggcaagccccagccuuguauugaucggcgcggggugagcggaaucucugcuauguggggccaggggacaauggucaccauuuccagc

SEQ ID NO: 39900 - RNA, 438 nt, Artificial Sequence
  derived and/or modified sequence opt5 from anti-HIV_cap256-206-146057_VR-Chain
cagaugcaacugguggagagcggcgggggagucguucagcccggcaccucccucacacugucuugcguggccagccaguucacguuuuccaacuacgggaugcacuggaucagacaggcuccuggacaaggccuugaauggguggccucuauuagcaaugacgggggaaagcgguaucauggcgaugcggucugggcucgcuucaucauuuccagagacaacucuaaaaauaccguguuucugcagaugacaagccuccgggccgaggauaccgcccgcuacuucuguguuagagaccggcaggaagaugagugccuggaauggugguccgacuauuacaacuuuggccgccagcuuccgugugcuaaguucagagggcugggacucgccggcguguuugauaucugggggcacggaacaauggucaccgugagcucu

SEQ ID NO: 39901 - RNA, 435 nt, Artificial Sequence
  derived and/or modified sequence opt5 from anti-HIV_cap256-206-139519_VR-Chain
caggagcaacugguggaaagcggcgggggagucguucccccuggcaccucccucagacugucuugcguggccagccgguucuccuuugggucuuucggaaugcacugggugcgccaggcuccgggcaaggggcuugagugggucgccggaaucagcuuugugggcauuaaaaaguacuauggcgacuccguuaaagggagauucuuuaucucucgggauaacagcaagaauacacuguuccucgaaaugaacggacugcgcggcgaggacacggcgagauacuauugugugaaagauaugcgggaacuugagugcgaggaaugggcuuccgacuacuaugauuuugggaagcccaaucagccuugucuggaccgcagaggagucagcggcauuucugccaugugggggcccggaaccaugcucacaguguccagc

SEQ ID NO: 39902 - RNA, 432 nt, Artificial Sequence
  derived and/or modified sequence opt5 from anti-HIV_cap256-206-136316_VR-Chain
caggagcaacugguggaaagcggcgggggagucguucccccuggcaagucccucacccugucuugcguggccagcggguucacauuuuccgcuuucggaaugcacugggugagacaggccccgggcaaagggcuugagugggucgcgggaaucucuuuugugggcauuaagaaauacuauggcgacagcguuaaggggcgguucacgaucucccgcgauaacucuaaaaauacccuguuucuccagaugaacggacugagaggcgacgauacagcucuuuaccauugugugaaggacaugcggcagcuggaaugcgaggaauggaccagcgauuauuacgacuucgggaagccccaaccuuguauugauccccgcggagucuccggcaucagcgccaugugggggcagggaacaauggugaccguuucuucc

SEQ ID NO: 39903 - RNA, 438 nt, Artificial Sequence
  derived and/or modified sequence opt5 from anti-HIV_cap256-206-116098_VR-Chain
cagaugaugcugguggagagcggcgggggagucguugaacccggcagaucccucacccugucuugcgccgcuagccaauucacauuuuccaacuacgggaugcacugggugcggcaggccccuggacgcgagcuugaauggguggcgucuaucagcaaugcuggcaacaagaaauaucauggggaggccgucuggggaagacugauuaucucccgggacaauucuaagaacacccucuuccugcacaugagcaaucuucgcccggaugacuccgcccuguacuuuugugugagagaucggcaggaagacgagugcgaggaaugguggagcgauuauuacgcuuucggccgcggcgggcccuguagaaaauaucauggacagggccucgccgggauuuuugacaucuggggacggggcacgaugguuacagugucuucc

SEQ ID NO: 39904 - RNA, 432 nt, Artificial Sequence
  derived and/or modified sequence opt5 from anti-HIV_cap256-206-115862_VR-Chain
caggagcaacugguggaaagcggcgggggagucguucccccuggcaagucccucagacugucuugcguggggagccgguucaccuuuuccgccuucggaaugcacugggugcgccaggcuccgggcaaagggcuugagugggucgccucuaucagcuuugcgggaacaaagaaauacuauguggacuccguuaagggcagauucuuuauuucucgggauaacagcaaaaauacgguguuccuggaaaugaacggccuccgcggggaggacaccggacuguacuauugugucaaggauaugagagaacuugagugcgaggaaugggcuuccgacuacuaugauuuuggcaagccccagccuugucuggaccggcgcggggugagcggaaucucugccauguggggccaggggacacucguuauuaucuccagc

SEQ ID NO: 39905 - RNA, 435 nt, Artificial Sequence
  derived and/or modified sequence opt5 from anti-HIV_cap256-206-107018_VR-Chain
caggagcaacugguggaaagcggcgggggagucguucccccuggcaagucccucacccugucuugcguggccagccgguucuccuuuucugcuuucgggaugcacugggugcggcaggccccgggaaaaggccuugagugggucgcgagcaucuccuuuguggggauuaagaaauacuauggagacucuguuaagggccgcuucuuuaucagcagagauaacuccaaaaauacaguguuccuggaaaugaacggccuccgcggggaggacacgggacuguacuauugugucaaggauaugcgggaacuugagugcgaggaaugggcuagcgacuacuaugauuuuggcaagcccaaucagccuugucuggacagaagaggggugucuggaauuuccgccauguggggccaggggacccucguuaucgugagcucu

SEQ ID NO: 39906 - RNA, 438 nt, Artificial Sequence
  derived and/or modified sequence opt5 from anti-HIV_cap256-206-098644_VR-Chain
cagaugcugcucguggagagcggcgggggagucguugaacccggcagaucccugacccuuucuugcgccgcuagccaauucacauuuuccaacuacgggaugcacugggugcggcaggccccuggaggcgggcuggaguggguggcgucuaucagcaaugaaggaaacaagcgcuaucauggcgaguccgucuggggcagauucgugauuucucgggacaauagcaaaaacacgcucuuucugcacauguccacccuucgcccggaugacagcgcucuguacuucuguguuagagaucggcaggaagacgagugcgaggaaugguggucugauuauuacgccuuugggcgcggaggccccuguagaaaguaucaugggcagggacucgccggcaucuucgacgugugggggcggggaacaauggucaccggccuguuu

SEQ ID NO: 39907 - RNA, 417 nt, Artificial Sequence
  derived and/or modified sequence opt5 from anti-HIV_cap256-206-098135_VR-Chain
caggagaagcugguggaaagcggcgggggagccguccaacccggcgggucccucagacugucuugcguugcuagcggauucaccuuuuccggcuucgggaugcacugggugcggcaggccccuggaaaaggccuugaguggguggcgacaaucucuuuuagcggcaugaagaaauacuaugggacguccgcuaagggacgcuucucuauuuacagagacaacagcaaaaauacccuguaucuccagauggauggccugcgggaaaaggacacagcccuuuacuauugugccaaggaucugcgcuaccucgagugcggggaaugguccaccuauuacccgcagcccugucuggacagacggggagucagcggcaucucuaacgugugggggccuggaacaaugguuaccguguccagc

SEQ ID NO: 39908 - RNA, 435 nt, Artificial Sequence
  derived and/or modified sequence opt5 from anti-HIV_cap256-206-096276_VR-Chain
caggagcaacugguggaaagcggcgggggagucguucccccuggcuccucucucagacugagcugcguggccucccgguucaccuuuucugcuuucgggaugcacugggugcgccaggccccgggaaagggccuugagugggucgcggggaucagcuuugugggaauuaaaaaguacuaugcugacuccguuaaaggcagauucacaaucucucgggauaacagcaagaauacgcuguuucuccagaugaacggccugcgcggggaagacaccggacuuuacuauugugugaaagauaugagagagcuggaaugcgaggaguggcgguccgacuacuaugauuucggcaagcccaaucagccuuaccucgaccgcagaggggucagcggaauuucugccuuuuggggccaagggacaauggugaccguuuccagc

SEQ ID NO: 39909 - RNA, 438 nt, Artificial Sequence
  derived and/or modified sequence opt5 from anti-HIV_cap256-206-092794_VR-Chain
cagaugaugcugguggagagcggcgggggagucguugaacccggcagaucccucacccugucuugcgccacaagccaauucacguuuuccaacuacgggaugcacugggugcggcaggcuccuggacgcggccuugaguggguggccucuaucagcaaugaagggaacaagagauaucauggagaguccgucuggggccgguucauuaucucucgcgacaauagcaaaaacacccuguuucuccacauguccacacugagagcggaugacagcgcucuuuacuucugugugcgggaucgccaggaagacgagugcgaggaaugguggucugauuauuacgccuuuggcagagggggaccgugucggaaguaucauggccaggggcuggccggaauuuucgacaucguuggccgcgggacccucgugacagucuccagc

SEQ ID NO: 39910 - RNA, 432 nt, Artificial Sequence
  derived and/or modified sequence opt5 from anti-HIV_cap256-206-086817_VR-Chain
caggagcaacugguggaaagcggcgggggagucguucccccuggcaagucccucagacugucuugcgccgcuagcggguucuccuuuggagccuucggcaugcacugggugcggcaggcgccggggaaaggacuugaguggguggcuggcaucucuuuugucggcauuaaguacuauuacgccgacagcgugaaagggcgcuucaccaucuccagagauaacucuaagaauacaguuuuucugcagaugaacggacuccggggcgacgauacggggcgcuauuacugugugaaagacaugagagaacuggagugcgaagaguggaccagcgauuauuacgacuucggaaagccccagccuuguauugaucggcgcggcgucuccgggaucagcgccauguggggacaaggcacaauggugaccauuucuucc

SEQ ID NO: 39911 - RNA, 432 nt, Artificial Sequence
  derived and/or modified sequence opt5 from anti-HIV_cap256-206-086446_VR-Chain
caggagcaacugguggaaagcggcgggggagucguucccccuggcaagucccucagacugucuugcguggccagccgguucaccuuuuccgcuuucgggaugcacugggugcgccaggccccgggaaaaggccuugagugggucgcggggaucucuuuugugggaauuaagaaauacuauagcgacgcuguuaagggcagauucuacaucucccgggauaacucuaaaaauacacuguuucucgaaaugaacggccugcgcggggacgauacggccagauauuacugugugaaggaccuucgggagcuggaaugcgaggagugggccagcgauuauuacgacuucggaaagccccagccuugucucgauucccgcggcgucagcgggauuucugcuauguggggacagggcaccauggugacaguuuccagc

SEQ ID NO: 39912 - RNA, 432 nt, Artificial Sequence
  derived and/or modified sequence opt5 from anti-HIV_cap256-206-086180_VR-Chain
caggagcaacuggaagagagcggcgggggagugguucccccuggcaagucccuccggcugucuugcgucgccagccgguucaccuuuuccgcuuucgggaugcacugggugcgccaggccccgggaaaaggccuugaauggguggcggggaucucuuuugucggaauuaagaaauacuaugcugacagcgugaagggcagauucacaaucucccgggauaacucuaaaaauacgcuguuucuccagaugaacggccugcgcggggacgauaccggacuuuacuucuguguuaaggacaugagagagcuggaaugcgagcaguggacaagcgauuauuacgacuuuggcaagccccaaccuuguauugaucccagagggguguccggaaucagcgccauguggggccaggggaccauggucacagugucuucc

SEQ ID NO: 39913 - RNA, 435 nt, Artificial Sequence
  derived and/or modified sequence opt5 from anti-HIV_cap256-206-083708_VR-Chain
caggagcaacugguggaaagcggcgggggagucauucccccuggccagucccucagacugucuugcguugccagccgguucaccuuuuccgcuuucgggaugcacugggugcgccaggccccgggaaagggccuugagugggugucuagcgucuccuuugcggggaucaaaaaguacuaugcugacucugugaaaggaagauucuuuaucagccgggauaacuccaagaauacaguuuuccuggaaaugaacggccuccgcggcgaggacacggggcuguacuauugugugaaagauaugagagaacuugagugcgaggaaugggccagcgacuacuaugauuuuggaaagcccgaccagccuugucuggaucggcgcggcgucucugggauuuccgccauguggggacaaggcacccucgugaucguuagcucu

SEQ ID NO: 39914 - RNA, 432 nt, Artificial Sequence
  derived and/or modified sequence opt5 from anti-HIV_cap256-206-079556_VR-Chain
caggagcaacugguggaaagcggcgggggagucguucccccuggcaagucccucagacugucuugcguggccagcggguucaccuuuuccggauucggcaugcacugggugcggcaggcuccggggaaaggacuugagugggucgccggcaucucuuuugugggcauuaaguacuauuacgcggacagcguuaaagggcgcuucuccaucucuagagauaacagcaagaauacacuguuucuccagaugaacggacugcggggcgacgauacggcucuuuauuacugugugaaagacaugcgcgaacuggagugcgaagaguggaccuccgauuauuacgacuucgggaagccccagccuuguauugauagacggggagucagcggcaucucugccaugugggggcaaggaacaauggugaccguuuccagc

SEQ ID NO: 39915 - RNA, 438 nt, Artificial Sequence
  derived and/or modified sequence opt5 from anti-HIV_cap256-206-078657_VR-Chain
cagaugcugcucguggagagcggcgggggagucguugaacccggcagaucccugacccuuucuugcgccacaagccaauucacguuuuccaacuacgggaugcacugggugcggcaggcuccuggacgcggccuggaguggguggccucuaucagcaaugaaggguccaagaaauaucauggagagccggucuggggcagauucauuaucucucgggacaacagcaagaaaacccucuuucugcacauguccaaucuucgcguggaugacagcgcgcuguacuucuguguuagagaucggcaggaagacgagugcgaggaaugguggucugauuauuacgcuuuuggccgcgggggacccuguagaaaguaucauggccaggggcucgccggaauuuucgacaucuggggccgggggacaauggugaccgucuccagc

SEQ ID NO: 39916 - RNA, 438 nt, Artificial Sequence
  derived and/or modified sequence opt5 from anti-HIV_cap256-206-075802_VR-Chain
cagaugcugcucguggagagcggcggggacgucguugaacccggaaagucccugacccuuucuugcgccacaagcagauucacguuuuccaacuacggcaugcacugggugcggcaagcuccugggggaggccuggaguggguggccucuaucagcaaugaagggaacaaaaaguaucauggagaguccgucuggggccgcuucauuaucucuagagauaauagcaaaaacacccucuuucugcacauguccgcgcuucggacagacgauagcgcucuguacuucugugugcgcgacagacaggaagaugagugcgaggaaugguggucugacuauuacgccuuuggccgcgggggaccgugucggaaguaucauggccaggggcucgccggaauuuucgauaucuggggcagagggaccaugguuacaguguccagc

SEQ ID NO: 39917 - RNA, 438 nt, Artificial Sequence
  derived and/or modified sequence opt5 from anti-HIV_cap256-206-069097_VR-Chain
cagaugcugcucguggagagcggcgggggagucguugaacccggcagaucccugacccuuucuugcgccacaagccgguucacguuuuccaacuacgggaugcacugggugcgccaagcuccuggaagagagcuggaauggguggccucuaucagcaaugagggcaacaagaaauaucaugcggaauccgucugggggcgguucauuaucucucgcgacaauagcaagaacacccucuuucugcacauguccaaugugagaggagaugacagcgcucuuuacuucuguguucgggaucgccaggaggacgagugcgaagagugguggucugauuauuacgccuuuggcagaggcgggccgugucggaaauaucauggacagggccuggccgggauuuucgacguguggggacgcggcacagucgugaccguuuccagc

SEQ ID NO: 39918 - RNA, 438 nt, Artificial Sequence
  derived and/or modified sequence opt5 from anti-HIV_cap256-206-067758_VR-Chain
cagaugcugcucguggagagcggcgggggagucguugaacccggcagaucccugacccuuucuugcgccgcuagccaauucacauuuucccacuacgggaugcauugggugcggcaggccccuggacgcggccuggaguggguggcgucuaucagcaacgaagggaauaagagauaucacggagaguccgucuggggccgguucauuaucucucgcgacaacagcaaaaauacgcucuuucugcauauguccgcucuuagaaccgaugacagcgcccuguacuucugugugcgggaucgccaggaagacgagugcgaggaaugguggucugauuauuacgccuuuggcagagggggaccgugucggaaguggcacggccaggggcucgcuggaauuuucgacaucuggggccgcgggacaguugugaccgucuccagc

SEQ ID NO: 39919 - RNA, 417 nt, Artificial Sequence
  derived and/or modified sequence opt5 from anti-HIV_cap256-206-057019_VR-Chain
caggagaagcugguggaaagcggcgggggagccguccaacccggcgggucccucagacugucuugcguugcuagcggauucuccuuuucuggcuacgggaugcacugggugcggcaggccccuggaaaaggccuugaguggcuggcgaccaucagcuucuccggcgugaagaaauauuacgggacaucugcuaagggacgcuuuuauauuuacagagacaacacgaaaaauaccauguaucucgaaaugaacggccugcgcggggaggauacagcccuuuacuauugugccaaggaccugcgguaccucgaaugcggagaguggagcaccuacuauccgcagcccugucuggauacaagaggcgucuccgggaucagcaauguguggggaccuggcaccaugguuacagugucuucc

SEQ ID NO: 39920 - RNA, 438 nt, Artificial Sequence
  derived and/or modified sequence opt5 from anti-HIV_cap256-206-055385_VR-Chain
cagaugaugcugguggagagcggcgggggagucguugaacccggcagaucccucacccugucuugcgccgcuagcaaguucacauuuuccaacuacgggaugcacugggugcggcaagccccuggacgcggccuugaguggguggcgucuaucagcaaugaagggaacaaaaaguaucauggagagccggucuggggcagacugauuaucucccgggacaauucuaaaaacacccucuuccugcacaugagcgaucuucgcgcugacgauuccgcccuguacuuuugugugagagaccggcaggaagaugagugcgaggaaugguggagcaauuauuacgccuucggccgcgggggacccuguagaaaguggcggggccaggggcucgcuggaauuuuugacguuuggggccgcgggacgauggugacagucucuucc

SEQ ID NO: 39921 - RNA, 435 nt, Artificial Sequence
  derived and/or modified sequence opt5 from anti-HIV_cap256-206-053187_VR-Chain
caggagcaacugguggaaagcggcgggggagucguucccccuggcuccucucucagacugagcugcguggccucccgguucaccuuuucugcuuucgggaugcacugggugcgccaggccccgggaaagggccuugagugggucgcggggaucagcuuugugggaauuaaauacuauuacgcugacuccguuaagggcagauucacaaucucucgggauaacagcaaaaauacgcuguuucuccagaugaacggccugcgcggggaagacaccggacuuuauuacugugugaaggauaugagagagcuggaaugcgaggagugggccuccgacuauuacgauuucggcaaacccaaucagccuugucucgaccggcgcggggucagcggaauuucugccuuuuggggccaagggacaauggugaccguuuccagc

SEQ ID NO: 39922 - RNA, 438 nt, Artificial Sequence
  derived and/or modified sequence opt5 from anti-HIV_cap256-206-053139_VR-Chain
cagaugcugcucguggagagcggcggggacgucguugaacccggaagaucccugacccuuucuugcgccacaagccaauucacguuuuccaacuacggcaugcacugggugcggcaggcuccugggcgcggacuggaguggguggccucuaucagcaaugaaggcuccaagaaauaucauggggagucugucuggggaagauucauuaucagccgggauaacuccaagaauacccucuuucugcacaugacaacccuucgcccggacgauagcgcgcuguacuucugugugagagaccggcaggaagaugagugcgaggaaugguggucugacuauuacgcuuuuggccgcggcgggcccuguagaaaauaucauggacagggccucgccgggauuuucgauaucuggggacggggcacaaugguuaccguguccagc

SEQ ID NO: 39923 - RNA, 432 nt, Artificial Sequence
  derived and/or modified sequence opt5 from anti-HIV_cap256-206-050350_VR-Chain
caggagcaacugguggaaagcggcgggggagucguucccccuggcaagucccucaaacugucuugcguggccagcagauucuccuuuggggcuuucggaaugcacugggugcggcaggccccgggcaaggggcuugagugggucgcgggaaucucuuuugugggcauuaaaaaguacuaugcugacagcguuaaaggccgcuucuacaucuccagagauaacucuaagaauaccguguuucuggaaaugaacgcccuccgcggggaggacacagcccuguaucauugugucaaggauaugcgggaacuugagugcgaggaaugggcuagcgacuacuaugauuucggaaaaccccagccuugucuggacagacggggcguguccgggauuagcgccauguggggacccggcacgaugguuaucgugucuucc

SEQ ID NO: 39924 - RNA, 432 nt, Artificial Sequence
  derived and/or modified sequence opt5 from anti-HIV_cap256-206-046207_VR-Chain
caggagcaacugguggaaagcggcgggggagucguucccccuggcaccucccucagacugucuugcguggccagccgguucacauuuuccgcuuucgggaugcacugggugcgccaggccccgggaaagggccuugagugggucgcggggaucucuuuugcuggaauuaaaaaguacuaugccgacagcgugaaaggcagauucacgaucucccgggauaacucuaagaauagccuguuucucgaaaugaacggccugcgcggggacgauaccgcccuuuacuauuguguuaaagaccugagauaccucgagugcgaacuguggacauccgauuauuacgacuucggacggccccagccuuguauugauagccgcggcgugucugggaucuccgcuauguggggacccggcaccauggucacagugagcgcc

SEQ ID NO: 39925 - RNA, 417 nt, Artificial Sequence
  derived and/or modified sequence opt5 from anti-HIV_cap256-206-043389_VR-Chain
caggagaagcugguggaaagcggcgggggagccguccaacccggcgggucccucagacugucuugcguugcuagcggauucaccuuuuccggcuucgggaugcacugguuucggcaggccccuggaaaaggccuugaguggguggcgacaaucucuuucagcggcauuaagaaauacuauaacacguccgcuaaggggcgcuuuuucaucucuagagacaauaccaaagauacacuguaccuccagauggacggacugcaggaaaaggauaccgcccuuuaucugugugccaaggaccuccgguaccuggagugcggcuauuggagcacauacuauccgcaacccugucuggauacccgcgggguguccggaauuagcaacgucuggggcccugggacaauggugaccguuucuucc

SEQ ID NO: 39926 - RNA, 432 nt, Artificial Sequence
  derived and/or modified sequence opt5 from anti-HIV_cap256-206-042555_VR-Chain
caggagcaacugguggaaagcggcgggggagucguucccccuggcaagucccucagacugucuugcguggugagcggguucaccuuuuccgccuucggaaugcacuggguccggcaggcuccgggcaaagggcuugaguggguggccggaaucucuuuugcgggcacaaagagcuacuaugcugaauccguuaaaggccgcuucacgauuucuagagacaacagcaaaaauucccuguuucuccagaugaacgggcugcggggagaugacaccgcccuuuacuauugugugaaggauaugcgcgagcuggaaugcgagcucuggacaagcgacuacuaugauuucggcagaccccagccuuguaucgaccggcgcggggucucuggaauuuccgccauguggggccaagggaccauggugacaaucagcucu

SEQ ID NO: 39927 - RNA, 432 nt, Artificial Sequence
  derived and/or modified sequence opt5 from anti-HIV_cap256-206-029720_VR-Chain
caggagaagcugguggaaagcggcgggggagucguucaacccggcagaucccucacccugucuugcguggccagccacuucacauuuuccggggugggaaugcauuggguccggcaggcuccuggcaaagggcuugaguggguggccggaaucucuuucgcgggcacgcgcaaguacuaugcugacagcguuaaaggcagauuuaccauuucccgggauaacucuaagaauacaguguaccugcagaugaacgggcuccgcggagaagacaccgcccuguaucacugugccaaagaucuuagagagcuggaaugcgagcucuggacaagcgacuacuaugauuucggccggccgcagcccuguaucgaccgcagaggggucuccggaauuugcgauauguggggccaagggaccauggugaucguuagcucu

SEQ ID NO: 39928 - RNA, 432 nt, Artificial Sequence
  derived and/or modified sequence opt5 from anti-HIV_cap256-206-028848_VR-Chain
caggagcaacugguggaaagcggcgggggagucguucccccuggcaagucccucagacugucuugcguggccagcggguucaccuuuuccggauucggcaugcacugggugcggcaggcuccggggaaaggacuucagugggucgccggcaucucuuuugcgggcacaaaguacuauuacgaggacagcgugaaagggcgcuucacgauuuccagagauaacucuaagaauaccguuuuucugcagaugaacggacuccggggcgacgauacagcucuguauuacugugugaaagacaugcgcgaacuugagugcgaagaguggaccagcgauuauuacgacuucgggaagccccaaccuuguaucgauagacggggagucuccggcauuagcgccaugugggggcagggaacaauggugaccaucucuucc

SEQ ID NO: 39929 - RNA, 432 nt, Artificial Sequence
  derived and/or modified sequence opt5 from anti-HIV_cap256-206-027652_VR-Chain
caggagcaacugguggucagcggcggggacguugugcccccuggaaagucccucagacugucuugcguggccagcggcuucaccuuuuccgcuuucgggaugcacuggguccggcaggccccgggaaaaggccuugaauggguggcgucuaucagcuuugcugggacaaaguacuauuacgccgauuccguuaaaggacgcuucgccauuucuagagacaacagcaagaauacgcuguuucuccagaugaacggccugcggcgcgaggauaccggccuuuauuacugugugaaagacaugagacagcuggaaugcgaggaauggacauccgauuauuacgacuucgggcggccccaaccuuguaucgaucgcagaggagucagcggcauuucugcuaugugggggcagggaaccauggugacaaucuccagc

SEQ ID NO: 39930 - RNA, 417 nt, Artificial Sequence
  derived and/or modified sequence opt5 from anti-HIV_cap256-206-024075_VR-Chain
caggagaagcugguggaaagcggcgggggagccguccaacccggcgggucccucagacugucuugcguugcuagcggauucaccuuuuccggcuucgggaugcacugggugcggcaggccccuggaaaaggccuugaguggcuggcgacaaucucuuuuagcggcgugaagaaauacuaugggacguccgcuaagggacgcuucuacauuucuagagacaacaccaaaaauacagucuaucuccagauggauggccugcgcggggacgauaccgccaucuacuauugugccaaggaccuucgguuucuggaaugcggacucuggagcacauacuauccgcagcccugucuggauaccagaggcguguccgggauuagcaacguuuggggaccuggcacaauggugaccgucucuucc

SEQ ID NO: 39931 - RNA, 417 nt, Artificial Sequence
  derived and/or modified sequence opt5 from anti-HIV_cap256-206-008748_VR-Chain
caggagaagcugguggaaagcggcgggggagccguccaacccggcgggucccucagacugucuugcguugcuagcggauucaccuuuaacggcuucgggaugcacugggugcggcaggccccuggaaaaggccuugaguggguggcgacaaucuccuuuucuggcgucaagaaauacuaugggacgagcgcuaagggacgcuucuuuauuuccagagaaaauucuaaaaacacccuguaccuccagaugaauggccugcgcggggaggacacagcccuuuauuacugugccaaggaucugcgguaucucgaaugcggagaguggagcaccuacuauccgcagcccugucuggacacaagaggcguguccgggaucagcaacguuuggggaccuggcacccgggugacagucucuucc

SEQ ID NO: 39932 - RNA, 432 nt, Artificial Sequence
  derived and/or modified sequence opt5 from anti-HIV_cap256-206-008530_VR-Chain
caggagcaacugguggaaagcggcgggggagucguucccccuggcaagucccucagacugucuugcguggccagcggguucuccuuuggagcuuucggcaugcacugggugcggcaggccccggggaaaggacuugagugggucgcgggcaucucuuuugugggcauuaaguacuauuacgcugacagcguuaaagggcgcuucaccaucuccagagauaacucuaagaaaacacuguuucuccagaugaauggacugcggggcgacgauacggcccuuuauuacugugugaaggacaugcgcgaacuggagugcgaagaguggaccagcgauuauuacgacuucgggaagccccagccuuguauugauagacggggagucuccggcaucagcgccuuuugggggcaaggaacaauggugaccauuucuucc

SEQ ID NO: 39933 - RNA, 432 nt, Artificial Sequence
  derived and/or modified sequence opt5 from anti-HIV_cap256-176-723043_VR-Chain
caggagcaacugguggaaagcggcgggggagucguucccccuggcaagucccuccggcugucuugcguggccagcggguucaccuuuuccgcuuucggaaugcacugggugcggcaggccccgggcaaagggcuugagugggucgcgggagugucuuuugcuggcaucaaguacuauuacgccgacagcguuaaaggccgcuucacaauuuccagagauaacucuaagaauacgcuguuucuccagaugaacgggcugcggggagacgauaccgcccuuuauuacugugugaaagaccugcgcgaacucgagugcgaagaguggacaagcgauuauuacgacuucggcagaccccagccuuguaucgaucccagaggggucuccggaauuagcgcuauguggggccaagggaccgugguuacaaucucuucc

SEQ ID NO: 39934 - RNA, 432 nt, Artificial Sequence
  derived and/or modified sequence opt5 from anti-HIV_cap256-176-600049_VR-Chain
gaggugcagcugguccaaagcggcgggggaguugugcagcccggcagaucccuccggcugucuugcgccgcuccuuacuucgaauuugggcgcuauggauuccacugggugagacaggccccgggcaaggggcuugagugggucgcgagcaucuccuuugcuggacggggcuacuaucauucucccagcguguggggccgcuucaccauuuccagagacaacucuaaaaauacacuguaccuccagaugaacagccugcggaucgaagauacggcccuuuauuuuugugcccgcgaccugagagaguccgaaugcgaggagugggaaagcgauuacuaugacuucgggaagaaaggaccuuguguuaagccccggggcguggcugggggacucgaucuguggggccaagggaccauggucauugugucuucc

SEQ ID NO: 39935 - RNA, 432 nt, Artificial Sequence
  derived and/or modified sequence opt5 from anti-HIV_cap256-176-531926_VR-Chain
caggugcaacuggucgagagcggcgggggaguugugcccccuggcaagucccucacccugucuugcguggccagcagauucacauuuuccgcuuucgggaugcacuggguccggcaggccccgggaaaaggccuugaauggguggcggggaucucuuuuguuggcauucgcaaguacuaugcugacagcgugaaaggaagauucuccaucucucgggauaacagcaagaauacggucuuucuggagaugaacggccuccgcggggaagacaccggacuguacuauugugugaaagauaugagagagcuugaaugcgaggagugggccuccgacuacuaugauuucggcaagccccagccuugucuggaccggcgcgggguuagcggaauuucugccauguggggccaggggacacucgugaucauuuccagc

SEQ ID NO: 39936 - RNA, 432 nt, Artificial Sequence
  derived and/or modified sequence opt5 from anti-HIV_cap256-176-504134_VR-Chain
gaggugcagcuggucgaaagcggcgggggaguugugcccccuggcaagucccucagacugucuugcgugaccagccggcuugccuucggggcuuuuggaaugcacuggguccgccaagccccgggcaaagggcuggaguggguggcguccaucucuuucgcuggaauuaagaaauacuaugccgacagcguuaagggcagauuuacaaucucccgggauaacucuaaagacacgguguuccucgaaaugaauggccugcgcggggaugacaccggacuuuacuauugugucaaggauaugagauaccuggagugcgaagagugggccagcgacuauuacgauuuuggccggccccagccuugucucgacccccgcgggguguccggaauuagcgcuauguggggccaggggacacugguuaucauuucuucc

SEQ ID NO: 39937 - RNA, 432 nt, Artificial Sequence
  derived and/or modified sequence opt5 from anti-HIV_cap256-119-186229_VR-Chain
cagaugcaacugguggagagcggcgggggagucguucagcccggcgggucccucagacugcuuugcucugccagcggauucaccuuuuccacauacggcaugcacugggugcggcaggcuccugggaagggacuggaauggguggccucuaucagcuaugacggcuccgauaaauaccaugcgggccucgucugggggcgcuucauuaucucuagagacaacagcaagaauacgcuguaucuucagaugaacucccugcgggcugaggauaccgcccucuacuauugugugcgcgacgaaagagagagcgaaugcgagcugugggagucugauuacuauaauuuuggcaaaaagcugccguguguuaaaccccggggaguggccgggacacucgacauuuggggacaaggcaccacagucaucguguccagc

SEQ ID NO: 39938 - RNA, 432 nt, Artificial Sequence
  derived and/or modified sequence opt5 from anti-HIV_cap256-119-183891_VR-Chain
caggugcaacuggucgagagcggcgggggaguugugcagcccggcgggucccucagacugucuugcgccgcuagcggauucaccuuuuccucuuacggcaugcacugggugcggcaggccccugggaagggacuugaaugggucgcguucacacgcuaugacggcagcgauaaauacuaucuggacuccgugaagggcagauuuacgaucucucgggauaacagcaaauacacccucuuccugcagaugguuucccuucgcacagaggacaccgcucuguauuuuugugccagagaucuccgggaaagcgagugcgaagagugggagucuuacuauuacgacuucgggaagaaaggaccgugugugaagccccgcggcgucguggggguucuggauauuuggggacaaggcacacuggugaccgucuccagc

SEQ ID NO: 39939 - RNA, 435 nt, Artificial Sequence
  derived and/or modified sequence opt5 from anti-HIV_cap256-119-183631_VR-Chain
caggugcaacugguccagagcggcgggggaguugugcagcccggcagaucccuccggcugucuugcgccgcuagcaaguucaccuuuuccacauacacgcuucacugggugcgccaggccccugggaaaggacuggagugggucgcggugaucucucaugacggcgggaacagauucuaugcugauagcguuaagggacgguuuaccauuucccgcgacaauucuaaaaacaaucucuuccugcaaaugaacagccuuagaguggaagauacagcccuguacuauugugcccgggaccuccgcgagauggaaugcgaggaauggacccuguacaauuauuacgauuuuggcuccagaggcccgugugucgacccccggggagugguugggagcuucgauguguggggccaggggacaauggucaccgugucuucc

SEQ ID NO: 39940 - RNA, 432 nt, Artificial Sequence
  derived and/or modified sequence opt5 from anti-HIV_cap256-119-182676_VR-Chain
caggugcaacuggucgagagcggcgggggaguugugcagcccggcaagucccucagacugucuugcguggucagcggguucaccuuuuccaacuacccuaugcacugggugcggcaggccccgggaaaaggccuugaauggguugcuucuaucagcuucgccgggauuaagaaauauuacggagacuccgugaagggccgcuuuacaaucucuagagauaauagcaaaaacacgcuguaucuccagauggacggccugcgcggggaggauaccgcgcuuuacuauugugcuaaggaccugcgggaacucgagugcgaagagugggccuccgauuacuaugacuucggaagaccccaaccuugucuggauccccggggcgucagcgggauuucuaauguguggggacagggcacaaugguuaccguguccagc

SEQ ID NO: 39941 - RNA, 432 nt, Artificial Sequence
  derived and/or modified sequence opt5 from anti-HIV_cap256-119-180772_VR-Chain
caggugcaacuggucgagagcggcgggggaguugugcagcccggcagaucccuccggcugucuugcgccgcuagcgaguucaccuuuuccaacuacgccaugcacugggugcgccaggcgccugggaagggacuugaaugggucgcuucuaucagcuucgacggcagagauaaauaucauuccucucuggugugggggcggcucacaauuagccgcgacaauuccaagagcacgcuguuucuucagaugaacucucugagaccggaagauaccgcccucuacuauugugcccgggacguucgcgaguccgaaugcgaggaguggcaaagcgauuacuaugcuuucuacagaaaacugcccugugugaagccucggggagucgccggcacacuggacaucuggggccaggggaccauggugacaguuucuucc

SEQ ID NO: 39942 - RNA, 435 nt, Artificial Sequence
  derived and/or modified sequence opt5 from anti-HIV_cap256-119-180508_VR-Chain
caggugcaccuggucgagagcggcgggggaguugugcaacccggcagaucccuccggcugucuugcgccgcuagccauuucucccuuucuagcuacgggaugcacugggugcgccagaccccuggaaagggccuggaaugggucgccgggaucuccuuugcgggagugaaaacauauuacggcacgucuguuaagggcagauucaccauuagccgggacaacuccaaaaauaaccucuaucugcagaugaauagccuucgcccggaggauacagcucuguacuauugugccagagaccuccgggaaauggagugcgaagaguggaagcuguacaacuauuacgauuuucgcaccagagggcccuguguggacccucggggagucgugggcucuuucgauguuugggggcagggaacaguggucaccguguccagc

SEQ ID NO: 39943 - RNA, 432 nt, Artificial Sequence
  derived and/or modified sequence opt5 from anti-HIV_cap256-119-180260_VR-Chain
gaggugcagcuggucgaaagcggcgggggaguugugagacccggcgggucccuccggcugucuugcgccgcuagccaauucaccuuuuccaauuucggaaugcacugggugcgccaggccccuggcaaggggcuugagugggucgcgucuaucagcuuugugggaauuaaaacacauuacgcuaauuccguuagaggccgguucacgaucucucgcgaccagagcaagaacacccuguaucuccagaugaacuccgugagagucgaagauacaggccgguacuauugugcccgcgacaugagagaguacgaaugcgagcugugggccagcgauuauuacgacuuugggaaaccgcaacccugugaggauccucggggagugguuggcaccuucgacaugugggggcuuggaacacuggugaccgucucuucc

SEQ ID NO: 39944 - RNA, 432 nt, Artificial Sequence
  derived and/or modified sequence opt5 from anti-HIV_cap256-119-180173_VR-Chain
gaggugcagcuggucgaaagcggcgggggacucguucaacccggcgggucccugagacuuucuugcgccgcuagcggauucaccguguccucuaacuacaugagcugggugcggcaggccccuggcaaggggcuggagugggucgcguccaucucuuuugcuggaacgaaaaagcacuauggcaauagcgugaaaggccgcuucacaauuuccagagacaacagcaagaauacccucuaccugcagaugaacucucuucgcggggaagauacagcccuguauuacugugccaaagaccuccgggaguaugaaugcgaggaguggaccuccgauuacuaugacuuuggaagaccgcagcccuguaucgauagccggggcguuguggggauucuggacaucuggucucaaggaacaauggucaccguguccagc

SEQ ID NO: 39945 - RNA, 432 nt, Artificial Sequence
  derived and/or modified sequence opt5 from anti-HIV_cap256-119-179839_VR-Chain
caggugcaacuggucgagagcggcgggggaguugugcagcccggcagaucccuccggcugucuugcgccgcuagcggguucuccuuuggaaccucugacgugcacuggguccgccaggccccuggcgaagggcuugaguggguggcgcugaucagcuucgauggaagacagaaggaccucgcugauuccguucggggccgcuuuacaauuucuagagacagcuccaaaaacacgcuguaccuugaaaugaauagccugcggccggaggauaccgcccucuauuacugugccaaggacaugcgcggcuaugaaugcgaggaguggacaucugauuacuaugacuucgggagaccccaaccuuguaucgauucccggggaguggucggcaccuuugacgugugggggcagggaacaaugguuaccgugagcucu

SEQ ID NO: 39946 - RNA, 423 nt, Artificial Sequence
  derived and/or modified sequence opt5 from anti-HIV_cap256-119-179262_VR-Chain
caggugcaacuggucgagagcggcgggagaguugugcaguccggaggcucucuccggcugagcugcggggccuccggauucucuuuuaccacaagcgcuaugcacugggugcgccaggcccccggcaaggggcuugaaugggucgcgaucaacggagcuaauaaacauuacgccgaguccgugaagggcagauucacgauuucucgggacaacagcaaaaauacccuguuucucgaaaugaacucccugcgcccugaugacacagcccuuuauuucuguguuaaggaucagagagaggacgaaugcgaggagugguggagcgauuacuaugacuuuggccgggaacaaccgugucuggauccccgcgggguggucggaaucuucgaccucuggggccaggggaccauggugacaguuucuucc

SEQ ID NO: 39947 - RNA, 432 nt, Artificial Sequence
  derived and/or modified sequence opt5 from anti-HIV_cap256-119-178995_VR-Chain
caggugcaacuggucgagagcggcgggggaguugugcagcccggcaagucccucagacugucuugcgccgcuagcggguucacccuuacacgguuugccaugcacugggugcgccaggcgccuggaaaaggccuggaaugggucgcugugaucugguacgacggguccaacaaguauuacgccgauucuguuaaaggaagauucacggugagccgggacaauuccaagaacacccucuaucugcagaugaacucucuucgcacagaggauaccgcccuguacuauugugucagagaccggcgcgaaagcgagugcgaacucugggaguccgauuacuauaauuuuggcagacggcugccgugugugaaaccccgcggcguugcugggauucuggacaucuggggacaaggcacaaccgugacagucagcccu

SEQ ID NO: 39948 - RNA, 432 nt, Artificial Sequence
  derived and/or modified sequence opt5 from anti-HIV_cap256-119-178455_VR-Chain
gaggugcagcuggucgaaagcggcgggggacucguucaacccggcgggucccugagacuuucuugcguggugagcggauucaccuuuuccaacuucuggaugucuuggguccggcaggccccuggcaaggggcuggaguggguggcuagcaucuccuacgacggacgcgauaaauaucacucuagccucguuuggggcagacugacaauuucccgggacaauagcaagucuacgcuuuuucugcagaugaacucccuccgcgccgaagauaccgcgcuguacuauugugcuagagaccugcgggagagcgaaugcgaggaguggcagucugauuacuaugccuucuacaaaaagcucccgugugugaaaccccgcggcgucgccgggacacuggacaucuggggacaaggcaccauggugacaguuuccagc

SEQ ID NO: 39949 - RNA, 438 nt, Artificial Sequence
  derived and/or modified sequence opt5 from anti-HIV_cap256-119-177993_VR-Chain
caggugcaccuggucgagagcggcgggggaguugugcaacccggcaagucccucagaaucuacugcgccgugucugaguucaccuuuagcaacuaugcuaugcauuggguccggcuggccccugggcgcggacuucaguggcuggcggugauuuccuacgacggcucuaaaaaguauuacgcugauagccucgaagggagauucacaaucuccaaagacaauucuaagaacacgcuguuucuucagaugaauagccugcggguugaagauaccgcccucuauuucugugugaaagaccagcgcgaggaugaaugcgaggaguggugguccgacuacuaugauuuuggagaaagagccccgcugcccaaggucccuggccccggcccuggguggaaccuggacauguggggacacggcacaauggugaccguuagcucu

SEQ ID NO: 39950 - RNA, 438 nt, Artificial Sequence
  derived and/or modified sequence opt5 from anti-HIV_cap256-119-177727_VR-Chain
caggugcaacuggucgagagcggcgggggaguugugcagcccggcagaucccuccggcugucuugcgccgcuagcggguucacccuuucccgcuacgacaugcacugggugagacaggccccuggaaagggccuggaaugggucgcgucuaucagcaaagaugggacaaagaaauaucauggagacuccguguggggccgguuuauuaucucucgcgauaacagcaagaauacccucuuccugcagauguccagccuuagagcugaggacacggcccuguacuuuuguguucgggaucaacgcgaagccgagugcgaagagugguggucugacuauuacgauuucggcagagagcucccgugucggaaauuucgcgggcugggacuggcuggcauuuucgacaucugggggcacggaacaauggugaccgucuccagc

SEQ ID NO: 39951 - RNA, 432 nt, Artificial Sequence
  derived and/or modified sequence opt5 from anti-HIV_cap256-119-176746_VR-Chain
gaggugcagcuggucgaaagcggcgggggacucguucaacccggcgggucccugagacuuucuugcgccgcuagcgacuucaccuuugaugacuacgccaugcacugggugcggcaggcgccuggaaagggccuggagugggucgggggaaucuccuaugauggcucugacaaauaccauacaaacagcguguggggccgcuucauuguguccagagauaauucuaagaacacgcucuaucugcagaugaauagccuucggccggaagacaccgcucuguacuauuguguucgcgauagacgggaguccgaaugcgaggagcgcuggagcgacuacuaugauuuugggaaacagcuccccugugugaagccuagaggagucgccggcaucuucgacauuugggggcaaggaacaauggugaccguuucuucc

SEQ ID NO: 39952 - RNA, 432 nt, Artificial Sequence
  derived and/or modified sequence opt5 from anti-HIV_cap256-119-176241_VR-Chain
caggugcaacuggucgagagcggcgggggaguugugcagcccggcagaucccuccggcugucuugcgccgcuagcggguucaccuuuuccaacuacgccaugcacugggugcgccaggcgccuggaaagggccuugaaugggucgcugugaucucuuaugacgggagcaauaaauacuaugccgauuccguuaagggaagauucacaauuucucgggacaacagcaaaaauacgcuguaccuccagauggauggccugcgcggcgaggacaccgcccuuuauuacugugcuaaggaucugagagaacucgagugcgaagagugggccuccgacuauuacgauuuugggcggccgcaacccugucuggacccucgcggagugagcggcaucucuaacgucugggggcagggaacaauggugaccguuuccagc

SEQ ID NO: 39953 - RNA, 432 nt, Artificial Sequence
  derived and/or modified sequence opt5 from anti-HIV_cap256-119-175215_VR-Chain
caggugcaacuggucgagagcggcgggggaguugugcagcccggcagaucccuccggcugucuugcgccgugagccaguucaccuuugggcgcuacggaauguauugggucagacaggcuccuggcaaggggcuugaauggguggccggaaucuccuacgacggcucugauaaauaucacacaaacagcguuuggggccgguucauugugucccgcgacaauucuaagaacaugcuguaccuccaaaugaauaaccugagaccggaggauacggcgcuuuauuacuguguccgggaccgcagagaaagcgagugcgaggaacggugguccgauuauuacgacuuugggaaacagcugcccugugugaagccucgcggaguugcuggcaucuucgauauuugggggcagggaaccauggugacagucagcucu

SEQ ID NO: 39954 - RNA, 432 nt, Artificial Sequence
  derived and/or modified sequence opt5 from anti-HIV_cap256-119-173928_VR-Chain
ggcguggagcugcucgaaagcgggggaggccuggucgagcccgggggaucccuuagacugucuugcguuggcagccaguucuccuuugaccgguacgggaugcacugggugcgccaagccccuggaaagggccucgaauggguggcugccgucucuuucgauggcaccgacaaauaucaugcggaugacgugugggggagauuuacaaucagccgggauaacuccaagaauacgcuguaccuucagaugaacucucugcgcgcugaggacaccgcccucuauuacugugccaaagaucugagagaagacgagugcgaggaaugguggagcgauuauuacgaccugggaaagcagcucccgugucggaaaucccgcggcguugcuggggugcuggauaaguggggacuuggcacaauggucaccgugagcucu

SEQ ID NO: 39955 - RNA, 432 nt, Artificial Sequence
  derived and/or modified sequence opt5 from anti-HIV_cap256-119-173495_VR-Chain
caggugcaacuggucgagagcggcgggggaguugugcagcccggcaagucccucagacugucuugcgccgcuagccgguucaccuuuaaccgcuacgggaugcacugggugagacaggccccuggaaaaggccuugaaugggucgcggcuaucuccuucgacgggacagauaaguaucauucugacgauguguggggacgguuuacgauuagccgcgacaauuccaaaaacacccuguaccuccagaugaacucucugagagccgaggauacagccguuuauuacugugcuaaggaccuucgggaagaugagugcgaggaacgcuggagcgacuauuacgauuucggcaaacaacugccguguagaaagucccggggcguggccgggaucuuugacaauuggggacagggcaccauggucacagugagcucu

SEQ ID NO: 39956 - RNA, 432 nt, Artificial Sequence
  derived and/or modified sequence opt5 from anti-HIV_cap256-119-172882_VR-Chain
caggugcaacuggucgagagcggcgggggaguugugcagcccggcagaucccucacccugucuugcgaagugagcggguucacauuuaagacguacggaaugcacuggguccggcaggccccuggcaaagggcuugaguggguggcuuccaucucuuaugacggaagcgauaaguaccaugccgaccgcguuuggggcagauucaccauuucccgggauaacucuaaaaauacacuguaucuccagaugaacagccugcgcgcggaagacaccgcucuuuacuauugugugagagaugcccgggaguccgaaugcgagcugugggagagcgacuacuauaauuuuggccgcaagcucccgugugucaaacccagagggguggccggaacacuggauaucuggggccaagggaccaugguuacagugucuucc

SEQ ID NO: 39957 - RNA, 432 nt, Artificial Sequence
  derived and/or modified sequence opt5 from anti-HIV_cap256-119-172429_VR-Chain
gaggugcagcuggucgaaaccggcgggggacucauccaacccggcgggagccugagacuuuccugcguugccucucaguucacauuuagcggauguggccugcacugggugcggcaggcuccugggaagggacucgaguggguggccuccauuucuuucgcgggcacgaaaaagcauuacggcaacagcgucaaagggcgcuuuaccaucuccagagacaauucuaagaacacacuguaucuugaaaugaauacccugcgggcugaggauacagcccucuacuauugcgccaaagaccugcgcgaauacgagugugaggaauggaccagcgauuauuacgacuucggaagaccgcagcccugcauugauucccggggcgugguugggauccuggacauuuggggacaaggcacaauggugagcgucucuucc

SEQ ID NO: 39958 - RNA, 432 nt, Artificial Sequence
  derived and/or modified sequence opt5 from anti-HIV_cap256-119-172223_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacgggagagauuucuaccaugcccgguccguuuggggacgcuuuacaauuucuagagacaacagcaaaaauacgcugcaccuccagaugaacucccugcggccggaggauaccgcccuuuauuucugugcucgcgaccugagagaaagcgagugcgaagagugggagucuuacuauuacgauuuuggcaagaaagaccccugugugaagccucggggcgucguggggguucucgauaucuggggacaaggcacacuggugaccgucuccagc

SEQ ID NO: 39959 - RNA, 432 nt, Artificial Sequence
  derived and/or modified sequence opt5 from anti-HIV_cap256-119-171838_VR-Chain
caggugcaacugggcgagagcgggggaggcgucguucagcccgggcggucccuccggcugucuugcgccgcuagcggauucaccuuuuccacauucgccaugcacugggugcgccaggcgccuggcaaggggcuugaauggguggcugucaucucuuacgacggaagcaacaaauauuacgccgauuccgugaagggcagauuugccauuucucgggacaaugcuaaaaaccugcuccaucugcagaugaauagccuucgcccggaggauacggcccuguauuacugugcuaaggaccuccaagaagaugagugcgaagaguggugguccgacuauuacgauuucggcaaacagcugcccuguagaaagagcagagggguugccggaaucuuugacgauuggggccaggggaccauggugacagucucuucc

SEQ ID NO: 39960 - RNA, 432 nt, Artificial Sequence
  derived and/or modified sequence opt5 from anti-HIV_cap256-119-171587_VR-Chain
gaggugcagcuggucgaaagcggcgggggacucguucaacccggcgggucccugagacuuucuugcgccgcuagcggauucaccuuuuccgacuacuauaugucuuggauccggcaggccccuggcaaggggcuggaguggguggcgagcauuuccuucgcuggaacaaaacagcacuacggcaacucugugaagggccgcuuuacgaucagcagagauaauuccaaaaacaccgucuaucuccagaugaauagccugcggcuugaagacacagcccuguacuauugugccaaggaucuccgcgaguacgaaugcgaggaguggaccucugacuauuacgauuucgggagaccgcaacccuguauugacucccggggagugguuggcauccuggauauuugggggcagggaacaauggugaccgucagcucu

SEQ ID NO: 39961 - RNA, 432 nt, Artificial Sequence
  derived and/or modified sequence opt5 from anti-HIV_cap256-119-169596_VR-Chain
cuggugcagcucgucgagagcggcgggggaguugugcaacccggcagaucccugcggcuuucuugcaccgccagcggguucacauuuuccucuuucgcuaugcaccgcgugagacagacgccuggaaagggccuggaaugggucgccagcaucuccuacgacgggucugauaaauaucaugcggaccggguguggggacgcuuuaccauuagcagagauaacuccaagaauacacucuaccugcagaugaacagccuucgggcugaggacaccgcccuguauuacuguguucgcgaugccagagaaucugagugcgaacucugggaguccgacuauuacaauuucggccggaaacugccgugugugaagccccgcggcgucgcugggacacuggauaucuggggacagggcaccauggugacaguuagcucu

SEQ ID NO: 39962 - RNA, 432 nt, Artificial Sequence
  derived and/or modified sequence opt5 from anti-HIV_cap256-119-169523_VR-Chain
caggugcaacuggucgagagcggcgggggaguugugcagcccggcgaaucccuccggcugucuugcgccgcuagcggguucuccuuuggaaccucugacgugcacuggguccggcaggccccuggcgaggggcuugaauggguggcgagcaucuccuucgcuggaauuaagaaauacuauggcgauucuguuaagggccgcuuuacaaucagcagagacaacuccaaaaauacgcuguaccuccagauggaugggcugcggggagaggacaccgcccuuuauuacugugccaaggaucugcgcgaacucgagugcgaggaaugggcuagcgacuauuacgauuucggcagaccgcaacccugucuggacccuagaggggugucuggaauuuccaacgucuggggccaggggacaauggugaccguuagcucu

SEQ ID NO: 39963 - RNA, 432 nt, Artificial Sequence
  derived and/or modified sequence opt5 from anti-HIV_cap256-119-169462_VR-Chain
gaggugcagcuggucgaaagcggcgggggacucguucaacccggcgggucccugagacuuucuugcgccgcuagcggauucaccuuuacaacguacucccugcacugggugcggcagucuccuggcaaggggcucgaguggguggccgcgaucagcuucgcuggaaccaaagaaaacuaugccaauuccguccgcggcagauuuacaauuucucgggacaacagcaagaauacccuguaccuucagaugaacucccugcgcgccgaggauacagcucucuauuacuguaccaaagacaugagagaauaugagugcgaggaauggacaagcgauuacuaugacuucggccggccgcagcccuguaucgauucucgcggggugguuggaaccuuugacguguggggccaagggacgauggucaccguguccagc

SEQ ID NO: 39964 - RNA, 432 nt, Artificial Sequence
  derived and/or modified sequence opt5 from anti-HIV_cap256-119-169092_VR-Chain
gaggugcagcuggucgaaagcggcgggggacucguucaacccggcgggucccugagacuuucuugcgugaucagcggauucaccuuuuccucuuacgagaugaacugggugcggcaggccccuggcaaggggcuggaaugggucgcuggaauuagcuaugacggccgcgauaaauaccacgcccauuucguguggggcagaaucacaauuucccgggacaauucuaagaacacgcucuaucugcagaugaauagccuucgcgcggaggauaccgcucuguaccacuguguuagagaccuccgggaauccgagugcgagcugugggaaagcgauuauuacgacuuugggaaaaagcugccgugugugaaaccccgcggagucgccggcaucuucgaucucugggggcagggaacaauggugaccguuucuucc

SEQ ID NO: 39965 - RNA, 432 nt, Artificial Sequence
  derived and/or modified sequence opt5 from anti-HIV_cap256-119-168680_VR-Chain
caggugcaacuggucgagagcggcgggggaguugugcagcccggcagaucccuccgggugucuugcgccgcuagccacuucaccuuuucccgcuacgggaugcauugggucagacaggccccuggaaagggccuggaauggguggcgucuaucagcuaugacgggcgggauuucuaccacgcucgcuccguuuggggaagauuugccauuucucgggacaacagcaaaaauacacuucaucugcagaugaacucccuccgcacggaggauaccgcccuguaucacugugugagagaccuucgggaaagcgagugcgaacugugggagucugauuacuaugacuucggcaagaaacucccgugugucaagccccgcggcguggcugggacauuugaucuguggggacaaggcaccaugguuacaguguccagc

SEQ ID NO: 39966 - RNA, 438 nt, Artificial Sequence
  derived and/or modified sequence opt5 from anti-HIV_cap256-119-166385_VR-Chain
caggugcaacuggucgagagcggcgggggaguugugcaccccggcagaucccuccggcugucuugcgccgcuagcggguucuccuuuggaaacuucggcaugcauugggugcgccaggccccugggaagggacuugaaugggucgcgucuaucagcaaugacggcaccaaaaaguaccacgcugaguccgugugggauagauuuucuauuagcaaagacaacuccaagaauacacuguuccuccagaugaacagccugcggguugaagauacggcccuuuauuuuugugugaaagaccagcgcgaggaugaaugcgaggagugguggucugacuacuaugauuucggcagagaacugccgugucggaagucccgcgggcucggacuggccggcaucuuugacaugugggggcauggaaccauggucacagugagcucu

SEQ ID NO: 39967 - RNA, 432 nt, Artificial Sequence
  derived and/or modified sequence opt5 from anti-HIV_cap256-119-165943_VR-Chain
gaggugcagcuggucgaaagcggcgggggacucguucaacccggcagaucccugcggcuuucuugcgccgugagcggguucaccguguccucuaacuacaugagcuggguccgccaggcuccuggaaagggccuggaguggguggccuccaucucuuuugcggggauuaaaaaguauuacggagacagcguuaaaggcagauucacaaucucccgggauaauagcaagaacacgcucuaucugcagauggacggccuucgcggggaagauaccgcucuguacuauugugccaaagaccucagagagcuggaaugcgaggagugggccucugauuacuaugacuuuggacggccgcagcccugucuggauccucgcggcguguccgggauuagcaaugucuggggacaaggcacaauggugaccguuucuucc

SEQ ID NO: 39968 - RNA, 432 nt, Artificial Sequence
  derived and/or modified sequence opt5 from anti-HIV_cap256-119-165738_VR-Chain
gaggugcagcuggucgaaagcggcgggggacucguucaacccggcagaucccugcggcuuucuugcgccgcuagcggguucaccuuugacgauuacgccaugaacugggugcgccaggcgccuggaaagggccuggaguggguggcuacaaucuccuucgacgggacggauaaauaucacgccgacgaugucuggggaagauuuaccauuucucgggacaauagcaagaaaacacucuaccugcagaugaacucccuucgcgccgaagauaccgcucuguauuacugugccaaggaccucagagaggaugaaugcgaggagugguggucugacuauuacgaucugggcaaacagcugccgugucgcaagagccggggcguggcugggguucucgacaaguggggacugggcacaauggugaccgucuccagc

SEQ ID NO: 39969 - RNA, 432 nt, Artificial Sequence
  derived and/or modified sequence opt5 from anti-HIV_cap256-119-164913_VR-Chain
caggaccaccugguggagagcggcgggggaggcguccaacccgggaagucccucagacugucuugcgccgcuagcggauucaccuuuuccgcccaugcgaugcacuggguucggcaggcuccuggcaaagggccggaauggguggccgugaucucucaugauggaggccagcaguucuaccgcgagagcgucaagggcagauuuacaauuucccgggacaacucuaaaaauacgcuuuaucugcaaauggaugggcuccgcggagaagacaccgcccuguacuauugugcuaaggaucuuagagagcuggaaugcgaggagugggccagcgacuacuaugauuucggccggccccagccuugucucgacccccgcgggguguccggaaucagcaacguuuggggccaggggacaauggugaccgucucuucc

SEQ ID NO: 39970 - RNA, 432 nt, Artificial Sequence
  derived and/or modified sequence opt5 from anti-HIV_cap256-119-164167_VR-Chain
gaggugagacuggucgaaagcggcgggggacucauccagcccggcgggucccugcggcuuucuugcgccgcuagcggacugaccguuuccucuaaucacaugagcugggugcgccaagccccuggcaaggggcucgaguggguggcguccauuucuuacgacggaagagauuucuaucaugcucggagcgucuggggccgcuuuacaaucuccagagacaauagcaaaaacacgcugcaccuucagaugaacucucugcggccggaagauaccgcccucuacuucugugcccgcgaccugagagaguccgaaugcgaggagugggaaagcuauuacuaugauuuuggcaagaaagggcccugugugaagccucggggaguugugggcguccuggacauuugggggcagggaacacucgugaccguuucuucc

SEQ ID NO: 39971 - RNA, 432 nt, Artificial Sequence
  derived and/or modified sequence opt5 from anti-HIV_cap256-119-163558_VR-Chain
cagaugcaacugguggagagcggcgggggagucguucagcccggcagaucccucacccugucuugcgccgcuagccaguucaacuuugccaauuacgggaugcacugggugcggcaggcgccuggaaagggccuugaauggguggcuuccaucucuuaugacgggagcgauaaauaccaugccgaccgcgucuggggaagauucacaauuucccgggauaacucuaagaauacgcuguaucuccaaaugaacagccugcgcgccgaggacaccgcucuuuacuauugugugagagaugcccgggaauccgagugcgaacugugggagagcgacuacuauaauuuuggccgcaaacucccguguguuaagcccagaggcguggcugggacacuggauaucuggggacagggcaccauggucacagugucuucc

SEQ ID NO: 39972 - RNA, 432 nt, Artificial Sequence
  derived and/or modified sequence opt5 from anti-HIV_cap256-119-162043_VR-Chain
caggugcaacuggucgagagcggcgggggaguugugcagcccggcagaucccuccgggugucuugcgccgcuagccacuucaccuuuucccgcuacgggaugcauugggucagacaggccccuggaaagggccuggaaugggugacagggaucucuuucgcggcuacgaaaaccuauuacggagacagcguucggggccgcuuuacaguguccagagauauuucuaagaacacccuuuaucugcagaugaauagccuccggccggaggacacagccauguacuauugugcccgcgaucaaagauacuaugaaugcgaggaaugggcuuccgacuacuacgauuucggccgggagcagcccugucaggacccucgcggggucgugggaauccuggaucuuuggggccaggggaccaugguuacagugagcucu

SEQ ID NO: 39973 - RNA, 432 nt, Artificial Sequence
  derived and/or modified sequence opt5 from anti-HIV_cap256-119-161718_VR-Chain
caggugcaacuggucgagagcggcgggggaguugugcagcccggcaagucccucagacugucuugcgccgcuagccacuucuccuuuaaucgguacgggaugcauugggugcgccaggccccuggaaaaggccuugaaugggucgcggcuaucucuuaugacgggaccgauaaguaccacgccgaccagguguggggaagauucacaauuagccgggauaauuccaaaaacacgcuguaucuccaaaugaacucucugcgcccggaggacaccgcccuuuacuauugugcuaaggaucugagagaagacgagugcgaagagugguggagcgauuacuaugaccucggcaaacagcugcccugucggaagucccgcggcguugccgggaucuuugauaaguggggacagggcacaauggugaccgucagcucu

SEQ ID NO: 39974 - RNA, 432 nt, Artificial Sequence
  derived and/or modified sequence opt5 from anti-HIV_cap256-119-161675_VR-Chain
caggugcaacuggucgagagcggcgggggaguugugcagcccggcagaucccuccggcugucuugcaccgccagcggguucacauuuuccaucuacucuaugaacugggugcgccaggcuccuggaaagggccuugacugggucgccgggauuagcuucgcggcuacgaaaaccuauuacggaggcuccgugaagggcagauuuacaguuucucgggauaucagcaaaaauacccuguaucuccagaugaacucccugcgcccggaagacacagccauguacuauugugccagagaucaacgguacuaugagugcgaagagugggcuagcgacuacuacgauuucgggcgcgaacagcccugucaggacccuagaggaguggucggcguguuugauaugugggggcagggaaccaugguuacagugucuucc

SEQ ID NO: 39975 - RNA, 432 nt, Artificial Sequence
  derived and/or modified sequence opt5 from anti-HIV_cap256-119-161053_VR-Chain
caggugcaccuggucgagagcggcgggggaguugugcaacccggcaccucccucagacugucuugcguggccagcggguucacauuuuccaacuucgcuaugcauuggguccggcaggccccuggaaagggccuugaaugggcggcuaucauuucuacgcgcgggaauaacagaaauuacgccgacagcgugcggggacgcuuuaccguuuccagagauaucucuaaaaacacacuguaucuccagaugaauagccugcggccggaggacaccgccauguacuauugugcucgcgaucagagauacuaugaaugcgaggaaugggccuccgacuacuaugauuucggccgggagcaacccugucaggacccucgcggcguggucgggauucuugaucuguggggacagggcacaauggugaccguuagcucu

SEQ ID NO: 39976 - RNA, 432 nt, Artificial Sequence
  derived and/or modified sequence opt5 from anti-HIV_cap256-119-159499_VR-Chain
caggugcaacuggucgagagcggcgggggaguugugcagcccggcagaucccuccggcugucuugcgccgcuagcggguucgccuuuucccacuacggaaucuucugggugcgccaggcgccuggcaaggggcuugaaugggucgcuucuauuagcuuugacggaagagauuauuaccauuccccgcacguguggggccggcugaccaucucucgcgacaacagcaaaaauacacucuaucugcagaugaacucccuuagagccgaggauacggcccuguacuauugugcucgggaccuccgcgaaagcgagagagaagagugggagucugauuacuaugacuucggcaagaaagggcccugcguuaagccucggggaguggccggcucccuggauaugugggggcaaggaaccauggucauugugagcucu

SEQ ID NO: 39977 - RNA, 432 nt, Artificial Sequence
  derived and/or modified sequence opt5 from anti-HIV_cap256-119-159114_VR-Chain
gaggugcagcuggucgaaagcggcgggggacucguucaacccggcgggucccugagacuugccugcgcugccucuggacugaccuuccggaagcacggcaugcauugggugcgccaggcgccugggaaaggacucgagugggugagcuacaucuccucugacggcgucaacaauuaucugauugauagcgugagaggccgguuuacaguuucccgcgacaacucuaagaauacgcuuuaccugcagauggaugggcucagaggagaagacaccgcucuguauuacugugccaaagaucugcgggagcucgaaugcgaggagugggccagcgacuauuacgauuucggccgcccgcagcccugucuggacccuagagggguguccggaaucagcaacgucuggggccaagggacaauggugaccguuucuucc

SEQ ID NO: 39978 - RNA, 432 nt, Artificial Sequence
  derived and/or modified sequence opt5 from anti-HIV_cap256-119-156751_VR-Chain
gaggugcagcugcucgaaagcggcgggggacugguccaacccggcgggucccuuagacugucuugcgccgcuagcggauucgccuuuuccucuuacggcaugcacuggguucggcaggcgccugggaagggacucgaguggguggcuagcaucuccuaugacggccgcgauuucuaccaugccagaucuguguggggccgguuuaccauuagccgcgacaacuccaaaaauacacugcaccuucagaugaacagccugagaccggaagauacggcccucuauuucugugcucgggaccugcgcgagucugaaugcgaggagugggaauccuacuauuacgauuuugggaagaaaggacccugugucaagccuagaggcgugguuggggugcuggacaucuggggacagggcacccucgucacagugagcucu

SEQ ID NO: 39979 - RNA, 432 nt, Artificial Sequence
  derived and/or modified sequence opt5 from anti-HIV_cap256-119-155656_VR-Chain
gaggugcagcuggucgaaagcggcgggggacucguucaacccggcgggucccugagacuuucuugcgccgcuagcggaaucaccuucuccucuuacggcaugcacugggugcggcaggccccugggaagggacuggaguggguggcguuuauucgcuaugacggcagcuccaaauacuaugcugauucugucaagggcagauucacaaucagccgggacaacuccaaaaauacgcucuaccugcagauggaugggcuucgcggagaagacaccgcccuguauuacugugccaaggaucucagagagcuggaaugcgaggagugggcuagcgacuauuacgauuuuggccggccgcagcccugucuggacccucgcggggugucuggaauuuccaacguuuggggccaagggacaauggugaccgucagcucu

SEQ ID NO: 39980 - RNA, 432 nt, Artificial Sequence
  derived and/or modified sequence opt5 from anti-HIV_cap256-119-154420_VR-Chain
caggugcggcuggucgagagcggcgggggaguugugcaacccggccggucccuccgcaucucuugcgccgcuagccaguucauguuuuccagauacgggaugcacugggugcggcaggccccuggaaagggccuggaaugggucgcgucuauuagcuaugacgggaccgauaaauaccaugcugaccuuguguggggacgcuucacaaucuccagagauaacucuaagaauacgcuguaucuccagaugaacagccugcgggccgaggacaccgcccuuuacuauugugcucgcgaucugagagaauccgagugcgaagagugggagagcgacuacuaugauuuuggcaaaaagggcccguguguuaaacccagagggguggccggaucucucgacauguggggccaagggacaauggucauuguguccagc

SEQ ID NO: 39981 - RNA, 432 nt, Artificial Sequence
  derived and/or modified sequence opt5 from anti-HIV_cap256-119-153954_VR-Chain
gaggugcagguccuggaaagcggcgggggacucguucaacccggcgggucccugagacuuucuugcguggccagccaguucaccuuuuccggauguggccugcacugggugcggcaggcuccugggaagggacucgagugggucgccucuaucagcuucgcgggcacgaaaaagcauuacggcaauuccgugaaagggcgcuuuacaauuucuagagacaauagcaagaacaccguuuaucuggaaaugaacucccuucgggcugaggauacagcccuguacuauugcgccaaagaccuccgcgaauacgagugugaggaauggaccagcgauuauuacgacuucggaagaccgcagcccugcaucgauucucggggcguggucgggauucuggacaucuggggacaaggcacaauggugaccguuuccagc

SEQ ID NO: 39982 - RNA, 432 nt, Artificial Sequence
  derived and/or modified sequence opt5 from anti-HIV_cap256-119-153864_VR-Chain
caggugcaccuggucgagagcggcgggggaguugugcaacccggcgggucccucagacugucuugcgccgcuagcggauucaccuuuuccggcugugggcuucauugggugcggcaggccccuggaaagggccuggaaugggucgcgucuaucagcuucgcuggcacgaaaaagcacuacggguccucugugcgcggaagauuuagcauuucccgggacaacagcaaaaauacacucuaucugcagaugaacucucuucgcaccgaggauacagcccuguacuucugcgccaaggaccucagagaauaugagugugaagaguggaccuccgauuacuaugacuuuggccggccgcagcccugcaucgauagccgcgggguugugggcauucuggacaucuggggacaagggacaauggucaccgugucuucc

SEQ ID NO: 39983 - RNA, 432 nt, Artificial Sequence
  derived and/or modified sequence opt5 from anti-HIV_cap256-119-153793_VR-Chain
gaggugcagcuggucgaaagcggcgggggaguugugcaacccggcgggucccucagacugucuugcgccaccagcggauucacauuuggcacguucgggaugcacugggugcggcaggcuccuggaaagggccuugacugggucgccuacauccgcuaugauggcaaaaccaagaacuacggggaguccgugaaaggaagauuuacaauuucucgggacaauagcaagaacaccaugucccugcagaugaacucucuccgcccggaagauacagcgcuguauuacugugcuaaagaccuuagagaggaugaaugcgaggagcgguggagcgacuauuacgauuucggcaagcagcugcccugucgcaaguccagagggguugccggaguguuugacaauuggggccaagggaccauggucacagugagcucu

SEQ ID NO: 39984 - RNA, 432 nt, Artificial Sequence
  derived and/or modified sequence opt5 from anti-HIV_cap256-119-153462_VR-Chain
caggugcaacuggucgagagcggcgggggaguugugcagcccggcgggucccucagacugucuugcgccgcuagcggauucaccuuuuccaacuacggcaugcagugggugcggcaggccccugggaagggacuugaaugggucgcggcuaucucuuaugacggccgcaaugaguacuaugccgaaagcgugaaaggcagauucacaauuucccgggauaacuuuaagucuacgcuguuccuccaaaugaauagccugcgcgccgaggacaccgcucuuuacuauugugccagagaucugcgggaauccgagugcgaggaaugggagagcgacuacuaugcuuuuuaccgcaaacucccguguguuaagcccagagggguggccggaacacuggauaucuggggccaggggaccauggucacagugucuucc

SEQ ID NO: 39985 - RNA, 438 nt, Artificial Sequence
  derived and/or modified sequence opt5 from anti-HIV_cap256-119-153124_VR-Chain
caggugcaacuggucgagagcggcgggggaguugugcagcccggcagaucccucacccugucuugcaucgccagccaguucaauuuugcuuccuacgggaugcacugggugcggcaggccccuggaaagggccuugaaugggucgcgucuauuagccaugacgggacgaaaaaguaucacgcugaguccguguggggacgcuucacaaucucuaaagauaauagcaagaacacccuguuucuccaaaugaacucccugagaguugaagacacagcccuuuacuucugugugaaagaucagcgggaggacgaaugcgaggagugguggagcgauuauuacgacuuuggccgcgaacugccguguagaaagucucggggccucgggcuggccggaauuuucgauauguggggccaugggaccauggucacaguguccagc

SEQ ID NO: 39986 - RNA, 438 nt, Artificial Sequence
  derived and/or modified sequence opt5 from anti-HIV_cap256-119-153025_VR-Chain
cagaugcaacugguggagagcggcgggggagucguucagcccggcaagucccucacccugucuugcgccgcuagccaguucacauuuuccaauuacgggaugcacugggugagacaggccccuggaaaaggccuugaauggguggcgucuaucagcaaugacgggaacaagaaauaucauggagauuccgucuggggccggcugacgauuucucgcgacaauagcaagaacacccucuuccugcaaaugaacucccuuagaccggaggauacagcucuguacuuuugugugaaagaccagcgggaagaugagugcgaagagugguggagcgacuauuacgauuucggccgcgagcuccccuguagaaaguuucgggggcugggacuggccggcaucuucgacauuugggggcacggaaccaugguuacagugucuucc

SEQ ID NO: 39987 - RNA, 432 nt, Artificial Sequence
  derived and/or modified sequence opt5 from anti-HIV_cap256-119-152713_VR-Chain
gaggugcagcuggucgaaagcggcgggggacucguuagacccggcgggucccugcggcuuucuugcgccaccagcggauucacauuuuccucucacuggaugagcugggugcgccaagcuccuggcaaggggcuggaguggguggccggaaucuccuucgcgggcacgaaaaccuacuauggcgacucugucaaggggagauuuacagugagcaccgauauuuccaaaaacacacucuaccugcagguuaauagccuucggccggaagacaccgcuauguauuacugugcccgcgaucagagauauuacgagugcgaagagugggccucugacuauuacgauuucggaaaggagcagcccugucuggacccucggggcguggucgggaucuuugauauuuggggacaaggcacaauggugaccguuuccagc

SEQ ID NO: 39988 - RNA, 438 nt, Artificial Sequence
  derived and/or modified sequence opt5 from anti-HIV_cap256-119-151794_VR-Chain
cacgugcagcuggucgagagcggcgggggaguugugcaacccggcaccucccucagacugucuugcguggccagcgaguucuccuuuaagaacuacgggaugcauuggguccggcaggcuccuggaaaaggccuugaauggguggccucuaucagcaaugacgggacaaagaaauaucacgcggaauccguuugggaucgcuucucuauuagcaaggacaacuccaaaaauacgcuguuucuccagaugaacagccugagaguggaggauaccgcucuuuacuucugugucaaggaccagcgggaagaugagugcgaggaaugguggucugacuauuacgauuuuggacgcgagcugccguguagaaagucccggggccucggccuggccgggaucuucgacauguggggacauggcacaauggugaccguuagcucu

SEQ ID NO: 39989 - RNA, 438 nt, Artificial Sequence
  derived and/or modified sequence opt5 from anti-HIV_cap256-119-150980_VR-Chain
caggugcaacuggucgagagcggcgggggaguugugcagcccggcaagucccucagacugucuugcgccgcuagcggguucauccuuuccaacuacgccaugcacugggugcggcaggcgccuggaaaaggccuggaaugggucgcuucuauuagcaaugacggguccaagaaauaucauggagauucugugugggcccgcuuuaucauuagcagagacaacuccaagaauacccucuuccugcagaugagcucucuucgggccgaggauacagcucuguacuuuuguguucgcgaccacagagaagaugagugcgaagaguggugguccgacuauuacgauuucggccgggagcucccgugucgcaaauuuagaggccuggggcuggccggaaucuucgacauuuggggccaugggacgauggugaccgucagcucu

SEQ ID NO: 39990 - RNA, 432 nt, Artificial Sequence
  derived and/or modified sequence opt5 from anti-HIV_cap256-119-148895_VR-Chain
caggugcaacuggucgagagcggcgggggaguugugcagcccggccggucccuccggcugucuugcgccgcuagcggguucaccuuucgcuccuacggaaugcacugggugagacaggccccuggcaaggggcuugaaugggucgcggugaucucuagcgacggagauauugaguauuacacacaguccguuaaaggccgguucacgaucucucgcgacaacagcaagaauacccuguaucuccaaaugaacgcucugagaccggaagauacagccauguacuauugugcccgggaccagcgcuacuaugagugcgaagagugggcuuccgauuacuacgacuuuggcagagagcagcccugucaggauccuagagggguggucggaguguucgacauguggggccaagggaccaugguuacagugagcucu

SEQ ID NO: 39991 - RNA, 438 nt, Artificial Sequence
  derived and/or modified sequence opt5 from anti-HIV_cap256-119-148848_VR-Chain
cagaugcaacugguggagagcggcgggggagucguucagcccggcagaucccucacccugucuugcgccgcuagccaguucuccuuuacaucuuacgggaugcacugggugcggcaggccccuggaaagggccuugaauggguggcgagcaucuccaacgacgggacgaaaaaguaucauggagagucugucugggaucgcuucagcauuuccagagacaauagcaaaaacacccuguuucuccaaaugaacucucugcggguggaagauacagcucuuuacuucuguguuaaggaccagcgcgaggaugaaugcgaggaguggugguccgacuauuacgauuuuggcaaagaacugccguguagaaaguggaagacccggggcguggccgggauccucgacaauuggggacagggcacaaugcugaccgucagcucu

SEQ ID NO: 39992 - RNA, 432 nt, Artificial Sequence
  derived and/or modified sequence opt5 from anti-HIV_cap256-119-148743_VR-Chain
caggugcaacuggucgagagcggcgggggaguugugcagcccggcagaucccucacccugucuugcgccgcuagccaguucaauuuugccaauuacgggaugcacugggugcggcaggcgccuggaaagggccuugaaugggucgcuuccaucucuaacgacgggacgaaaaaguaucaugccgagagcgugugggaucgcuucuccauuucuaaagacaauagcaagaacacacuguuucuccaaaugaacucccugagaguugaagauaccgcccuuuacuucugugugaaagaccagcgggaggaugaaugcgaggagugguggagcgacuauuacgauuuuggaaagaagcugccgugucgcaaaucuagaggccucgcuggcaucuuccacgucugggggcauggaacaauggugaccguuuccagc

SEQ ID NO: 39993 - RNA, 432 nt, Artificial Sequence
  derived and/or modified sequence opt5 from anti-HIV_cap256-119-148595_VR-Chain
gaggugcagcuggucgaaagcggcgggggacucguucaacccggcgggucccugagacuuucuugcgccgcuagccgguucaccuuugacaacuacggaaugcacugggugcgccaggccccuggcaaggggcuggaguggguggcgcuccugaauuaugauggauccaaaaaguacuaugucgacucugugaaaggcagauucaucauuuuucgggauaacagcaagaauacacuuuuccugcagaugaacucccuccgcccggaagacacggcucuguacuuuuguguuaaagaucagagagaggacgccugcgaagagugguggucugauuauuacgacuucggcaagaagcugcccugucggaaaagccgcgggcucgccggaaucuuucauguguggggccacgggaccauggucacaguguccagc

SEQ ID NO: 39994 - RNA, 432 nt, Artificial Sequence
  derived and/or modified sequence opt5 from anti-HIV_cap256-119-148490_VR-Chain
caggugcaacuggucgagagcggcgggggaguugugcagcccggcagaucccuccggcugucuugcguggccagcggguucaccuuuuccgacuacgcuaugcacuggguccgccaggccccuggaaagggccuugaauggguggcgacaaucucuuucgauggggcugacaaauaucaugccgaugacguuuggggaagauuuacgauuagccgggauaacuccaagaauacccuguaccuccagaugaacucucugcgcccggaggacacagcccuuuauuacugugcuaaagaucugagagaagacgagugcgaggaacgguggagcgauuauuacgacuucggcaagcaacuccccugucgcaaauccagaggcguggccggggucuuugauaauuggggacagggcaccauggugacaguuagcucu

SEQ ID NO: 39995 - RNA, 438 nt, Artificial Sequence
  derived and/or modified sequence opt5 from anti-HIV_cap256-119-148470_VR-Chain
caggugcaacuggucgagagcggcgggggaguugugcagcccggcagaucccuccggcugucuugcguggccagcggguucaccuuuuccucuuacggaauccacuggguccgccaggcuccuggcaaggggcuugaauggguggccguuauuagcgacgauggauccaaaaaguaucaugaggaaucuguguggggcagauucacaaucagcaaagacaacuccaagaauacgcuguuucuccagaugaacagccugcggauugaggauaccgcgcuuuacuucugugucaaagaccaacgcgaagaugagugcgaggaaugguggucugacuauuacgauuuuggcagagagcugccgugucggaagucccgcgggcucggacuggcuggcaucuucgacaugugggggcacggaacaauggugaccguuagcucu

SEQ ID NO: 39996 - RNA, 432 nt, Artificial Sequence
  derived and/or modified sequence opt5 from anti-HIV_cap256-119-148107_VR-Chain
gaggugcagcuggucgaaagcggcgggggacucguucaacccggcgggucccugcggcuuucuugcgccgcuagcggauucaccguguccucuaacuacaugacaugggugcggcaggccccucgcaagggccuggagugggucgggagcaucuccuaugacggaucugauaaauaccacacgaauagccucuggggcagauuuauugugucccgggacaacagcaagaauacccuguaucuucagaugaacaaucugcgcccggaagauacagcgcucuacuauuguguuagagaccggcgcgagucugaaugcgaggagagaugguccgauuacuaugacuucggcaaacagcugcccugugugaagccuagaggggucgcuggaaucuuugauauuuggggccaagggaccauggugacaguuagcucu

SEQ ID NO: 39997 - RNA, 432 nt, Artificial Sequence
  derived and/or modified sequence opt5 from anti-HIV_cap256-119-147933_VR-Chain
gagcugcagcucguggaaagcggcgggggacugguccaacccggcuggucccuuagacugucuugcgaggccagcggguucccuuuuuccgcuuucuggaugaccuggguucggcaggccccgggaaagggccucggguggguggcguuuauccgcuacgacggaucuaacaaauauuacgcugauagcgugaagggcagauucacaauuucccgggacaauucuaugacgacccuguaucuucagaugaacagccugcgcgccgaagaugccgcugucuacuauugugccaaagaccucagagaggaugaaugcgaggaguggugguccgacuacuaugauuuuggcaagcggcugcccugucgcaaaagcagagggguggcuggaguuuucgacaaguggggccaggggacaauggugaccgucucuucc

SEQ ID NO: 39998 - RNA, 432 nt, Artificial Sequence
  derived and/or modified sequence opt5 from anti-HIV_cap256-119-147434_VR-Chain
caggugcaacuggucgagagcggcgggggaguugugcaggccggcagaucccuccggcugucuugcgcugccagccaguucaccuuugggcgcuacggaaugcacugggugagacaggcgcccggcaaggggcuugaaugggucggauccaucucuuaugacggcagcgauaaauaccauacaaauuccguguggggccgguucauuguuucucgcgacaauagcaagaacacgcuguaucuccaaaugaacucccugagaccugaggauaccgcuauguacuauugugcccgggaccagcgcuacuaugaaugcgaggaaugggccagcgauuacuacgacuuugggagagagcagccgugucaggauccccggggaguggucggcguguucgacaugugggggcaaggaacaaugguuaccgugucuucc

SEQ ID NO: 39999 - RNA, 435 nt, Artificial Sequence
  derived and/or modified sequence opt5 from anti-HIV_cap256-119-146106_VR-Chain
caggugcaacuggucgagagcggcgggggaguugugcagcccggcagaucccuccggcugucuugcgccgcuagcggguucaccuuuuccucuagcggaaugcacugggugcgccaggccccuggcaaggggcuucagugggucgcggugaucuccuacgacggaggcaacaaauauuacgcugauucuguuaagggcagauucacaauuagccgggacaauuccaaaaacaaucuguaucuccaaaugaacagccugcgcccggaagauacggcccuuuacuauugugccagagaccugcgggagauggaaugcgaggaauggaagcucuacaauuauuacgauuuucgcaccagagggcccuguguggacccucggggagucgugggcucuuucgauguuugggggcagggaacaguggucaccguguccagc

SEQ ID NO: 40000 - RNA, 438 nt, Artificial Sequence
  derived and/or modified sequence opt5 from anti-HIV_cap256-119-145604_VR-Chain
gacgugcagcuggccgagagcggcgggggacucguccaacccggcgggucccugagacuuucuugcguugcuagcggauucaccuuuuccucuuucgaaaugcacugggugcggcaggccccuggcaaggggcuggaguggguggcgagcaucuccaaugauggaacaaaacgcuaccaugcugaaucugucugggacagauuuagcauuuccaaggauaauagcaaaaacacccucuuccugcagaugaacucucuucggguggaggacacggcccuguauuuuuguguuaaggaucagcgcgaagacgagugcgaggaauggugguccgauuacuaugacuucggcagagagcucccgugucggaaaagccgcggccuggggcuggccggaaucuuugauauguggggccacgggacaauggugaccgucucuucc

SEQ ID NO: 40001 - RNA, 438 nt, Artificial Sequence
  derived and/or modified sequence opt5 from anti-HIV_cap256-119-143998_VR-Chain
caggugcaacuggucgagagcggcgggggaguugugcagcccggcagaucccuccggcugucuugcgccgcuagcggguucaccuuucgcaacuacggaaugcacugggugagacaggccccuggcaaggggcuugaaugggucgcguccaucucuaaugacggaagcaaaaaguaucauggcgauuccgugugggcucgguucauuaucucucgcgacaacagcaaaaauacacuguuucuccagauguccagccugagagccgaggauacggcccuuuacuucuguguuaaggaccaacgggaagaugagugcgaagagugguggucugacuauuacgauuuuggccgcgagcugccguguagaaaaucccgggggcucggacuggcuggcauuuucgacaugugggggcacggaaccauggugacagucagcucu

SEQ ID NO: 40002 - RNA, 438 nt, Artificial Sequence
  derived and/or modified sequence opt5 from anti-HIV_cap256-119-143441_VR-Chain
gaggugcaccuggucgaaagcggcgggggacucgcccagcccggcagaucccugcggcuuucuugcgcugccagccaauucaacuuugcguccuacgggaugcauuggguucgccaggcuccuggaaagggccuggaguggguggccucuaucagcaaugacgggaccaaaagauaucacgccgaauccgugugggaucgguucucuauuagcaaggacaacuccaaaaauacacucuuucugcagaugaacagccuucgcgucgaggauacggcucuguacuucugugugaaggaccagagagaagaugagugcgaggaaugguggucugacuauuacgauuuuggacgggagcucccgugucgcaaauccagaggccugggccuggccgggaucuucgacauguggggacauggcaccaugguuacagugagcucu

SEQ ID NO: 40003 - RNA, 432 nt, Artificial Sequence
  derived and/or modified sequence opt5 from anti-HIV_cap256-119-141307_VR-Chain
caggugcaccuggucgagagcggcgggggaguugugcaacccggcagaucccuccggcugucuugcgccgcuagccaguucaccuuuaaucgcuacgggcuucauugggugagacaggccccuggaaagggccuggaaugggucgcggggaucuccuaugacggacgggauaaauaccacgcucauuucguguggggccgcuuuauuaucucuagagacaauagcaagaacacacucuaucugcagaugaacucccuucgggccgaggauacggcccuguacuauuguguucgcgaccucagagaaucugagugcgaacugugggagagcgauuacuaugacuucggcaaacggcugccgugugugaagccccgcggggucgcuggaaccuuugaucucuggggccaagggacaauggugaccguuuccagc

SEQ ID NO: 40004 - RNA, 432 nt, Artificial Sequence
  derived and/or modified sequence opt5 from anti-HIV_cap256-119-140896_VR-Chain
gaggugaagcuggucgaaagcggcgggggacucguucagcccggcgggucccugaaacuuucuugcgccgcuagcggauucaccuuuuccuacuaugccaugcacugggugagacaagcgccuggcaaggggcuggaguggguggcugucaucucuuacgacggaagcgauaaauauuacgccgacuccgugaagggccgguucacaauuucucgcgauaacagcaaaaauacgcuccaucugcagaugaacucccuuagaccggaagacaccgcccuguauuuuugugcucgggaucuccgcgagagcgaaugcgaggagugggaaucuuacuauuacgacuucggcaagaaggggcccuguguuaaaccuagaggaguggucggcgugcuggauaucugggggcagggaacacugguuaccguguccagc

SEQ ID NO: 40005 - RNA, 432 nt, Artificial Sequence
  derived and/or modified sequence opt5 from anti-HIV_cap256-119-140090_VR-Chain
gaggugcagcuggucgaaagcggcgggggacucguucaacccggcgggucccugagacuuucuugcgccgcuagcggauucgccuuuuccucuuacuggaugaccugggugcggcaggcgccuggcaaggggcuggaguggguggcugucaucagcuaugacggauccaacaaauacuaugccgauucugugcgcggcagauucacaauuagccgggacuccagcaagaauacgcucuaccuggaaaugaacucucuucgcccggaggauaccgcccuguauuacugugcuaaagacaugagaggcuaugaaugcgaggaguggacauccgauuacuacgacuuugggcggccccagccuuguaucgauagccgcggaguugugggcaccuucgacgucugggggcagggaacaauggugaccguuucuucc

SEQ ID NO: 40006 - RNA, 438 nt, Artificial Sequence
  derived and/or modified sequence opt5 from anti-HIV_cap256-119-140037_VR-Chain
caggugcaacuggucgagagcggcgggggacucguucagcccggcagaucccugcggcuuucuugcgccgcuagcggguucaccuuugacgauuacgugaugcacugggugcgccaggccccuggaaagggccuggaaugggucgcguccaucucuaacgacgggacgaaaaaguaucaugaggaaagcguguggggaagauucacaauuuccaaagauaauucuaagagcacccucuuucugcagaugaacucccuucggaucgaggacacagcucuguacuucuguguuaaagaucaacgcgaagacgagugcgaggaaugguggagcgauuauuacgacuuuggcagagagcucccgugucggaagucucgcggccuggggcuggccggaauuuucgauauguggggccacgggaccauggugacagucuccagc

SEQ ID NO: 40007 - RNA, 432 nt, Artificial Sequence
  derived and/or modified sequence opt5 from anti-HIV_cap256-119-139135_VR-Chain
gaggugcagcuggucgaaagcggcgggggaguugugagacccggcggguccgugcggcucucuugcgucgccagcggauucuccuuucgcucuuacggcaugcacugggugagacaagcuccugggaagggacuggaguggguugccagcaucuccuaugacggccgggauuucuaccacgcgcgcucuguguggggcagauuuaccauuagccgggacaacuccaaaaauacacuucaucugcagaugaacagccuccgcccggaagauacggcucuguauuucugugccagagaccuucgggagucugaaugcgaggagugggaauccuacuauuacgauuuugggaagaaaggacccugugucaagccucgcggcgugguuggggugcuggacaucuggggacagggcacccucgucacagugagcucu

SEQ ID NO: 40008 - RNA, 438 nt, Artificial Sequence
  derived and/or modified sequence opt5 from anti-HIV_cap256-119-137881_VR-Chain
caggugcaacuggucgagagcggcgggggacucguuaagcccggcagaucccugacccuuucuugcgccgcuagccaguucacauuuuccaacuacgggaugcacugggugcggcaggccccuggaaaaggccuggaauggguggcgucuaucagcaaugacgggaacaagaaauaucauggagauuccgucugggcucgcuucacgauuucuagagacaauagcaagaacacccucuuucugcagauguccagccuucggacagaggauaccgcccuguacuucugugugcgcgacagacgggaagaugagugcgaagagugguggucugacuauuacgauuuuggccgcgagcucccguguagaaaauuccggggccuggggcuggccggaaucuuugacauuuggggccacgggacaaugguuaccguguccagc

SEQ ID NO: 40009 - RNA, 432 nt, Artificial Sequence
  derived and/or modified sequence opt5 from anti-HIV_cap256-119-137643_VR-Chain
gaggugcagcuggucgaaagcggcggggaccucguucaacccggaggcucccugagacuuucuugcgccgcuagcggguucuccuuuucuagcuacggaaugcacugggugcggcaggccccugauaagggccuggagugggugaccgucaucuccuaugacgggucuaacaaacauuacgcggauagcgugaagggacgcuucacaauuuccagagacaauagcaaaaacacgcucuaucuggaaaugaauacccuucgggcugaggauacagcccuguacuauugugccaaggaccuccgcgaauacgagugcgaggaauggaccucugauuauuacgacuuuggcagaccgcagcccuguaucgauucccggggcguuguggggauucuggacaucuggggacagggcacaauggucagcgugucuucc

SEQ ID NO: 40010 - RNA, 438 nt, Artificial Sequence
  derived and/or modified sequence opt5 from anti-HIV_cap256-119-137170_VR-Chain
caggugcaacuggucgagagcggcgggggaguugugcagcccggcagaucccuccggcugucuugcgccgcuagcgaguucaccuuuucccgcuacucuaugcacugggugagacaggccccugggaagggacuugaaugggucgcggugaucagcuccgacggcucuaaucaguuccaugcugauagcguuugggggcgguuuacaauuuccaaagacaauagcaagaacacgcuguuccuccaaaugaacucucugcgcaucgaagauaccgcccuuuauuuuugugugaaagaccagagagaggaugaaugcgaggaguggugguccgacuacuaugauuucggacgggaacugccgugucgcaagagcagaggccucggccuggccgggauuuuugacauguggggacacggcacaauggucaccgugucuucc

SEQ ID NO: 40011 - RNA, 432 nt, Artificial Sequence
  derived and/or modified sequence opt5 from anti-HIV_cap256-119-136616_VR-Chain
caggugcaacuggucgagagcggcgggggaguugugcagcccggcagaucccuccggcugucuugcgccgcuagcggguucaccuuuucccgcaacgccaucaauugggugagacaggcgccuggacggggccuugaaugggucgcugugauuucugacgaugggagccugaaguacuaugccgacuccguuaaaggacgcuucacaaucucuagagauaacagcaagaauacgcucuaccugcagaugaacaaucuucggccggaggacaccgcccuguauuacugugugcgcgauagacgggaauccgagugcgaggaacgcuggagcgacuauuacgauuuuggcaaacaacuccccugugucaagccuagaggcguggcugggauuuucgacaucuggggacagggcacaaugguuaccgugucuucc

SEQ ID NO: 40012 - RNA, 432 nt, Artificial Sequence
  derived and/or modified sequence opt5 from anti-HIV_cap256-119-136206_VR-Chain
caggugcaacuggucgagagcggcgggggaguugugcagcccggcagaucccuccggcugucuugcgccgcuagccaguucaccuuugggcgcuacggaaugcacugggugagacaggccccuggcaaggggcuugaaugggucgcggcuaucuccuucgccggaacgaaaaaguauuacggcgacucugcccggggccgcuuuacaauuagcagagauaacuccaaaaauaugcuguuccuccaaaugaacucucugcgggcugaggacaccgcccuuuauuacugugcucgcgaucugagagacuaugaaugcgaggaaugggaggccuacuauuacgauuuugggcgggugggaccguguacagacccccgcggcguuguggggauccucgaugucuggggacagggcacccuggugacaguuagcucc

SEQ ID NO: 40013 - RNA, 438 nt, Artificial Sequence
  derived and/or modified sequence opt5 from anti-HIV_cap256-119-135565_VR-Chain
caggugcaccuggucgagagcggcgggggaguugugcaacccggcaagucccucagacugucuugcgccgcuagccaguucaccuuugaccgguacgggaugcauugggugcgccaggccccuggaaaaggccuugaaugggucgcguccaucucuaacgaugggacagacaaguaucacgcugauaauguguggggaagauucacgauuagccgggacaacuccaaaaauacccuguaccucgagaugaacucucugcgcggcgaagauacagcccuuuauuuuuguguuaaggaccagagagaggaugaaugcgaggagugguggagcgacuacuaugauuucggccgggaacugccgugucgcaaauccagagggcucggacuggccggcaucuuugacaugugggggcauggaaccauggugacagucagcucu

SEQ ID NO: 40014 - RNA, 432 nt, Artificial Sequence
  derived and/or modified sequence opt5 from anti-HIV_cap256-119-135025_VR-Chain
gaggugcagcuggucgaaagcggcgggggacucguucaacccggcgggucccugagacuuucuugcgaggccagcggauucaccuuuaacacauacgaaaugaauugggugcggcagccuccgggccgcgggcuggaguggguggcuggaaucuccuucgccgcgacgaagaccuauuacggcggcucugucaaagggagauuuacagugagccgggacauuuccaagaacacccucuaucugcagauggauggacuucgcggcgaagacacagcucuguacuauugugccaaagaucucagagagcuggagugcgaagagugggccucugacuacuaugauuucgggcggccccagccuugucuggacccccgcggaguuagcggcaucuccaaugugugggggcaaggaaccauggucacagugagcucu

SEQ ID NO: 40015 - RNA, 432 nt, Artificial Sequence
  derived and/or modified sequence opt5 from anti-HIV_cap256-119-133983_VR-Chain
cagaugcaacugguggagagcggcgggggagucguucagcccggcagaucccucacccugucuugcgccgcuagccaguucaacuuugccaauuacgggaugcacugggugcggcaggcgccuggaaagggccuugaauggguggcuuccaucucuaacgacgggacgaaaaaguaucaugaggaaagcgucuggggacgcuucacaauuuccaaagauaauucuaagaacacccuguuucuccaaaugaauagccugagaccggaggacacagcccuuuacuauugugccaaagaucugcgggaagacgagugcgaggaacgcugguccgauuacuaugacuucggcaagcagcuccccuguagaaagagccggggcguggcugggguuuuugauaacuggggacagggcaccauggugacagucucuucc

SEQ ID NO: 40016 - RNA, 438 nt, Artificial Sequence
  derived and/or modified sequence opt5 from anti-HIV_cap256-119-133917_VR-Chain
cagaugcaacugguggagagcggcgggggagucguucagcccggcagaucccucacccugucuugcgccgcuagccaguucacauuuuccaacuacgggaugcacugggugcggcaggccccuggaaagggccuugaauggguggcgucuaucagcaaugacggguccaaaaaguaucauggagauucugucugggcucgcuucacgauuagcagagacaacuccaaaaauacccuguuucuccaaaugagcucucugcggguggaggauacagcccuuuacuucuguguucgcgaccagagagaagaugagugcgaagaguggugguccgacuauuacgauuuuggccgggagcugccgugucgcaaguucagaggccucgggcuggccggaaucuuugacauuuggggccacgggaccauggugacagucagcucu

SEQ ID NO: 40017 - RNA, 432 nt, Artificial Sequence
  derived and/or modified sequence opt5 from anti-HIV_cap256-119-132663_VR-Chain
caggcccaacugguggagagcggcgggggagucguucagcccggcagaucccuccggaucucuugcgcugugagccaguucaccuuuucccgcuacgggaugcacugggugagacaggccccuggaaagggccuggaaugggucgcgucuauuagcuucgacgggcgggauaaauaucauuccccgcuuguguggggacgccugacaaucucuagagacaacagcaagaauacgcucuuucuggagaugaacucccuucgggcugaagauaccgccguuuacuauugugcccgcgaccugagagagagcgaaugcgaggaguggcaaucugauuacuaugcuuucuacaaaaagcuccccugugugaaaccucggggcgucgccggcucccuggacauuugggggcagggaacagugguuaccgugagcucu

SEQ ID NO: 40018 - RNA, 438 nt, Artificial Sequence
  derived and/or modified sequence opt5 from anti-HIV_cap256-119-132113_VR-Chain
caggugcaacuggucgagagcggcgggggacucguuaagcccggcgggucccugagacuuucuugcgccgcuagccaguucaacuuugccaauuacggaaugcacugggugcggcaggcgccuggcaaagggcuggaauggguggcuuccaucucuaacgacggaaccaagaaauaucaugaggaaagcgucuggggccgcuucacaauuuccaaggauaauucuaaaagcacgcucuuucugcagaugaacucccuuagaaucgaggacaccgcccuguacuucugugugaaggaucaacgggaagacgagugcgaggaaugguggagcgauuauuacgacuuuggccgcgagcucccguguagaaagucucgggggcugggacuggccggcauuuucgauaugugggggcacggaacaaugguuaccguguccagc

SEQ ID NO: 40019 - RNA, 432 nt, Artificial Sequence
  derived and/or modified sequence opt5 from anti-HIV_cap256-119-131839_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacaaauacuaugccgauucuguuaagggaagauucacaauuagccgggacaauuccaaaaacacgcuguaccuccagaugaauagccugcgcgccgaggauaccgcuguguauuacugugccagagaccaacgguauuacgaaugcgaggaaugggcuucugauuacuaugacuuuggccgcgagcagccgugucaggaucccagaggcgucguggggguuuucgacauguggggacagggcacaauggugaccgucuccagc

SEQ ID NO: 40020 - RNA, 435 nt, Artificial Sequence
  derived and/or modified sequence opt5 from anti-HIV_cap256-119-130626_VR-Chain
gaggugcagcuggucgaaagcggcgggggacucauccaccccggcgggugccugagacuuuccugugccguuucuggauucaccuuuagcgacuacccuaugcauugggugcggcaauccccgggcaaggggcuggaguggguggcugucauuucuuaugauggaaucaacuacuauuacgccgacagcgugaaaggccgcuucacaauuuccagagauaauucuaagaacaaucucuuucugcagaugaacagccuucggcuggaagacacggcgcucuauuacugcgcucgcgaucugagagagcuggacugugaagaguggacccucuauaauuacuacgauuucggcucccgggggcccugcguugacccucgcggagugggcgggagcuuugaugucuggggacagggcacaauggugaccguuucuucc

SEQ ID NO: 40021 - RNA, 438 nt, Artificial Sequence
  derived and/or modified sequence opt5 from anti-HIV_cap256-119-130191_VR-Chain
gaggugcagcuggucgaaagcggcgggggacucauccaacccggcagaucccugcggcuuucuugcgccgcuagcggguucaccguuuccucuaacuuuaugacaugggugcgccaggccccuggaaagggccuggaguggguggcgagcauuuccaaugacgggacgaaaaaguaccacgcugaaucugucugggauagauucagcaucuccaaagacaacagcaagaauacccucuuucugcagaugaacucucuucggguggaggauacagcccuguauuucuguguuaaagaccagcgcgaagaugagugcgaggaauggugguccgacuacuaugauuuuggaagagagcucccgugucgcaagagccggggccugggccuggccgggauuuucgacauguggggacauggcaccauggugacagucucuucc

SEQ ID NO: 40022 - RNA, 438 nt, Artificial Sequence
  derived and/or modified sequence opt5 from anti-HIV_cap256-119-129798_VR-Chain
caggugcaacuggucgagagcggcgggggaguugugcagcccggcaagucccucagacugucuugcgccgcuagcggguucaucuuuuccucuuacuucaugcacugggugcggcaggccccuggaaaaggccuugaaugggucgcggugguuaccgacgaugggagcaagaaauauuacgcugacuccgugaagggacgcuuuacaauuucuagagauuauagcaaaaacacgcuguuccuccagaugaaucggcugcgcgucgaggacaccgcccuuuacuuuugugugaaggaucaaagagaagacgagugcgaagaguggugguccgauuauuacgacuucggccgggagcugccgugucgcaaguuuagaggccucgggcuggccggaaucuucgauauguggggccaugggacaaugguuaccgugagcucu

SEQ ID NO: 40023 - RNA, 432 nt, Artificial Sequence
  derived and/or modified sequence opt5 from anti-HIV_cap256-119-128745_VR-Chain
caggugcaacuggucgagagcggcgggggaguugugcagcccggcagaucccuccggcugucuugcgccgcuagcggguucaccuuuuccaacuacgccaugcacugggugcgccaggcgccuggaaagggccuugaaugggucgcuucuaucagcuucgccgggacaaaaacgcauuauggaaauuccgugaagggcagauuuucuauuagccgggacaacuccaucaauaccguuuaccugcagaugaacagccuccgcgccgaggauacagcucuguauuacugugccaaagaccuuagagaauaugagugcgaagaguggaccucugauuacuaugacuucggccggccgcaacccuguauugauucccgcgggguggucggaauccuggacauuuggagccagggcacaauggugaccguuucuucc

SEQ ID NO: 40024 - RNA, 438 nt, Artificial Sequence
  derived and/or modified sequence opt5 from anti-HIV_cap256-119-128593_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcuagcaucuccuaugacgggagagauuucuaccaugcccggucuguguggggacgcuuuacaauuagcagagacaacuccaaaaauacgcugcaccuccagaugaacagccugcggguugaggauaccgcccuuuauuucugugugaaggaccaacgcgaagaugagugcgaagagugguggucugacuacuaugauuuuggcagagagcugccgugucggaaaucccgcggccucgggcuggcuggaaucuucgacauuuggggccaugggacaauggucaccgugagcucu

SEQ ID NO: 40025 - RNA, 438 nt, Artificial Sequence
  derived and/or modified sequence opt5 from anti-HIV_cap256-119-128152_VR-Chain
caggugcaacuggucgagagcggcgggggaguugugcagcccggcagaucccuccggcugucuugcgccgugagcggguucaccuuuacauccuacccuaugcacuggguccgccaggcuccgggaaagggccuugaauggguggccucuguuagcaacgacgggacgaaaaaguaucauggagauuccgugugggacagauucaccaucucucgggauaauagcaaaaacacacuguuucuccagauguccagccugcgcgcggaggacaccgcugucuacuucugugugagagaugaacgggaggacgaaugcgaggagugguggucugauuauuacgacuuuggccgcgaacuucccuguagaaaguuccggggccuggggcucgccggaauuuuugauaucuggggccacgggacacugguuaccguguccagc

SEQ ID NO: 40026 - RNA, 438 nt, Artificial Sequence
  derived and/or modified sequence opt5 from anti-HIV_cap256-119-127693_VR-Chain
gaggugcagcugcucgaaagcggcgggggacugguccaacccggcgggucccuuagacugucuugcgccgcuagcggauucaccuuuuccucuuacgccauggcguggguucggcaggcuccuggcaaggggcucgaguggguggccagcaucuccaacgacggaucuaaaaaguaucacggcgauagcgugugggcccgcuucauuaucuccagagacaauagcaaaaacacacuguuucuucagaugucuucccugcgggucgaagauacggcucucuacuucugugugcgcgaccauagagaggaugaaugcgaggagugguggagcgacuauuacgauuuuggccgggaacugccgugucgcaaguucagagggcugggacucgccggcauuuuugacaucugggggcacggaaccaugguuacagugucuucc

SEQ ID NO: 40027 - RNA, 432 nt, Artificial Sequence
  derived and/or modified sequence opt5 from anti-HIV_cap256-119-126684_VR-Chain
caggugcaacuggucgagagcggcgggggagccguuagacccggccggucccuccgccugucuugcgcuaccagcggguucacauuuuccaacuacgccaugcacugggugagacaggcgccuggaaagggccuugaaugggugacggggaucucuuucgcuggaaccaaaacauauuacggcgacagcguccggggccgcuuuaccguguccagagauauuucuaagaauacacuguuccuccagaugaacagccugcggccggacgauaccgccauguauuacugugcccgcgaccagagauauuacgagugcgaagagugggcuuccgauuauuacgacuuugggcgggaacaacccugucuugauccucgcggaguugugggcaucuucgaccugugggggcagggaacaauggucaccgugagcucu

SEQ ID NO: 40028 - RNA, 438 nt, Artificial Sequence
  derived and/or modified sequence opt5 from anti-HIV_cap256-119-126056_VR-Chain
gaggugcagcuggucgaaagcggcgggggacucguucaacccggcgggucccugagacuuucuugcgccgacagcggauucaccuuuuccucuuacuggaugagcugggugcggcaggcuccuggcaaggggcuggaguggguggccuccaucucuaaugauggaacgaaaaaguaucacgcggaaagcgucugggaccgcuucuccauuagcaaagauaauucuaagaacacacucuuucugcagaugaacucccuuagaguggaggacaccgcucuguacuucuguguuaaagaucagcgggaagacgagugcgaggaaugguggagcgauuauuacgacuuuggccgcgagcucccguguagaaagucucggggccuggggcuggccggaaucuucgauauguggggccaugggacaauggugaccgucuccagc

SEQ ID NO: 40029 - RNA, 432 nt, Artificial Sequence
  derived and/or modified sequence opt5 from anti-HIV_cap256-119-125765_VR-Chain
caggugcaacugguccagagcggcgggggaguugugcagcccggcagaucccuccggcugucuugcgccgcuagcggguucaccuuuuccucuuacgugaugcacuggguccgccaggccccuggaaagggccuugaggggguggcgguuaucagcuucgacggaaacaaugaauauuacgcugauuccgugaaaggcagauuuacaauuucucgggacaacagcaagaauacggucuaucugcaaaugaacucccuccgcguggaggauaccgcccuguacuauugugccaaagacaugagagaauacgagugcgaagaguggacaagcgauuauuacgacuucggccggccgcagcccuguaucgauucucgcgggguugugggcauucuugacaucuggggacaggggauuauggucaccguguccagc

SEQ ID NO: 40030 - RNA, 438 nt, Artificial Sequence
  derived and/or modified sequence opt5 from anti-HIV_cap256-119-125106_VR-Chain
caggugcaacuggucgagagcggcgggggaguugugcagcccggcagaucccuccggcugucuugcgccgcuagcggguucaucuuucgcuccuacggaaugcacugggugagacaggccccuggcaaggggcuugaaugggucgcgucuauuagcaacgacggaaccaaacgguaucaugcugaguccgugugggaucgcuucucuaucagcaaggacaauuccaaaaacacacuguuucuccagaugaauagccugagaguugaagauacggcccuuuacuucugugugaaggaccaacgggaggaugaaugcgaggagugguggucugacuauuacgauuuuggccgcgaacugccguguagaaaaucccggggccucgggcuggccggaauuuucgacauguggggccacgggaccauggucacagugagcucu

SEQ ID NO: 40031 - RNA, 435 nt, Artificial Sequence
  derived and/or modified sequence opt5 from anti-HIV_cap256-119-124026_VR-Chain
caggugcaacuggucgagagcggcgggggaguugugcaguccggccggucucuccggcugaccugcagcggguccgccuuccgcuuuucuagcuacacagugcacugggucagacaggcucccggaaagggccuugaauggcuggcccucaucuccuaugacgggcagaaaaagcauuucgcggauucugugaaaggacgguuuacgauuagccgcgacaacuccaagaauaaccuguuccuucaaaugaauagccugagacucgaggauaccgcucuguacuauugugcccgggaccugcgcgaacucgauugcgaggaauggacacuguacaacuauuacgacuuuggcucuagaggcccuuguguugauccgagaggggugggaggcuccuucgacgucugggggcagggaaccauggugacaguuagcucu

SEQ ID NO: 40032 - RNA, 432 nt, Artificial Sequence
  derived and/or modified sequence opt5 from anti-HIV_cap256-119-121783_VR-Chain
cugggcagacucguggccagcgggggaggcgucguucccccugggggaucccugacccuuucuugcgugacaagccaguucacguuuuccggcugugggcugcacugggugcggcaagcuccgggaaagggccucgagugggucgccucuaucagcuucgcgggcaccaaaaagcauuacggguccucugugcgcggaagauuuagcauuucccgggacaacagcaaaaauacacuguaucuucagaugaacucucugcgcaccgaagauacagcucucuacuucugcgccaaggaccugagagaguaugaaugugaggaauggaccuccgauuacuaugacuuuggccggccccagccuugcaucgauagccgcgggguugugggcauucuggacaucuggggacaggggacaauggucaccgugucuucc

SEQ ID NO: 40033 - RNA, 432 nt, Artificial Sequence
  derived and/or modified sequence opt5 from anti-HIV_cap256-119-121208_VR-Chain
cugggcagacucguggccagcgggggaggcgucguucccccugggaagucccugacccuuucuugcguggcuagccaguucacauuuuccggauguggccugcacugggugcggcaagccccggggaaaggacucgagugggucgcgucuaucagcuucgcuggcacgaagaaacauuacggcaacuuugugcgcgggagauucaccauuucccgggacaauucuaagaacacacuguaucuucagaugaauagccugcgcgccgaagauaccgcccucuacuauugcgcuaaagaccugagagaguacgaaugugaggaauggacauccgauuauuacgacuuuggacggccccagccuugcaucgauagccgcggcguuguggggauucuggacaucuggggacagggcaccauggucacagugucuucc

SEQ ID NO: 40034 - RNA, 432 nt, Artificial Sequence
  derived and/or modified sequence opt5 from anti-HIV_cap256-119-120945_VR-Chain
caggugcaacuggucgagagcggcgggggaguugugcagcccggcgggucccucagacugucuugcguggccagcggauucaccuuuuccaacuacggcaugcacuggguccggcaggcuccugggaagggacuugccuggguggcguucauccgcuaugacggcucuaauaaauacuauguugauagcguguggggcagauuuacaauuucccgggacaacucuaagaauacgcugcaucuccagaugaacagccugcgcccggaagauaccgcucuuuacuucugugccagagaccugcgggaguccgaaugcgaggaaugggagagcuauuacuaugauuuugggaauaaaggacccugugucaagccucgcggcgugguuggggugcucgacaucuggggacaaggcacacuggucaccgugucuucc

SEQ ID NO: 40035 - RNA, 432 nt, Artificial Sequence
  derived and/or modified sequence opt5 from anti-HIV_cap256-119-118229_VR-Chain
caggugcaagucguugagagcggcgggggaguggugcagcccggcagaucccugcggcucucuugcgccgcuagcggguucaccuuuuccaacuacgccauccacuggguccgccaggcgccuggaaagggccuggaauggguggcucuuauuucuuaugacggguacaauaaauauuacgccgauagcguuagaggacgguucacaaucucccgcgacaacucuaauaacacgguguaucugcagaugaauagccucaagccggaggauaccgccgucuacuauugugcuagagaccugcgggaauccgagugcgaagagugggagagcuacuacuaugauuuuggcaaaaagggccccugugugaaaccucgcgggguugugggaguccuugacauuuggggccaagggacacuggugaccgugucuucc

SEQ ID NO: 40036 - RNA, 432 nt, Artificial Sequence
  derived and/or modified sequence opt5 from anti-HIV_cap256-119-118025_VR-Chain
gaggugcagcuggucgaaagcggcgggggaguugugcaacccggcaagucccucagacugucuugcaccgccagccaguucacauuuuccaauuucgggaugcacugggugcggcaggcuccuggaaaaggccuugagugggucgccucuaucagcuuuguggggauuaagacgcauuacgcuaauuccguucgcggaagauucaccaucucucgggaccagagcaaaaacacacuguaucuccaaaugaacuccgugcgcauugaagauaccgcgagauacuuuugugcccgggacaugcgcgaguaugaaugcgagcugugggccagcgauuacuaugacuucggcaagccgcagcccugugaggauccuagaggcgucguggggacauuugacauguggggacuuggcacccugguuacagugucuucc

SEQ ID NO: 40037 - RNA, 432 nt, Artificial Sequence
  derived and/or modified sequence opt5 from anti-HIV_cap256-119-117418_VR-Chain
caggugcaacuggucgagagcggcgggggaguugugcagcccggcagaucccuccggcugucuugcgccgcuagcggguucaacuuucgcaauuacgacaucaacugggugagacaggucccuggaaagggccuugaauggguggccgcgauuuccuucgauggggcugacaaauaucacgccgauaauguuuggggacggcugucuaucagccgcgacaacuccaagucuacccucuaccugcagaugaauagccuuagaccggaggauacagccguguauuuuugugcuaaagaccugcgggaagaugagugcgaggaacgcugguccgacuacuaugauuucggcaagcaacuccccuguagaaaaagccggggcgucgccgggauuuuugacaacuggggacagggcacgauggugaccguuucugcu

SEQ ID NO: 40038 - RNA, 432 nt, Artificial Sequence
  derived and/or modified sequence opt5 from anti-HIV_cap256-119-117250_VR-Chain
caggugagacuggucgagagcggcgggggaguugugcaacccggcgggucccuccggcugucuugcgccgcuagccaguucaccuuuuccgccuacggaaugcacugggugcgccaggcgccuggcaaggggcuugaaugggucgcuucuaucagcuucgacggaacagauaaauuucaugccgacaagguguggggcagacugguuauuucccgggauaacucuaaaaauacgcucuaucugcagaugaacagccuucgcccggaggacaccgccguguacuauugugcuaaggaucugagagaagacgagugcgaggaacggugguccgauuacuaugacuucggcaaacaacuccccugucgcaagagcagaggggucgccggaguguuugauaauuggggccaggggacaaugguuaccgugucuucc

SEQ ID NO: 40039 - RNA, 432 nt, Artificial Sequence
  derived and/or modified sequence opt5 from anti-HIV_cap256-119-117230_VR-Chain
caggugcaacuggucgagagcggcgggggaggcguucagcccgggagaucccuccggcugucuugcgccgcuagcggauucacccuuuccucuuacggcaugcacugggugcgccaggccccugggaagggacuggaauggguggcgagcaucuccuuugacggcagagauuauuaccauucuccgcacgucuggggccggcucacaauuagccgcgacaacuccaaaaauacgcuguaucuucagaugaacagccugagagcugaggauaccgcccucuacuauugugcccgggaccugcgcgaaucugagugcgaagagugggaguccgauuacuaugacuucgggaagaaaggacccugugugaagccuagaggcguugcugggagccuggauauguggggacaaggcacaauggugaucgucucuucc

SEQ ID NO: 40040 - RNA, 432 nt, Artificial Sequence
  derived and/or modified sequence opt5 from anti-HIV_cap256-119-116999_VR-Chain
caggugcaacuggucgagagcggcgggggaguugugcagcccggcaccucccuccggaucucuugcgccgcuagccaguucacauuuucccgguacgggaugcacugggugcgccaggccccuggaaagggccuggaaugggucgcgucuauuagcuaugacgggagagauuacuaucaugcuggacggguguggggccgcuucacgaucuccagagacaacucuaaaaauacccuuuaccugcaaaugaacagccuccggccggaggauacagcccuguauuuuuguguucgcgacuccagagaaagcgagugcgaagagugggagucugauuacuaugacuucggcaagaaacuucccugugugaagccuagaggggucgugggaguucuggaucucuggggccaggggacccuggugacagucuccagc

SEQ ID NO: 40041 - RNA, 432 nt, Artificial Sequence
  derived and/or modified sequence opt5 from anti-HIV_cap256-119-116558_VR-Chain
caggugcaacuggucgagagcggcgggggaguugugcagcccggcagaucccuccggcugucuugcgccgcuagcggguucaccuuuaaccgcuacucccuucacugggugagacaggccccuggaaagggccuggaaugggucgcguucacaucuuaugacgggagcaauaaauacuauccggauuccgugaagggacgguuuacgaucucucgcgacagcuccaaaaacacccucuaccuggagaugaauagccuuagacccgaagauacagcucuguauuacugugccaaggacaugcggggcuaugagugcgaagaguggaccucugauuacuacgacuucggccgcccucagcccuguauugauuccagagggguugugggaacauuugacgucuggggccaagggaccauggugacaguuagcucu

SEQ ID NO: 40042 - RNA, 432 nt, Artificial Sequence
  derived and/or modified sequence opt5 from anti-HIV_cap256-119-116484_VR-Chain
gacgugcagcugcucgagagcggcggggaucugguccaacccggaggcucccuuagacugucuugcgccgcuagcggguucaccuuuacaaaguacgaaaugacguggguucggcaggccccuggaaaaggccucgaguggguggcguccaucucuuaugacgggagcgauaaguaccacaccuccucucuguggggacgcuucauugugagcagagacaacuccaaaaauacacuuuaucugcagaugaacagccuccggccggaagauaccgcucuguacuauuguguccgcgacagacgggagucugaaugcgaggagcgcugguccgauuacuaugacuuuggcaagcagcugcccugugugaaaccuagaggcguugccgggaucuucgauauuuggggacaaggcacaauggugaccgucagcucu

SEQ ID NO: 40043 - RNA, 438 nt, Artificial Sequence
  derived and/or modified sequence opt5 from anti-HIV_cap256-119-114844_VR-Chain
gaggugcagcuggucgaaagcggcggggaccucguucaacccggaagaucccugcggcuuucuugcgccgcuagcggcuucaccuuuuccucuuacuggaugagcugggugcgccaggccccugggaagggacuggaguggguggcguccaucucuaacgauggcacgaaaaaguaucacgaagagagcgucugggggagauucacaauuuccaaagacaauagcaagucuacccucuuucugcagaugaacucccuucggguggaagauacagcucuguacuucuguguuaaagaccagcgcgaggaugagugcgaagagugguggagcgacuauuacgauuuuggaagagaacucccgugucggaagucucgcggccugggccuggccgggaucuucgacauguggggacauggcaccauggugacagucuccagc

SEQ ID NO: 40044 - RNA, 438 nt, Artificial Sequence
  derived and/or modified sequence opt5 from anti-HIV_cap256-119-114141_VR-Chain
ggcgggagaagcggaggcgggggagugggcaccacaccccggcgcgggccucugagacucuccugcgccgcuucuggauucacgcuggacgauuacgccaugcacuggguccggcaggcgccgggcaagggccuugaguggguugcuagcaucuccaacgacgggaccaaaaaguaucaugccgaaucugugugggaucgcuuuagcauuuccaaagacaauucuaagaacacacuguuccuccaaaugaauagccugagaguggaggauaccgcccuuuacuuuugugucaaagaccagcgggaagaugagugcgaagaguggugguccgacuauuacguguucugggagcgcgcucccuguagaacaguuccuggacggggccccgggugguauuuugauauggugggacgcagaaccauggucacagugagcucu

SEQ ID NO: 40045 - RNA, 432 nt, Artificial Sequence
  derived and/or modified sequence opt5 from anti-HIV_cap256-119-111917_VR-Chain
gaggugcaccuggucgaaagcggcgggggacucguucagcccggcgggucccugagacuuucuugcgccgcuagcggauucaccuuuuccucuuacggcaugcauugggugcggcaagccccugggaagggacuggaguggguggcgacaaucagcuucgacggcgcugauaaauaucacgccgacgaugucuggggccgcuuuuccauuucuagagacaacagcaagaauacgcucuaccugcagaugaacaaucuucggccggaagauaccgcccuguauuacugugcuaaagaccuccgcgaggaugaaugcgaggagagaugguccgacuauuacgauuucgggaagcagcugcccugucggaaaagccgcggaguggccggcguuuuugacaacugggggcagggaacaauggugaccgucucuucc

SEQ ID NO: 40046 - RNA, 432 nt, Artificial Sequence
  derived and/or modified sequence opt5 from anti-HIV_cap256-119-111862_VR-Chain
caggugcaacuggucgagagcggcgggggaguugugcagcccggcgggucccucagacugucuugcgccgcuagcggauucaccuacuccgacuauggcaugcacugggugcggcaggccccugggaagggacuugaaugggucgcgucuaucagcuuugcuggcacaaaacagcauuacggcaauuccgugaaggggcgcuucacgauuucuagagauaauagcaaaaacaccguuuaucugcaaaugaacucccuccggguggaggacacagcccuguacuauugugccaaggauaugcgcgaauacgagugcgaagaguggaccagcgacuauuacgauuuuggaagaccgcagcccuguaucgacucucggggcgucguggggauucuugauaucuggggacagggcauuaugguuacaguguccagc

SEQ ID NO: 40047 - RNA, 432 nt, Artificial Sequence
  derived and/or modified sequence opt5 from anti-HIV_cap256-119-110064_VR-Chain
cugggcagacucguggccagcgggggaggcgucguucccccugggcggucccugcgccuuucuugcguggcuagccaguucaccuuuuccggauguggccugcacugggugagacaagccccggggaagggacucgagugggucgcgucuaucagcuucgcuggcacaaaacagcauuacggcaauuccgugaaggggcgguuuacgauuucucgcgacaauagcaaaaacaccguuuaucugcagaugaacucccuuagaguggaagauacagcccuguacuauugcgccaaggacaugcgggaguacgaaugugaggaauggaccagcgauuauuacgacuucggacgcccccagccuugcaucgauucuagaggcgucguggggauucucgacaucuggggacaaggcacaaugguuaccguguccuuu

SEQ ID NO: 40048 - RNA, 432 nt, Artificial Sequence
  derived and/or modified sequence opt5 from anti-HIV_cap256-119-109192_VR-Chain
caggugcaacuggucgagagcggcgggggaguugugcagcccggcagaucccuccggcugucuugcgccgcuagcggguucaccuuuuccaacuacgccaugcacugggugcgccaggcgccuggaaagggccuugaaugggucgcugugaucgccuaugacggggauaauaaauacuaugccgacucuguuaagggaagauucacaauuagccgggauaacuccaaaaauacgcuguaccuccagaugaacucucugcgcgcugaggacaccgcccuuuauuacugugcuaaggaucugagagaagacgagugcgaagagugguggagcgauuauuacgaccucggcaaacaacugccgugucggaagucccgcggcguggccgggguccuggauaaguggggacucggcacaauggugaccguuagcucu

SEQ ID NO: 40049 - RNA, 435 nt, Artificial Sequence
  derived and/or modified sequence opt5 from anti-HIV_cap256-119-108793_VR-Chain
caguuccaacugguggagagcggcgggggagucguucagcccggcagaucccuccggcugucuugcgccgcuagcggguuuaccuucuccucuuacccuaugcacugggugcgccaggccccgggaaagggccuugaauggguggcgcugaucagcuaugacgggacagauaaauacuaugcugacuccgucaagggaagauuuacgauuucucgggauaacagcaaaaauacccucuaccugcagaugaacucccuucgcguggaggacacagccguuuaucauugugccaaggaucugggcggcagcaaaucugacgaaugggcuaccgauuacuauuacgacugguccaaggccuaccccgugcacgauccuagagcugucguggggguuuucgacaucuggggacaaggcacacucgugaccgucagcucu

SEQ ID NO: 40050 - RNA, 432 nt, Artificial Sequence
  derived and/or modified sequence opt5 from anti-HIV_cap256-119-108127_VR-Chain
caggugcaacuggucgagagcggcgggggaguugugcagcccggcagaucccuccggaucucuugcgccgcuagccaguucaccuuuaaccgcuacgggaugcacugggugagacaggccccuggaaagggccuggaaugggucgcguccauuucuuaugacgggagcgauaaauaccaugcuggacuuguguggggccgguucaucauuucccgcgacaauucuaagaacacacuguaucuccaaaugaauagccugagagccgaggauacggcccuuuacuauuguguucgggaccgcagagaauccgagugcgaggaacgguggagcgauuacuaugacuuuggcaaacagcugccgugugugaagccccgcggggucgcuggaaucuucgauauuuggggccaggggaccauggugacaguuucuucc

SEQ ID NO: 40051 - RNA, 438 nt, Artificial Sequence
  derived and/or modified sequence opt5 from anti-HIV_cap256-119-107758_VR-Chain
gaggugcagcuggucgaaagcggcgggggacucguuaagcccggcgggucccugagacuuucuugcgccgcuagcggauucaccuuuuccaacgccuggaugucuugggugcggcaagcgccuggcaaagggcuggaguggguggcuagcaucuccaaugacggaacaaagaaauaccacgaagagucugucuggggccgcuucacgauuagcaaggauaacuccaaaaauacccucuuucugcagaugaacagccuuagaaucgaagacacagcccuguauuucugugugaaggaucagcgggaggacgagugcgaagagugguggucugauuacuaugacuuuggccgcgaacucccguguagaaagucccgggggcugggacuggccggcauuuucgauaugugggggcauggaaccaugguuacagugagcucu

SEQ ID NO: 40052 - RNA, 432 nt, Artificial Sequence
  derived and/or modified sequence opt5 from anti-HIV_cap256-119-107209_VR-Chain
gaggugcagcuggucgaaagcggcgggggacucguucaacccggcagaucccugcggcuuucuugcaccgccagcggguucacauuuggagacuacggcaugcacugggugcgccaggcuccugggaagggacuggaguggguggccgcgaucuccuucgauggcgcugacaaauaucaugccgauaacgucuggggcagacucucuauuagccgggacaauuccaagucuacgcuguaccuucagaugaacagccugcgcccggaagauaccgccguguauuuuugugcuaaagaccucagagaggaugaaugcgaggagcggugguccgacuacuaugauuucgggaagcagcugcccugucgcaaaagcagaggaguugccggcaucuuugacaauugggggcaaggaacaauggugaccgucucugcu

SEQ ID NO: 40053 - RNA, 432 nt, Artificial Sequence
  derived and/or modified sequence opt5 from anti-HIV_cap256-119-107184_VR-Chain
caggcccaacugguggagagcggcgggggagucguucagcccggcagaucccucgggcugucuugcgcugccagcaaguucucccuuucuagcuacggaaugcacugggugcggcaggcgccuggccgcgggcuggaauggguggcuggaaucuccuuugccggcaccaaaaaguauuacgccgacucugucagaggccgguucagcguguccacagauauuagcaaaaauacgcucuaucugcagaugaacucucuucgcccggcugacaccgcccuguacuuuugugcuagagaucuccgguauuacgagugcgaagagugggccuccgacuauuacgauuucgggaaggaacaacccugucuggacccucgcggaguugugggcaucuuugaucugugggggcagggaacaauggucaccgugagcucu

SEQ ID NO: 40054 - RNA, 438 nt, Artificial Sequence
  derived and/or modified sequence opt5 from anti-HIV_cap256-119-106827_VR-Chain
gccgugcagcuggucgagagcggcgggggacucguucaacccggcgggucccugagacuuucuugcagcgugucccaguucaccuuuggacgguacggcauguauugggugcgccaggcuccugggaagggacuggaaugggucgccgugaucucuuacgacggcggcaacagauauuacgcggauagcguuaaaaaucgguucuccauuucucgcgacaacagcaagaauacacucuuucugcagauguccagccuuagagcugaggauacggcccuguauuucugugugcgggaccaccgcgaagaugagugcgaagagugguggucugacuacuaugauuuugggagagagcucccgugucggaaauuccgcggacugggccuggccgggaucuuugacauuuggggacauggcaccauggucacaguguccagc

SEQ ID NO: 40055 - RNA, 432 nt, Artificial Sequence
  derived and/or modified sequence opt5 from anti-HIV_cap256-119-106511_VR-Chain
caggugcaacuggucgagagcggcgggggaguugugcagcccggcagaucccuccggcugucuugcguggccagccaguucuccuuugaccgcuacgggaugcacugggucagacaggcuccuggaaagggccuugaauggguggccucuaucagcuucgaugggaccgacaaauaucaugcggauaagguuuggggacgguuuacaauuucccgcgacaacucuaaaaauacgcuguaccuccaaaugaacagccugagaccggaggauaccgcucuuuauuacugugccaaggacaugcgggaagaugagugcgaagccuggugguccgacuauuacgaucugggcaaacagcuccccugucgcgagagcagaggcguggcugggaucuucgacgaguggggacagggcacaauggucaccgugucuucc

SEQ ID NO: 40056 - RNA, 432 nt, Artificial Sequence
  derived and/or modified sequence opt5 from anti-HIV_cap256-119-106327_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugccaucagcgggggaggcggcaauacauauguggccgacuccguuaaagggagauucacgauuucucgggauaauagcaagaacaccguguaccugcagaugaacucccuccgccuggaggacacagcucuuuauuacugugccaaagaucugagagaauaugagugcgaagaguggaccagcgacuacuaugauuuuggacggccgcaacccuguaucgacucucgcggcgucguggggauucucgauaucuggggacagggcacaaugguuaccguguccagc

SEQ ID NO: 40057 - RNA, 438 nt, Artificial Sequence
  derived and/or modified sequence opt5 from anti-HIV_cap256-119-105486_VR-Chain
caggugcaacuggucgagagcggcgggggaguugugcagcccggcgggucccucagacugucuugcgccgcuagcggauucaccguguccggcuacgggaugcacuggguccggcaggccccugcgaagggacuugacuggguggcuuuuaucucucaugauggcagcaacaaauauuacgccgacuccguucgcggcagauucauuaucucucgggauaauagcaacaauacacuguaugugcagauguccagccuccgcgccgaagacacggcucuguacuuuugugucagagaucaccgggaggacgaaugcgaggaaugguggucugauuauuacgacuucgggcgcgagcuuccguguagaaaguuucggggacugggccucgccgggauuuucgauaucuggggacauggcaccauggugacaguuuccagc

SEQ ID NO: 40058 - RNA, 432 nt, Artificial Sequence
  derived and/or modified sequence opt5 from anti-HIV_cap256-119-105197_VR-Chain
caggugcaacuggucgagagcggcgggggaguugugcagcccggcagaucccuccggcugucuugcgccgugagccaguucaccuuugggcgcuacggaaugcacugggucagacaggcuccuggcaaggggcuugaaugggugggauccaucucuuaugacggcagcgauaaauaccauacaaacucccuguggggccgguucauuguuucucgcgacaauagcaagaacacgcucuaucugcaaaugaauaaccuuagaccggaggauaccgcccuguacuauugugugcgggaccgcagagaauccgagugcgaggaacgguggagcgauuacuaugacuuugggaaacagcuccccugugucaagccucgcggagugguuggcgugcuggauaucugggggcagggaacacuggucaccgugucuucc

SEQ ID NO: 40059 - RNA, 432 nt, Artificial Sequence
  derived and/or modified sequence opt5 from anti-HIV_cap256-119-104946_VR-Chain
caggagcaacugguggaaagcggcgggggagucguucagcccggcagaucccuccggcugucuugcguggccagccgcuucaccuuuuccgcuuucgggaugcacugggugagacaggccccuggaaagggccuugagugggucgcgucuaucagcuuugcugggauuaaaaaguacuauggagacuccgugaaaggccgguucacaaucucucgcgauaacagcaagaauacgcuguaccuccagauggacggccugagaggggaagauaccgcccuuuauuacugugccaaagaccugcgggagcucgaaugcgaggagugggcuuccgauuauuacgacuuuggacgcccgcaacccuguauugauagcagaggcguuguggggauccuggacauuuggggacagggcaucauggucacagugucuucc

SEQ ID NO: 40060 - RNA, 432 nt, Artificial Sequence
  derived and/or modified sequence opt5 from anti-HIV_cap256-119-103667_VR-Chain
caggugcaccuggucgagagcggcgggggaguugugcaacccggcaagucccuccggcugucuugcgccgcuagccaguucaccuuuaaucgguucgggaugcauugggugcgccaggccccuggaaaaggccuugaaugggucgcggggaucuccuacgacggaucugauaaguaucacgcugacaaaguguggggcagauuuacaauuagccgggauaauuccaagaacacgcuguaccuccagaugaacucucugcgcgccgaggacaccgcccuuuauuacugugcuaaagaucugagagaagacgagugcgaagagugggccagcgauuauuacgacuucggcaaggagcaaccgugucucgaucccagagggguugugggaaucuuugacauuuggggccaggggacaauggucaccguguccagc

SEQ ID NO: 40061 - RNA, 438 nt, Artificial Sequence
  derived and/or modified sequence opt5 from anti-HIV_cap256-119-103385_VR-Chain
gaggugcagcuggucgaaagcggcgggggacucguucaaaccggcgggucccugagacuuucuugcgccgcuagcggauucacauuuucccgguacgacaugaacugggugcgccaggcccccggcaaggggcuggaguggguggcgucuaucagcaaugauggauccaaaaaguaucacggcgacucugucugggcuagauucacgauuagccgggauaacuccaaaaauacccucuuucugcagaugagcucucuucgcguggaagacacagcccuguacuucuguguuagagaucagcgggaggacgaaugcgaggaguggugguccgauuauuacgacuuuggccgcgaacucccuuguagaaaguuccgggggcugggacuggccggcaucuuugauauuugggggcauggaaccauggugacagucagcucu

SEQ ID NO: 40062 - RNA, 438 nt, Artificial Sequence
  derived and/or modified sequence opt5 from anti-HIV_cap256-119-103267_VR-Chain
gaggugcccagcgucgaauccggcgggggacugguucagaccggcgggucucucacacugagcugcgccgcuucccaauucacguuuucuaacuacggaaugcacugggugagacaggccccuggcaaggggcuugaguggguggcgagcaucuccaaugacggaucuaaaaaguaucauggcgauagcgucugggcucgguucauuaucucccgcgacaacagcaaaaauacccuguuucuccagaugucuucccugagagccgaagauacagcccuuuacuucugugugcgggaccaccgcgaggaugaaugcgaggagugguggagcgacuauuacgauuuuggcagagaacugccgugucggaaguuccgcgggcucggacuggcuggcauuuuugacaucugggggcauggaaccaugguuacagugucuucc

SEQ ID NO: 40063 - RNA, 432 nt, Artificial Sequence
  derived and/or modified sequence opt5 from anti-HIV_cap256-119-103011_VR-Chain
caggugcaacuggucgagagcggcgggggaguugugcagcccggcgggucccucagacugucuugcgccaccagcggauucacauuuggcacguucgggaugcacugggugcggcaggcuccuggaaagggccuugacugggucgccgcgaucuccuuugcuggcaccaaaaagaacuacgccgauucugugcgcgggagauucacaauuagccgggacuccucuaaaaauacccuguaucuccagaugaacagccugcgcccggaagauacagcccuuuacuauuguguuaaggacaugagaggauacgagugcgaagaguggaccuccgauuauuacgacuuuggccggccccaaccuuguaucgauagccgcgggguggucggaacauucgacguguggggccaggggaccaugguuacggugucuucc

SEQ ID NO: 40064 - RNA, 438 nt, Artificial Sequence
  derived and/or modified sequence opt5 from anti-HIV_cap256-119-102072_VR-Chain
gaggugcagcuggucgaaagcggcgggggacucguucaacccggcgggucccugagagugucuugcgccgugagcggauucaccuuuuccaacuacgagaugaauuggguccggcaggcuccuggcaaggggcuugaauggguggccucuaucagcaacgacggaacgaaaaaguaucacgcggaguccguuugggaucgcuucucuauuagcaaagacaauuccaagaacacacuguuucuccagaugaauagccugagaguggaagauaccgcucuuuacuucugugucaaagaccagcgggaggaugagugcgaagagugguggucugacuauuacgauuuuggccgcgaacugccguguagaaagucccggggccucgggcuggccggaaucuucgacauuuggggccaugggacaauggugaccguuagcucu

SEQ ID NO: 40065 - RNA, 438 nt, Artificial Sequence
  derived and/or modified sequence opt5 from anti-HIV_cap256-119-101945_VR-Chain
gaggugcagcuggucgaaagcggcgggggacucguucaacccggcgggucccugagacuuucuugcgccgcuagcggauucaccuuuuccucuuacgugaugcacugggugcggcaggccccuggcaaggggcuggagugggucgcgagcaucuccaacgacggaacgaaaaaguaucaugaagagucuguguggggccgcuucacaauuagcaaagauaauuccaagaacacccucuuucugcagaugaauagccuuagaaucgaagacacagcucuguacuucuguguuaaagaucagcgggaggacgagugcgaagagugguggucugauuauuacgacuuuggccgcgaacucccguguagaaagucccgggggcugggacuggccggcauuuucgauaugugggggcacggaaccauggugacagucagcucu

SEQ ID NO: 40066 - RNA, 432 nt, Artificial Sequence
  derived and/or modified sequence opt5 from anti-HIV_cap256-119-101319_VR-Chain
caggugcaacuggucgagagcggcgggggaguugugcagcccggcaagucccucagacugucuugcguggggagcggauucaccuuugacgauuacggcaugcacuggguccggcaggccccugggaaaggacuugaauggguggcuuccaucucuuaugacggccgcgauuucuaccaugccagaagcguuuggggccgguuuacaauuucccgcgacaacucuaagaauacgcugcaccuccagaugaacagccugagaccggaggauaccgcgcuuuauuucugugcucgggaccugcgcgaauccgagugcgaagagugggagagcuacuauuacgauuuugggaaaaagggacccugugugaaaccuagaggcgucguggggguucucgacaucuggggacaaggcacacuggugaccgucucuucc

SEQ ID NO: 40067 - RNA, 432 nt, Artificial Sequence
  derived and/or modified sequence opt5 from anti-HIV_cap256-119-100871_VR-Chain
caggugcaacuggucgagagcggcgggggaguugugcagcccggcgaaucccucagaaucucuugcgccgcuagccaguucaccuuuucccgguacgggaugcacugggugcgccaggccccuggaaagggccuggagugggucgcgucuauuagcuucgacgggagagauaaauaucauuccucucuuguguggggacggcugacaaucagccgcgacaauuccaagagcacgcucuuucugcaaaugaacucucuuagagcugaagauaccgcccuguacuauugugcccgggaccuccgcgaguccgaaugcgaggagugggaaagcgauuacuaugacuucggcaaaccgcagcccugugaggauccuagaggcguuguggggacauuugacauguggggacugggcacccuggucacagugucuucc

SEQ ID NO: 40068 - RNA, 432 nt, Artificial Sequence
  derived and/or modified sequence opt5 from anti-HIV_cap256-119-100838_VR-Chain
gaggugcagcuggucgaaagcggcgggggaguugugcaacccggcgggucccucagacugucuugcgccgcuagcggauucaccuuuuccucuuacggcaugcacugggugcggcaggccccugggaagggacuugagugggucgcguucauccgcuaugacggcagcaacaaauacuaugcugauuccgugaagggcagauuuacaauuucucgggacaauagcaaccauacgcuguacaugcagcucgauucccugcgcgccgaagacaccgcccuuuauuacugugcuaaagaucugagagaguaugaaugcgaggaguggacaagcgacuacuacgauuucgggcggccgcagcccuguaucgacucucgcggaguugugggcauucucgauaucuggucccaagggaccauggucacagugagcucu

SEQ ID NO: 40069 - RNA, 438 nt, Artificial Sequence
  derived and/or modified sequence opt5 from anti-HIV_cap256-119-100025_VR-Chain
caggugcaacuggucgagagcggcgggggaguugugcagcccggcagaucccuccggcugucuugcgccgcuagcguguucaccuuuuccuacuaugggaugcacuggguccgccaggccccuggaaagggccuugaauggguggcguucaucucucaugacgggagcaacaaauacuaugcugauuccguuagaggacgguuuauuaucucucgcgacaauagcaacaauacacuguacgugcagaugaacucccucagagccgaggauacggcccuguauuucugugucaaggaccaacgggaagaugagugcgaagagugguggagcgacuacuaugauuuuggccgcgagcuuccguguagaaaauuccggggccuggggcucgcuggaaccuuugacauuuggggccacgggacaaugcugaucgugucuucc

SEQ ID NO: 40070 - RNA, 432 nt, Artificial Sequence
  derived and/or modified sequence opt5 from anti-HIV_cap256-119-100000_VR-Chain
cagaugcaacugguggagagcggcgggggagucguucagcccggcagaucccucacccugucuugcgccgcuagccaguucacauuuuccaacuacgggaugcacugggugcggcaggccccuggaaagggccuugaauggguggcgucuaucagcaaugacgggaacaaaaaguaucauggagauuccgucugggcucgcuucacgauuucuagagacaauagcaaaaacacccuguuucuccaaauguccagccugcggacagaggauaccgcccuuuacuucugugugcgcgacagacgggaaucugagugcgaggaacgcugguccgauuauuacgacuuuggcaagcagcugccguguguuaaacccagaggcguggccgggaucuucgauauuuggggacagggcacaauggucaccgugagcucu

SEQ ID NO: 40071 - RNA, 432 nt, Artificial Sequence
  derived and/or modified sequence opt5 from anti-HIV_cap256-119-098890_VR-Chain
caggugcaacuggucgagagcggcgggggaguugugcagcccggcgaaucccucagaaucucuugcguggccagccaguucaccuuugggcgguacggaaugcacuggguccgccaggcuccuggcaaggggcuggaguggguggccuccauuucuuucgacggaagagauaaauaucauagcccgcuuguuuggggccggcugacaaucucccgcgacaacucuaagaauacgcucuuucugcaaaugaacagccuuagaaccgaagauacagcgcuguacuauugugcucgggaccuccgcgaguccgaaugcgaggagugggaaagcgauuacuaugccuucuggagaaaacugcccugugugaagccucggggcgucgccgggacccuggacauuuggggacagggcacaauggugucuguuuccagc

SEQ ID NO: 40072 - RNA, 435 nt, Artificial Sequence
  derived and/or modified sequence opt5 from anti-HIV_cap256-119-098715_VR-Chain
caggugcaacuggucgagagcggcgggggaguugugcagcccggcagaucccuccggcugucuugcgccgcuagcggguucuccuuuaacaaucacggaaugcauugggugcgccaggccccuggcaaggggcuugaaugggucgcgggaaucucuuucgcuggcauuaaaaaguacuauggcaccagcgugaaagggagauuuacaaucucccgggacaacucuaagaauaaccuguuccuccagaugaauagccugcgcguugaggauacggcccuuuacuauugugccagagaccugcgggaaauggagugcgaagaguggacccucuacaacuauuacgauuuuggaucccgcggcccguguguggaccccagaggggucgugggcagcuucgauguuuggggacaagggacaauggugaccgucucuucc

SEQ ID NO: 40073 - RNA, 438 nt, Artificial Sequence
  derived and/or modified sequence opt5 from anti-HIV_cap256-119-098632_VR-Chain
cagaugcaacugguggagagcggcgggggagucguucagcccggcagaucccucacccugucuugcgccgcuagccaguucaauuuugccaauuacgacaugcacugggugcggcaggcgccugggaagggacuugaauggguggcuuucauccgcuaugauggcaacaauaaauacuaugccgacuccgucaaggggagauuuacaauuucucgggauaacagcaaauccacgcuguuccuccaaaugaacucucugcgcaucgaggacaccgcccuuuacuuuugugugaaggaucagagagaagacgagugcgaagagugguggagcgauuauuacgacuucggacgggagcugccgugucgcaaauccagaggccucggccuggcugggauuuuugauauguggggacauggcacaaugguuaccgugagcucu

SEQ ID NO: 40074 - RNA, 432 nt, Artificial Sequence
  derived and/or modified sequence opt5 from anti-HIV_cap256-119-097199_VR-Chain
caggugcaacuggucgagagcggcgggggaguugugcagcccggccggucccuccggcugucuugcgccgcuagcggguucgccuuuuccucuuacgcguuccacugggugcgccaggcuccuggaaagggccuugaaugggucgccuauaucccguuucaugggaaccagcaauacuauggagacagcgugaaaggcagauucaccauuucccgggauaauucucgcgacacacuguuucucgagaugaacagccugagacccgaagauacggcccuuuacuucugugcucgggaccagcgcuauuacgagugcgaagagugggccuccgauuauuacgacuuuggcagagagcagccuugucuggaucccagagggguugugggaaucuucgaccucuggggccaggggaccauggucacagugagcucu

SEQ ID NO: 40075 - RNA, 432 nt, Artificial Sequence
  derived and/or modified sequence opt5 from anti-HIV_cap256-119-096189_VR-Chain
caggugcaacuggucgagagcggcgggggaguugugcagcccggcagaucccuccggcugucuugcgccgcuagcggguucaaguuuggauccuucggcaugcacugggugcgccaggccccugggaaaggacuugaaugggucgcggugaucucuuacgacggcagcgauaaguauuacggcuccucuguuagagggcgguuuagcauuucccgcgacaacagcaaaaauacccuguaucuccagaugaacucucugagaacagaggauacggcucuuuacuucugugccaaggaccugcgggaauaugagugcgaagaguggaccuccgauuacuaugacuuuggacgcccgcaacccuguaucgauagcagaggcguggucgggauucucgacaucuggggacagggcacaauggugaccguuucuucc

SEQ ID NO: 40076 - RNA, 432 nt, Artificial Sequence
  derived and/or modified sequence opt5 from anti-HIV_cap256-119-094581_VR-Chain
caggugcaccuggucgagagcggcgggggaguugugcaacccggcagaucccuccggcugucuugcgccgcuagcggguucaacuuuuccaauuacgccauccauugggugcgccagaccccuggaaagggccuugaaugggucacacugauuucuaacgacgggagcaauaaauauuacgcggauucccucaagggaagauucacgaucucucgggacaacagcaaaaauacccuguaucuucagaugaacucccugcgcgcugaggauacagcccucuacuauugugccaaggaccugagagaagaugagugcgaagagugguggagcgacuacuaugauuuuggcaaacagcugccgugucggaagucucgcggcguggcugggauuuucgacggauggggccaagggaccaugguuacaguguccagc

SEQ ID NO: 40077 - RNA, 432 nt, Artificial Sequence
  derived and/or modified sequence opt5 from anti-HIV_cap256-119-094200_VR-Chain
gaggugcagcuggucgaaagcggcgggggacucguucaacccggcgggucccugagacuuucuugcgccgcuagcggauucaucuuuuccucuuacgcccugcacugggugcggcaggcgccuggcaaggggcucgaguggguggcuagcauuuccuucgccggaaccaaaaaccauuauggcaauucugucaagggccgcuuuacaaucagcagagacaacuccaaaaauacgguguaccugcagaugaacagccuucgggccgaagauaccgcucuguauuacugugccaaggaccuccgcgaguaugaaugcgaggaguggacaucugauuacuaugacuucgggagaccgcagcccuguauugauucccggggaguugugggcauccuggacauuuggagccaagggaccauggucacagugucuucc

SEQ ID NO: 40078 - RNA, 432 nt, Artificial Sequence
  derived and/or modified sequence opt5 from anti-HIV_cap256-119-094158_VR-Chain
cagaugcaacugguggagagcggcgggggagucguucagcccggcuccucucucacccugagcugcgccgcuucccaguucacauuuucuaacuacgggaugcacugggugagacaggccccuggaaagggccuugaauggguggcgagcaucuccaaugacgggacgaaaaaguaucauggagauucugucugggaccgguucaccauuagccgcgauaacuccaaaaauacacuguuucuccaaaugaacagccugagagcugaggacaccgcccuuuacuucugugugaaggaucagcgggaagacgagugcgaagagugguggucugauuauuacgacuuuggcaaacagcugccgugucgcaaguccagaggcguugccgggaucuucgauagcuggggacagggcacaauggugaccgucucuucc

SEQ ID NO: 40079 - RNA, 432 nt, Artificial Sequence
  derived and/or modified sequence opt5 from anti-HIV_cap256-119-092814_VR-Chain
caggugcaacuggucgaguucggcgggggaguugugcagcccggcgggagccucagacuguccugcgccgcuucuggauuuuacuucaccgacuauggcaugcacugggugcggcaggccccuggggaaggacuucagugggucgcguuuaucagcuacgauggcaauacaaagacgaccgcugacuccgugcgcggcagauucacacugucucgggauaauagcaaaaacacccucuaucugcaaaugaacuccguucgcguggaggacacagccagauacuuuugugcccgggauaugcgcgaauaugagugcgaacuuugggcuucugacuacuaugauuucgggaagccgcagcccugugaggacccuagaggagucgugggcaccuuugauaugugggggcugggaacacucguuaccgugagcucc

SEQ ID NO: 40080 - RNA, 432 nt, Artificial Sequence
  derived and/or modified sequence opt5 from anti-HIV_cap256-119-092808_VR-Chain
caggugcaacuggucgagagcggcgggggaguugugcagcccggcagaucccuccggcugucuugcgccgcuagccaguucuccuuugggaacuacggaaugcacugggugcgccaggccccuggcaaggggcuugaaugggucgcggcuaucucuuucgccggaaccaaaacaaauuaugccgacagcgugaagggcagauuuacgauuucccgggauaacucuaaaaauaccguuuaccugcaaaugaacagccuccgcgcugaggacacagcccuguauuucugugcuaaggauaucagagaauacgagugcgaauauuggaccuccgacuacuaugauuuuggccggccgcagcccuguauugacagccgcgggguggucggaacauucgauguguggggccaggggaccaugguuacagugucuucc

SEQ ID NO: 40081 - RNA, 432 nt, Artificial Sequence
  derived and/or modified sequence opt5 from anti-HIV_cap256-119-092573_VR-Chain
caggagcaacugguggaaagcggcgggggagucguucagcccggcaccucccucagacugucuugcagcgccuccggguucacauuuucuaacuucgcuaugaauugggugcggcaggccccuggaaagggccuugagugggugagcuuuaucuccucugacgggaaaaacaagaauuacgucgauagcgugaaaggacgcuucacgauuuccagagacaacuauaagaauacccuguaccuccagaugaacagccugcggacagaagauaccgcgguuuauuacugugcuaaagaccuuggcggcacaaaggaugacgagugggccaccgauuauuacgacuggucuacagccuauccggugcaagauccccgcgcugucgccgggggauuugaccuguggggccucgggaccauggugacgguuuccagc

SEQ ID NO: 40082 - RNA, 432 nt, Artificial Sequence
  derived and/or modified sequence opt5 from anti-HIV_cap256-119-090815_VR-Chain
caggugcaacuggucgagagcggcgggggaguuguggaacccggcagaucccuccggcugucuugcgccgcuagccaguucuccuuuucuagcuacgggaugcacugggugcgccaggccccuggaaagggccuugagugggucgcggcuaucuccuucgacggggccgauaaauaucaugccgacaacguguggggaagacugucuauuagccgggauaauuccaagagcacccucuaccugcagaugaacucucuucgcccggaagacacagcuguuuauuuuugugccaaagaucugagagaggacgaaugcgaggagcggugguccgauuacuaugacuucggcaagcaacuccccugucgcaaaagcagaggcguggcugggaucuuugauaauuggggacagggcacgauggucaccgugucugcc

SEQ ID NO: 40083 - RNA, 438 nt, Artificial Sequence
  derived and/or modified sequence opt5 from anti-HIV_cap256-119-090368_VR-Chain
caggugcaacuggucgagagcggcgggggaguugugcagcccggcagaucccuccggcugucuugcgccgcuagcggguucgccuuuucccacuacggaaucuucugggugcgccaggcgccuggcaaggggcuugaaugggucgcuucuauuagcaacgacggaaccaaaaaguaucaugccgaguccgugugggauagauuuucuaucagcaaagacaauuccaagaacacacuguuccuccagaugaauagccugcggguugaagauacggcccuuuacuuuugugugaaagaccaacgcgaggaugaaugcgaggagugguggucugacuauuacgauuucggcagagaacugccgugucggaagucccgcggccucgggcuggcuggaauuuuugacauguggggccacgggaccauggucacagugagcucu

SEQ ID NO: 40084 - RNA, 432 nt, Artificial Sequence
  derived and/or modified sequence opt5 from anti-HIV_cap256-119-089710_VR-Chain
caggugcaacuggucgagagcggcgggggaguugugcagcccggcagaucccuccggcugucuugcaccgccagcggguucggauuuuccaacuacgcuaugcacugggugcgccuugccccuggcaaggggcuggaaugggucgcgucuaucagcuaugacggaagagauuaccaucacgcuggcgccguguggggccgguucauuaucucccgcgacaauucuaaaaacagccuccaucugcagaugaacucccuuagaccggaggauacagcccuguauuuuugugcucgggaccuccgcgaaagcgagugcgaagagugggagucugauuacuauaauuucuggaagaaacugcccuguguuaagccuagagggguggucggcauucuggacaucuggggacaggggacggugguuaccguguccagc

SEQ ID NO: 40085 - RNA, 432 nt, Artificial Sequence
  derived and/or modified sequence opt5 from anti-HIV_cap256-119-088555_VR-Chain
caggugcaacuggucgagagcggcgggggaguugugcaggccggcagaucccuccggcugucuugcgcugccagccaguucaccuuuucccgcuacgggaugcacugggugagacaggcgcccggaaagggccuugaaugggucgcugggaucucuuaugacggacgggauaaauaccaugcccacuucguguggggccgcuuuauuaucagcagagacaacuccaagaauacacuguaucuccaaaugaacucucugcgggccgaggauacggcucuuuacuauuguguucgcgaccugagagaaagcgagugcgaacucugggaguccgauuacuaugacuucggcaaacggcugccuugugugaagccgcgcggggucgccggaaccuuugaucuguggggccaggggacaauggugaccguuagcucu

SEQ ID NO: 40086 - RNA, 432 nt, Artificial Sequence
  derived and/or modified sequence opt5 from anti-HIV_cap256-119-087962_VR-Chain
gagaugcagcugguggaaagcggcgggggacucgucaagcccggcagaucccugcggcuuucuugcgccgcuagcggguucaccuuuuccucuuacgccauccacuggguucgccaagcgccuggaaaaggccuggaguggguggcugugauuagcuaugacggguccaacaaguacuaugccgauucugucaaaggaagauucacaaucagccgggacaauuccaagaacacgguguaccuccagaugaauagccugcgcguugaagauaccgcccuuuauuacugugcuaaagaccugagagaguaugaaugcgaggaguggacaucugauuacuacgacuuuggcaagccgcagcccuguauugauucccggggcguggucgggauccucgacauuuggggacagggcaucauggugaccguuagcucu

SEQ ID NO: 40087 - RNA, 432 nt, Artificial Sequence
  derived and/or modified sequence opt5 from anti-HIV_cap256-119-086903_VR-Chain
caggugcaccuggucgagagcggcgggggaguugugcaacccggcaagucccucagacugucuugcgccgcuagccaguucaccuuugaccgguacgggaugcauugggugcgccaggccccuggaaaaggccuugaaugggucgcguccaucucuaacgaugggacagacaaguaucacgcugauaauguguggggaagauucacgauuagccgggacaacuccaaaaauacccuguaccucgagaugaacucucugcgcggcgaagauacagcccuuuauuacugugccaaggacaugagagaggaugaaugcgaggagugguggagcgacuauuacgauuuuggccggccgcagcccuguaucgacucccgcgggguugugggaaccuuccaugucuggggccaagggacaauggugaccguuagcucu

SEQ ID NO: 40088 - RNA, 432 nt, Artificial Sequence
  derived and/or modified sequence opt5 from anti-HIV_cap256-119-086804_VR-Chain
gaggugcagcuggucgaaagcggcgggggaguugugcaacccggcagaucccuccggcuguucugcgccgggucuggauuuaccuucagcuccuacggccuucacugggugcgccaggcuccugggaagggacuggagugggucucuuuuaucagcuaugacggcuccacaacgaaauacgccgauucucucaagggcagauucaccgugagccgggacaacuccaaaaauacaguuuaucuggaaaugaacagccuucgcgcggaggauaccgcucuguacuauugugccaaggaccucagagaauacgagugcgaggaauggacaucugauuauuacgacuuugggcggccgcagcccuguauugauucccgcggaguggucggcauccuggacauuugggggcagggaaccauggugacaguuagcucu

SEQ ID NO: 40089 - RNA, 432 nt, Artificial Sequence
  derived and/or modified sequence opt5 from anti-HIV_cap256-119-085910_VR-Chain
gaggugcagcugcucgaaagcggcgggggacugguccaacccggcgggucccuuagacugucuugcgccgcuagcggauucaccuuuuccucuuacggcaugcacuggguucggcaggccgcggggaagggacucgaguggguggcuagcaucuccuaugacggccgcgauuaccaucacgccggcgccgugugggggagauucauuaucucucgggacaacagcaaaaauucccugcaucuucagaugaacagccugcgcccugaagauacagcucucuauuuuugugccagagaccugcgggagucugaaugcgaggagugggaauccgauuacuauaauuucuggaagaaacugccgugugucaagccccgcggagugguuggcauucucgacaucugggggcagggaacgguggucaccgugagcucu

SEQ ID NO: 40090 - RNA, 432 nt, Artificial Sequence
  derived and/or modified sequence opt5 from anti-HIV_cap256-119-085772_VR-Chain
gaggugagacuggucgaaagcggcgggggacucauccagcccggcgggucccugcggcuuucuugcgccgcuagcggacugaccguuuccucuaaucacaugagcugggugcgccaagccccuggcaaggggcucgaguggguggcggucauuuccuacgacggaucuaauacauucuauggcgauagcgugaaaggcagauuuacgguuucccgggacaucagcaagaacacccuguaccuucagaugaacucucugcgcccggaagauacagcuauguauuacugugccagagaccagcgguauuacgagugcgaagagugggccuccgauuauuacgacuucgggcgcgagcagcccugucaagauccuagaggaguggucggcguguuugacaugugggggcagggaaccaugguuacagugagcucu

SEQ ID NO: 40091 - RNA, 432 nt, Artificial Sequence
  derived and/or modified sequence opt5 from anti-HIV_cap256-119-084603_VR-Chain
caggugcaacuggucgagagcggcgggggaguugugcaguccggccggucucuccggcugagcugcgccgcuuccggguuccccuuuucugacuucgccaugcacugggugcgccaggcgccuggaaagggccuugaaugggucgcuagcaucuccuuuguggggauuaaaacccauuacgccaacucuguuagaggacgguucacaaucagccgcgaucaguccaagaauacgcuguaucuccaaaugaacagcgugagagucgaggacaccggccgguacuauugugcccgcgauaugagagaauacgagugcgaacugugggcuucugacuauuacgauuuuggcaaaccgcagcccugugaggacccuagaggggugguuggaacauucgauauguggggccuugggacccuggugacagucuccagc

SEQ ID NO: 40092 - RNA, 432 nt, Artificial Sequence
  derived and/or modified sequence opt5 from anti-HIV_cap256-119-084276_VR-Chain
caggugcaacuggucgagagcggcgggggaguugugcagcccggcagaucccuccggcugucuugcgccgcuagccgcuucaccuuuuccucuuacgccaugcacugggugagacaggcgccugggaagggacuugaaugggucgcugugaucugguaugacggcagcaacaaauacuaugccgauuccguucgggggcgcuucucugugagcacagacauuuccaagaauacgcuguaccuccagaugaacagccugagaccggccgauaccgcucuuuauuuuugugcccgggaccugcgcuacuaugagugcgaagagugggcuucugauuacuacgacuucggaaaagaacaacccugucucgauccuagaggcgucgugggcaucuuugaccugugggggcagggaacaaugguuaccguguccagc

SEQ ID NO: 40093 - RNA, 432 nt, Artificial Sequence
  derived and/or modified sequence opt5 from anti-HIV_cap256-119-082288_VR-Chain
cagguguaccuggucgagagcggcgggggaguugugcaacccggcagaucccuccggcugucuagcgccgcuucccacuucucucuuagcuccuaugggaugcauugggugcgccaggccccuggaaagggccuggaaugggucgcggggaucucuuuugcuggaaccaaaacauacuauggcgacagcgugaagggcagauucacgguuuccaccgauauuagcaaaaacacacucuaccugcaggucaauucucuucggccggaggacaccgccauguauuacugcgcccgcgaucagagauauuacgaaugugaggaaugggcuuccgacuacuaugauuuugggaaggagcaacccugccuggacccucggggaguggugggcaucuucgauauuugggggcagggaacaaugguuaccgugagcucu

SEQ ID NO: 40094 - RNA, 432 nt, Artificial Sequence
  derived and/or modified sequence opt5 from anti-HIV_cap256-119-080383_VR-Chain
caggugcaacuggucgagagcggcgggggaguugugcagcccggcagaucccuccggaucucuugcgccgcuagccaguucaccuuuucccgcuacgggaugcacugggugagacaggccccuggaaagggccuggaaugggucgcgucuauuagcuaugacgggacagauaaauaccaugcucggcuuguguggggacgcuucacgaucuccagagacaacucuaagaauacccuguaucuccaaaugaacagccugcgggccgaggauacagcccuuuacuauuguguucgcgacgaaagagaguccgaaugcgagcugugggagagcgauuacuaugacuuuggcaaaaagcucccgugugugaaaccccggggcgucaccgggucucuggauauguggggacagggcacacaggugaccguuuccagc

SEQ ID NO: 40095 - RNA, 438 nt, Artificial Sequence
  derived and/or modified sequence opt5 from anti-HIV_cap256-119-079333_VR-Chain
gaggugcagcuggucgaaagcggcgggagacucguucaacccggauccccucugcggcuuucuugcgccgcuagccaguucaacuuugccuccuacggcaugcacugggugcgccaggcgccggggaagggacuggaguggguggcuucuaucagcaaugacggcaccaaaaaguaucaugccgaauccgucugggauagauucucuauuagcaaagacaacuccaagaauacacucuuucugcagaugaacagccuucggguggaggauacggcccuguacuucuguguuaaagaccaacgcgaagaugagugcgaggaaugguggucugacuauuacgauuuugggagagagcuccccugucggaagucccgcggacugggccuggcuggcaucuucgacaugugggggcacggaaccauggugacagucagcucu

SEQ ID NO: 40096 - RNA, 441 nt, Artificial Sequence
  derived and/or modified sequence opt5 from anti-HIV_cap256-119-078618_VR-Chain
cagaugcaacugguggagagcggcgggggagucguucagcccggcagaucccucacccugucuugcgccgcuagccaguucaacuuugccuccuacgggaugcacugggugcggcaggcgccuggaaagggccuugaauggguggcuucuaucagcaaugacgggacgaaaaaguaucaugccgaguccgucugggaucgcuucucuauuagcaaagacaacuccaagaauacacuguuucuccaaaugaacagccugagaguggaagauaccacacuuuacuucuguguuaaagaccagcgggaggaugaaugcgaggagugguggucugacuauuacgauuuuggacgcgaacugccguguagaaagucccggggccucggccuggccgggaauuucugcaucuguggagcugacggcaccauggugacagucagcucu

SEQ ID NO: 40097 - RNA, 432 nt, Artificial Sequence
  derived and/or modified sequence opt5 from anti-HIV_cap256-119-077466_VR-Chain
caggugcaacuggucgagagcggcgggggaguugugcagcccggcuccccucucagaaucucuugcgccgugagccaguucaccuuuucccgguacgggaugcacuggguccgccaggcuccgggaaagggccuggaauggguggccucuauuagcuucgacgggagagauaaauaucauuccucucuuguuuggggacggcugacaaucagccgcgacaauuccaagagcacgcucuuucugcaaaugaacucucuuagagcggaggauaccgcucuguacuauugugcccgggaccuccgcgaauccgagugcgaagagugggagagcgauuacuaugccuucuacagaaaacugcccugugugaagccucggggcgucgcuggcacacuggacauuugggggcagggaaccauggugacaguuucuucc

SEQ ID NO: 40098 - RNA, 423 nt, Artificial Sequence
  derived and/or modified sequence opt5 from anti-HIV_cap256-119-076284_VR-Chain
caggugcaacuggucgagagcggcgggggaguugugcagcccggcagaucccuccggcugucuugcgccgcuagcaacaccuacgccaugcacugggugcgccaggcgccugggaagggacuugaauggauggcucugaucuccuaugagggcucugacaaauacuaugucgauagcgugaaggggagauucacaauuucccgggacaauucuaaaagcacgcucuaccugcagaugaacucccuuagcgccgaagauaccgccguuuauuuuugugcuaaggaccugggaggcaauaaagaugacgaguggacaaccgauuacuauuacgacuggucuaaggcccgcccggugcaagaucccagagucguggcuggcacauucgacaucugggggcagggaaccaugguuacaguguccagc

SEQ ID NO: 40099 - RNA, 432 nt, Artificial Sequence
  derived and/or modified sequence opt5 from anti-HIV_cap256-119-074680_VR-Chain
gaggugcagcuggucgaaagcggcgggggacucguucaacccggcagaucccugcggcuuucuugcgccgggagcggauucaccuuuguggacuacgcuaugcacugggugcgccaggucccuggcaaggggcuggagugggugggauccaucucuuaugauggcagcgacaaauaccauacaaauuccguuuggggcagauucauugugucucgggauaauagcaagaacacgcucuaucugcagaugaacucccuucgcccggaagacaccgcccuguacuauugugucagagaucggcgcgagagcgaaugcgaggagagauggucugacuacuaugauuuugggaaacagcuccccugugugaagccucggggaguugcgggcaucuucgacauuugggggcaaggaacaauggugaccgucuccagc

SEQ ID NO: 40100 - RNA, 432 nt, Artificial Sequence
  derived and/or modified sequence opt5 from anti-HIV_cap256-119-074081_VR-Chain
gaggugcagcuggucgaaagcggcgggggacucguucaacccggcgggucccugagacuuucuugcguggugagcggagucaccguguccucuaacuacaugagcuggguucggcaggccccuggcaaggggcuggaguggguggcuuccaucucuuaugacggaagcgauaaauaccacgccgaccgcgucuggggcagauucacaauuucccgggauaauagcaagaacacgcucuaucugcagaugaacucucuucgcgcggaagacaccgcucuguacuauugugugagagaugcccgggaguccgaaugcgagcucugggagagcgacuacuauaauuuuggccgcaaacugccguguguuaagcccagagggguggccggaacacuggauaucuggggccaggggaccauggucacagugucuucc

SEQ ID NO: 40101 - RNA, 432 nt, Artificial Sequence
  derived and/or modified sequence opt5 from anti-HIV_cap256-119-071704_VR-Chain
cagaugcaacugguggagagcggcgggggagucguucagcccggcgggucccucagacugucuugcgccgugagccaguucaccuuuacauccuacggaaugcacugggugcggcaggcuccuggcaaggggcuugaaugggucgccacgaucucuagcgacggauccaaaaaguaucauggcgauucuguguggggccgccugaccauuagcagagacaacuccaaaaauacacucuuccugcaaaugaacaaucuucgggcggaggauaccgcucuguacuuuuguguuaaggaccagcgcgaagaugagugcgaagagugguggagcgacuauuacgauuucgggaaaaagcucccguguagaaagucucccggacuggccggcaucuuugacgugugggggcacggaacaauggucaccguguccccu

SEQ ID NO: 40102 - RNA, 432 nt, Artificial Sequence
  derived and/or modified sequence opt5 from anti-HIV_cap256-119-071266_VR-Chain
caggugcaacuggucgagagcggcgggggaguugugcagcccggcgaaucccucagacugucuugcgccgcuagcggguucaccuuuuccucuuucggaaugcacugggugcggcaggccccuggcaaggggcuugagugggucggaagcaucuccuacgacggcucugauaaauaucauacaaauagcguguggggccgcuuuauuguuuccagagacaauagcaagaacacgcuguaccuccagaugaacucucugcggccggaagauaccgcgcuuuauuacugugugcgcgacagacgggaguccgaaugcgaggagcgcuggagcgauuauuacgacuucgggaaacaacugcccugugucaagccuagaggaguggcuggcaucuuugauauuugggggcagggaacaaugguuaccgugucuucc

SEQ ID NO: 40103 - RNA, 432 nt, Artificial Sequence
  derived and/or modified sequence opt5 from anti-HIV_cap256-119-069667_VR-Chain
gaggugcagcuggucgaaagcggcgggggacucguucaacccggcagaucccugcggcuuucuugcgccgcuagcggguucuccuuuaacaccuacggaaugcacugggugcgccaggccccuggcaaggggcuggaguggguggcguucaucagauaugacggaucuaauaaauacuaugcugauagcgucaagggccgguuuacaauuucccgcgacaacucuaaaaauacgcucuaccugcagauggauggccuuagaggggaagacaccgcccuguauuacugugccaaggaucuccgggagcuggaaugcgaggagugggcuagcgacuauuacgauuucggacgcccgcagcccugucuggacccuagaggcguguccgggaucagcaacguuuggggacaaggcacaauggugaccgucucuucc

SEQ ID NO: 40104 - RNA, 432 nt, Artificial Sequence
  derived and/or modified sequence opt5 from anti-HIV_cap256-119-069591_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugggaucagcuaugacggauccgauaaauaccaugccgacaagguguggggcagauucacaauuucucgggauaacagcaaaaauacgcuguaucuccagaugaacucccugcgcgccgaggacaccgcucuuuacuauugugccaaggaucugagagaagacgagugcgaagagugguggagcgauuacuaugacuuuggcaaacggcucccgugucgcaagucuagagggguugcuggaguguucgauaaguggggccaagggacaauggucaccguguccagc

SEQ ID NO: 40105 - RNA, 432 nt, Artificial Sequence
  derived and/or modified sequence opt5 from anti-HIV_cap256-119-068691_VR-Chain
cagggccaccugguggccagcgggggaggcgucguucccccugggagaucccucacccugucuugccuugcuagccaauucacauuuuccggauacggcuuccauugggugcggcaggccccggggaagggacuggaguggguggcgucuaucagcuuugcuggcacgaaaaagcacuauggcaauuccgucaaagggcgcuucaccauuucuagagacaauagcaagaacacacucuaccuggaaaugaacucccuucggcccgaggauaccgcccuguauuacugugccaaagaccgcagagaauaugagugcgaagaguggacaagcgauuacuaugacuuuggacggccucagcccuguaucgauucucgcggcgugguugggauucucgacaucuggggaagaggcaccauggugacagucuccagc

SEQ ID NO: 40106 - RNA, 432 nt, Artificial Sequence
  derived and/or modified sequence opt5 from anti-HIV_cap256-119-068488_VR-Chain
cagaugcaacugguggagagcggcgggggagucguucagcccggcaugucccucacccugucuugcgccgcuagccaguucacauuuuccaacuacgggaugcacugggugagacaggccccuggaaagggccuugaauggguggcgucuaucagcaaugacggguccaaaaaguaucauggagauucugucaaaggccgguucacgauuagccgcgacaacuccaagaauacccuguaccuccaaauggauggccugagaggggaggacacagcucuuuauuacugugccaaagaucugcgggaacucgagugcgaagagugggccagcgacuauuacgauuuuggacgcccgcagcccugucuggacccuagaggcgugucugggaucuccaacguuuggggacagggcaccauggugacagucagcucu

SEQ ID NO: 40107 - RNA, 432 nt, Artificial Sequence
  derived and/or modified sequence opt5 from anti-HIV_cap256-119-067536_VR-Chain
caggugcaacuggucgagagcggcgggggaguugugcagcccggcagaucccuccggaucucuugcgccagcucccaguucaccuuuucucgcuacgggaugcacugggugagacaggcuccuggaaagggccuggaaugggucgccagcauuuccuaugacgggcgggauuaccaucacgcgggagcuguguggggccgcuucaucauuucuagagacaacagcaaaaauucccuucaucugcaaaugaacagccuccggccggaggauacagcccuguauuuuugugcccgcgaccuuagagaaucugagugcgaagagugggaguccgauuacuaugcuuucuaccggaagcugcccuguguuaaaccucgcggcguggccgggacgcucgacaucuggggacagggcaccauggucacagugagcucu

SEQ ID NO: 40108 - RNA, 432 nt, Artificial Sequence
  derived and/or modified sequence opt5 from anti-HIV_cap256-119-065852_VR-Chain
caggugcaccuggucgagagcggcgggggagccguucccuccggcagaucucuccggcugagcugcguggcuuccggguucaccuuuggaguguacgacauccauuggguccgccaagccccuggcaaggggcuugaauggguggcgucuauuagcuaugauggaagagacaaauaccacuccucucugguuuggggccggcucacaaucagccgcgauaauuccaagagcacgcuguuccuucagaugaacucucugagagcugaggacaccgcccucuauuacugugcccgggaucugcgcgaauccgagugcgaagaguggcagagcgacuauuacgcuuuuuauaaaaagcugccgugugugaaacccagaggcgucgccgggacacucgauauuuggggacagggcaccauggugacaguuucuucc

SEQ ID NO: 40109 - RNA, 432 nt, Artificial Sequence
  derived and/or modified sequence opt5 from anti-HIV_cap256-119-065457_VR-Chain
cugggcagacucguggccagcgggggaggcgucguucccccugggcgguccccgcgccugucuugcguggcuagccaguucaccuuuuccggauguggccuucacugggugagacaagcccccgggaagggacuggagugggucgcggcuaucucuuucgacggcacagauaaauaccauagcgacgauguguggggccgguuuacgauuucccgcgacaacucuaagaauacccucuaucugcagaugaacagccuuagaccugaagauacagcccuguacuauugcgccaaagaccuccaggaggaugaaugugaggaauggugguccgacuacuaugauuucgggaagcagcugcccugccggaaaagccgcggaguugcuggcaucuuugacgauugggggcaaggaaccauggugacagucucuucc

SEQ ID NO: 40110 - RNA, 432 nt, Artificial Sequence
  derived and/or modified sequence opt5 from anti-HIV_cap256-119-064501_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugggaucagcuaugacggaagagauaaauaccaugcccacuccguguggggccggcugucuauuagccgcgacaacuccaagaauacacucuaucugcagaugaacagccuuagaacggaggauaccgcccuguaccauuguguucgggaccuccgcgaaucugagugcgaacugugggaguccgauuauuacgacuucggcaaaaagcugccgugugugaaacccagaggggucgcuggaacauuugaucucuggggccaagggaccauggugacaguuagcucu

SEQ ID NO: 40111 - RNA, 432 nt, Artificial Sequence
  derived and/or modified sequence opt5 from anti-HIV_cap256-119-063568_VR-Chain
caggugcaacccgucgagagcggcgggggaguuguguggccuggcagaucccugcggcucucuugcaccacaagcggguucacguuuuccaacuacgccauccacugggugcgccaggcuccgggaaagggccugcagugggucgccgugauuucuuaugacgggagcaauaaauucuacgcggauuccguuaagggaagauuuaccaucucucgggacaacagcaaaaauacacuuuaucugcagaugaacucccuccgccccgaagauaccgcucuguacuauugugccaaggaccuuagagaggaugaaugcgaggaacgguggagcgacuacuaugauuucggcaaacaacugccuugucgcaagucuagaggcguggccggggucuuugacaauuggggacagggcacaauggugaccguuuccagc

SEQ ID NO: 40112 - RNA, 435 nt, Artificial Sequence
  derived and/or modified sequence opt5 from anti-HIV_cap256-119-063103_VR-Chain
caggugcaacuggucgagagcggcgggggacucguucagcccggcaagucccugagacuuucuugcgccgcuagcggguucaccuuuuccacauacggaaugcacugggugcggcaggccccuggcaaagggcuggaauggguggcgcucaucucuuaugacggaagcuacacguauuacgcugauuccgucaagggccgcuucaccauuucuagagacaacagcaaauccacacuggaucuucagcugaauacccuccggccggaggacacagcccuguauuacugugcccgcgaucugagagaaauggagugcgaagaguggaagcucuauaacuacuacgacuuucggacccgcggccccuguguggauccuagagggguugugggcagcuucgacgucuggggacaagggacagugguuaccgugucuucc

SEQ ID NO: 40113 - RNA, 432 nt, Artificial Sequence
  derived and/or modified sequence opt5 from anti-HIV_cap256-119-061027_VR-Chain
caggugcaacuggucgagagcggcgggggaguugugcagcccggcagaucccuccggcugucuugcagcgccuccggguucacccuuucuagcuacggaauccacugggugcgccaggcuccuggcaaggggcuggaaugggucgccgugauguccaaugacggaucuaaucaguuuuauggcgauagcguuaaaggcagauucacaauuucccgggacaucagcaagaacacgcucuaccugcaaaugaacucucuucgcccggaggauaccgcgauguauuacugugcuagagaccagcgguauuacgaaugcgaggaaugggccuccgauuauuacgacuuugggcgcgagcagcccugucaggauccuagaggaguggucggcguguucgacaugugggggcaaggaacaaugguuaccgugagcucu

SEQ ID NO: 40114 - RNA, 432 nt, Artificial Sequence
  derived and/or modified sequence opt5 from anti-HIV_cap256-119-058232_VR-Chain
caggugcaacuggucgagagcggcgggggaguugugcagcccggcaagucccucagacugucuugcaaagccagccaguucaccuuuaaucgguacgggaugcacugggugcgccaggcuccuggaaagggccuugaaugggucgccgcgaucuccuucgacgggacagauaaauaucaugcugacaagguguggggaagauuuacgauuucucgggaugacagcaaauccacccuguaccuccaaaugaacucucugcgcgccgaggauacagcccuuuauuacugugcuaaggaccugagagaagaugagugcgaagagugguggagcgacuauuacgauuucggcaagcagcucccgugucggaaaucccgcggcguugccgggaucuuugacggauggggccaggggaccauggugacagucagcucu

SEQ ID NO: 40115 - RNA, 432 nt, Artificial Sequence
  derived and/or modified sequence opt5 from anti-HIV_cap256-119-057341_VR-Chain
caggugcaacuggucgagagcggcgggggaguugugcagcccggcagaucccuccggcugucuugcgccgcuagccacuucucccuuucuagcuacgggaugcauugggugcgccaggccccuggaaagggccuggaaugggucgcgggggaguccuuugcugccaccaacaaauauuacgccgacucugugaagggaagauucaucguuagccgggauauuuccaaaaauacacucuaucuggaagugaacagccuucgcgcugaggacacggcccuguacuauugugcuagagaucagcgguacuaugaaugcgaggagugggccucugacuacuacgauuuuggccgcgaacaaccgugucaggaccccagaggcgucgcggggaucuucgauauuuggggacagggcaccauggugacaguuuccagc

SEQ ID NO: 40116 - RNA, 438 nt, Artificial Sequence
  derived and/or modified sequence opt5 from anti-HIV_cap256-119-056895_VR-Chain
cagaugcaacugguggagagcggcgggggagucguucagcccggcagaucccuccggcugucuugcgccgcuagccaguucaccuuuggguccuacggaaugcacugggugcgccagaucccuggcaaggggcuugaauggguggccacaauuucuuaugacggaacgaaaaaguaccaugcggauagcgucugggacagauucaucauuucccgggauaacucuaaaaauacccuguuucuccaaaugaacagccugcgcccggaggacacagcucuuuauuucugugugaaggaucagagacaggacgaaugcgaggaauggugguccgauuacuaugacuuuggccgggagcugcccugucgcaaaagcagaggccucgggcuggccggaaucuucgauauguggggccacgggaccaugguuacagugucuucc

SEQ ID NO: 40117 - RNA, 432 nt, Artificial Sequence
  derived and/or modified sequence opt5 from anti-HIV_cap256-119-056402_VR-Chain
caggugaagcuggucgagagcggcgggggaguugugcaacccggcaaaucccucagacugucuugcaccgccagccaguucacauuuuccaauuucgggaugcacugggugcggcaggcuccuggaaagggccuugaaugggucgccucuaucagcuuuguggggauuaaaaagcauuacgcuaauuccguucgcggaagauucacgaucucucgggaccagagcaaaaacacccuguaucuccaaaugaacuccgugcgcgucgaggauacagcgagauacuuuugugcccgggacaugcgcgaauaugagugcgaacugugggccagcgauuacuaugacuucggcaagccgcagcccugugaggauccuagaggcgugguugggaccuuugacauguggggacuuggcacacuggugaccgucucuucc

SEQ ID NO: 40118 - RNA, 432 nt, Artificial Sequence
  derived and/or modified sequence opt5 from anti-HIV_cap256-119-056034_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugccaucagcuucgccgggacaaaaacgcauuaugcugacuccgugaagggaagauuuaccauuucucgggauaacagcaaaaaugcccuguaccuccagaugaacaaucugcgcgcugaggacacagcccuuuauuacugugcgaaggaucugagagaagacgagugcgaggaacggugguccgauuauuacgacuucggcaaacaacucccgugucgcaagagcagaggcguugccgggguguuugauaacuggggacagggcaccauggucacagugucuucc

SEQ ID NO: 40119 - RNA, 432 nt, Artificial Sequence
  derived and/or modified sequence opt5 from anti-HIV_cap256-119-055042_VR-Chain
caggugcaacuggucgagagcggcgggggaguugcccagcccggccggucccuccggcugucuugcgcugccagcggguucaccuuucgcuccuacggaaugcacugggugagacaggcgccuggcaaggggcuugaauggguggcugucaucucucuggacggaagcaacaaauauuacgccgauuccgugaagggccgguucucuauuagccgcgacaauuccaaaaacacacucuaucugcagaugaauagccuuagaccggaggauacggccguuuacuauugugcuaaggaccugcgggaagaugagugcgaggaacgcuggucugacuacuaugauuuuggcaaacaacuccccuguagaaaguccagagggguggccggagucuucgacaacuggggccaggggaccauggugacaguuagcucu

SEQ ID NO: 40120 - RNA, 438 nt, Artificial Sequence
  derived and/or modified sequence opt5 from anti-HIV_cap256-119-054776_VR-Chain
caggugcaacugauggagagcggcgggggagucguucagcccggcagaucccuccggcugucuugcaccgccagcggguucacauuuuccucuuacagcaugcacugggugcgccaggcuccuggaaagggccuugaauggguggccaucauuuccuaugacgagucuaacaaauacuaugcggauagcguccaggggagauucacgaucucccgggacaauagcaagaacacccuguuucuccaaaugucuucccugcgcgcugaagauacagcccuuuacuucugugugagagaccaucgggaggaugaaugcgaggagugguggagcgacuauuacgauuuuggacgcgaacugccguguagaaaauuccggggccucggccuggccgggauuuuugacaucuggggacacggcaccaugguuacagugucuucc

SEQ ID NO: 40121 - RNA, 432 nt, Artificial Sequence
  derived and/or modified sequence opt5 from anti-HIV_cap256-119-054539_VR-Chain
cagaugcaacugguggagagcggcgggggagucguucagcccggcgggucccucagacugucuugcgccgcuagccaguucaccuuuggauccuacgccaugcacugggugcggcagccuccgggcgaacgccccgaguggguggcgacaaucucuuucgacgggacgaagaaauaucaugcugauagcgucuggggaagauuuaccauuucccgggacaacucuaagaauacacuuuuccugcaaaugaacagccuccgcccugaagauaccgcccuguacuuuugugugaaagaccagagagaggaugccugcgaagaguggugguccgacuauuacgauuucggcaagaauugucuugcugagagccccggcgccuggcuggaauuuuucuauguuugggggcacggaacaauggugaccgucucuucc

SEQ ID NO: 40122 - RNA, 432 nt, Artificial Sequence
  derived and/or modified sequence opt5 from anti-HIV_cap256-119-054112_VR-Chain
caggugcaacuggucgagagcggcgggggaguugugcaggccggcagaucccuccggcugucuugcgcugccagcggguucaccuuuuccacauacgcgaugcacugggugcgccaggcucccggaaagggccuugaaugggucgccgugaucucuuaugacgggagcaauaaauacuaugccgauuccguuagaggacgguucacgauuucucgcgacaauagcaagaacacccuguaccuccagaugaacucccugagagcugaggauacagcccuuuauuacugugcuaaagacaugcgggaauaugagugcgaagaguggaccagcgauuacuacgacuuuggccgcccucaaccguguaucgauucuagaggcguggucgggacauuccauguguggggacagggcaccaugguuacaguguccagc

SEQ ID NO: 40123 - RNA, 432 nt, Artificial Sequence
  derived and/or modified sequence opt5 from anti-HIV_cap256-119-053339_VR-Chain
caggugcaccuggucgagagcggcgggggaguugugcaacccggcagaucccuccggcugucuugcgccgcuagccauuucucccuuucuagcuacgggaugcacugggugcgccaggccccuggaaagggccuggaaugggucaccgggaucuccuuugcgggaacaaaaacguauuacggcgacucugugagaggccgguucaccguuagccgcgauauuuccaagaacacacuccugcuucagaugaauagccugagaccggacgauaccgcuaucuauuacugugcccgggaccagcgcuauuacgagugcgaagagugggccucugauuauuacgacuuugggaaagaacaacccugucucgauccuagaggaguggucggcauuuucgaccugugggggcagggaacaauggugaccguuuccagc

SEQ ID NO: 40124 - RNA, 432 nt, Artificial Sequence
  derived and/or modified sequence opt5 from anti-HIV_cap256-119-052404_VR-Chain
cagaugcaacugguggagagcggcgggggagucguucagcccggcagaucccucacccugucuugcaucgccagccaguucaacuuugcuuccuacgggaugcacugggugcggcaggccccuggaaagggccuugaauggguggcgucuauuagccaugacgggacgaaaaaguaucacgcugaguccgucuggggacgcuucacaaucucuaaagauaauagcaagaacacccuguuucuccaaaugaacucccugagaguggaagacacagcccuuuacuucuguguuaaagaucagcgggaggacgaaugcgaggagugguggagcgauuauuacgacuuuggcaagcagcugccgugucgcaagucuagaggcguggccggggucuucgauaauuggggacagggcaccauggugacaguuuccagc

SEQ ID NO: 40125 - RNA, 432 nt, Artificial Sequence
  derived and/or modified sequence opt5 from anti-HIV_cap256-119-051123_VR-Chain
caggugcaacuggucgagagcggcgggggaguugugcagcccggcgggucccucagacugucuugcgugggaagccaguucauccuuuaccgguauggcaugcacuggguccgccaggccccugggaagggacuggaauggguggcugccguuuccuuugacggcaccgauaaauaccaugcggacgauguguggggcagauucacaauuucucgggacaacagcaagaauauccucuaucugcaaaugaacucccuucgcgcugaggauacggcccuguacuauugugccaaagaccucagagaagaugagugcgaagagugguggucugacuacuaugaucuggggaagcagcugccgugucggaaaagccgcggagucgcuggcguguuugacaagugggggcucggaaccaugguuacaguguccagc

SEQ ID NO: 40126 - RNA, 438 nt, Artificial Sequence
  derived and/or modified sequence opt5 from anti-HIV_cap256-119-051077_VR-Chain
gaggugcagcuggucgaaagcggcgggggaguugugcaauccggcagaucucuccggcugagcugcgccgcuucccacuucaccuuuucucgcuacgggaugcauugggugagacaggcccccggaaagggccuugagugggucgcgagcaucuccuaugacgggcgggauuucuaccacgcucgcucuguguggggaagauuuacaauuagccgggacaacuccaaaaauacgcuguuccuccagaugaacagccugcgcaucgaagauaccgcccuuuauuuuuguguuaaggaccagagagaggaugaaugcgaggagugguggucugacuacuaugauuucggccgggaacugccuugucgcaaauccagaggccucgggcuggccggaauuuuugacauguggggccaugggacaauggugaccgucagcucu

SEQ ID NO: 40127 - RNA, 432 nt, Artificial Sequence
  derived and/or modified sequence opt5 from anti-HIV_cap256-119-050442_VR-Chain
caggcccaaaugguggagagcggcgggggagucguucagcccggcagaucccugcggcucucuugcgcugccagcggguucuccuuuucuuacuucgcgaugcacugggugcgccaggcuccuggaaagggccuggaauggguggccgggaucagcuuugccgcuaccaaaacauauuacggaggcuccgucaagggcagauucacggugucucgggacauuagcaaaaauacccuuuaucugcagaugaacucccuccgcccggaggauacagccauguacuauugugcuagagaccaacgguacuaugaaugcgaggaaugggccagcgauuacuacgacuuugggcgcgagcagcccugucaggauccuagaggaguugugggcgucuucgacaugugggggcagggaaccauggugacaguuucuucc

SEQ ID NO: 40128 - RNA, 432 nt, Artificial Sequence
  derived and/or modified sequence opt5 from anti-HIV_cap256-119-049433_VR-Chain
caggugcaacuggucgagagcggcgggggaguugugcagcccggcagaucccuccgggugucuugccgcgccagcggguucgcuuuuuccucuuacgccaugcacugggucagacaggcgccugugaagggacuggaauggguugcucuuaccagcuccgacggcgccgauaaauaucaugccgacgaugugugggggcgguucacaaucucucgcgacaacagcaagaauacgcuguaccuccagaugaacucccugagaccggaggauaccgcucuuuauuacugugccaaagaccugcgggaagaugagugcgaggaacgcuggagcgacuauuacgauuuuggaaagcaacuccccuguagaaaaucucggggcgucgcuggcguguucgacaauugggggcagggaacaaugguuaccguguccagc

SEQ ID NO: 40129 - RNA, 432 nt, Artificial Sequence
  derived and/or modified sequence opt5 from anti-HIV_cap256-119-047532_VR-Chain
cugggcagacucguggccagcgggggaggcgucguucccccugggcggucccugacccuuucuugcguggcuagccaguucacauuuuccggauguggccugcacugggugcgccaagccccggggaagggacucgagugggucgcgucuaucagcuucgcuggcacgaaaaagcauuacaccaauuccgugagaggccgguuuacaauuucucgcgacaauagcaaaaacaccguuuaucugcagaugaacucccuuagagccgaagauacagcccuguacuauugcgcuaaggacaugggggaguacgaaugugaggaauggaccagcgauuauuacgacuucggacggccccagccuugcaucgauucucgcggcguggucgggauucucgacaucuggggacagggcacaauggugaccguuuccagc

SEQ ID NO: 40130 - RNA, 432 nt, Artificial Sequence
  derived and/or modified sequence opt5 from anti-HIV_cap256-119-047489_VR-Chain
caggugcaccuggucgagagcggcgggggaguugugcaacccggcaagucccucagacugucuugcgccgcuagccaguucaccuuuaaucgguucgggaugcauugggugcgccaggccccuggaaaaggccuugaaugggucgcggggaucuccuacgacggaucugauaaguaucacgcugacaaaguguggggcagauuuacaauuagccgggauaauuccaagaacacgcuguaccuccagaugaacucucugcgcgccgaggacaccgcccuuuauuacugugcuaaagaucugagagaagacgagugcgaagagugguggagcgauuauuacgacuucggcaagcggcucccgugucgcaaguccagagggguugccggaguguuugauaaauggggccaagggacaauggucaccgugagcucu

SEQ ID NO: 40131 - RNA, 438 nt, Artificial Sequence
  derived and/or modified sequence opt5 from anti-HIV_cap256-119-046020_VR-Chain
gaggugcagcugcuccaaagcggcgggggacugguccagcccggcgggucccuuagacugucuugcgccgcuagcggauucuccuuuucuagcuacgccauguccuggauccggcaggcgccuggcaaggggcucgaauggguugcuucuauuagccacgacggaaccaaaaaguaucaugccgaguccguguggggccgcuucacaaucagcaaagauaacucuaagaauacgcuguuucuucagaugaacucccugagaguggaagacaccgcccucuacuucugugucaaagaucaacgggaggacgaaugcgaggagugguggagcgauuauuacgacuuuggccgcgaacugccguguagaaagucucgggggcugggacucgcuggcauuuucgauaugugggggcacggaacaauggugaccguuuccagc

SEQ ID NO: 40132 - RNA, 432 nt, Artificial Sequence
  derived and/or modified sequence opt5 from anti-HIV_cap256-119-044746_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacaaauacuaugccgauucuguuaagggaagauucacaauuagccgggacaauuccaaaaacacgguguaccuggagaugaauagccuccgcgccgaagauaccgcucuguauuacugugccaaggaccuuagagaguaugaaugcgaggaguggacaucugauuacuacgacuuuggccggccgcagcccuguaucgauucccgcggcgucguggggauucuggacaucuggggacaaggcaccaugguuacagugagcucu

SEQ ID NO: 40133 - RNA, 432 nt, Artificial Sequence
  derived and/or modified sequence opt5 from anti-HIV_cap256-119-044740_VR-Chain
cagaugcaccugguggagagcggcgggggagucguucaacccggcaugucccucagacugucuugcgccgcuagccaguucaacuuuggguccuucggaaugcauugggugcggcaggccccuggcaaggggcuugaauggguggcgaccaucucuuacgacggaacgaaaaaguaucacagcgauuccgucuggggccgccugucuauuagcagagacaauuccaaaaacacacucuuucugcagaugaauagccuucggaccgaggauacagcucuguacuucugugugcgcgaccaaagagaagaugacugcgaggaaugguggucugauuauuacgacuuuggcaagaaacucccgugucggaagucccgcgggcuggccggaaucuucgauauuuggggccaugggaccaugguuacagugagcucu

SEQ ID NO: 40134 - RNA, 432 nt, Artificial Sequence
  derived and/or modified sequence opt5 from anti-HIV_cap256-119-043790_VR-Chain
cugcuccagcugguggagagcggcgggggagucguucaacccggcaacucccuuagacugucuugcgccgcugccggguucaccuuuagcgacuacucccuccacugggugcggcaggcgccuggaaagggccuggaauggguggcuaugaucucugaugacgggaaucuugauuucuaugccgccagcgucaaaggacgcuuuacaauuuccagagacaacucuaucaauacgguguaccugcagaugaacagccuccgggcugaggauaccgcccuguauuacugugcuaaggaccugcgcgaauaugagugcgaagaguggacauccgauuacuaugacuucggcagaccgcagcccuguauugauagccggggcguuguggggauccucgacauuuggucucaaggaaccauggucacaguguccagc

SEQ ID NO: 40135 - RNA, 432 nt, Artificial Sequence
  derived and/or modified sequence opt5 from anti-HIV_cap256-119-042880_VR-Chain
gaggugagacuggucgaaagcggcgggggacucguucagcccggcgggucccugcggcuuucuugcgccgcuagcggauucacccuguccgacuacuauaugucuuggauccgccaagccccuggcaaggggcucgaguggguggcggcuauuagcuuugccggaacgaaaaagcacuacggcaauuccgugaaaggcagauucacaaucucucgggauaauagcaagaacacccuguaucuugaaaugaacucccugcgcgucgaggacacagcccucuacuauugugcuaaagaucugagagaauacgagugcgaggaauggaccagcgacuauuacgauuuugggcggccgcagcccuguauugacucucgcggagugguuggcauccuggauauuugggggcagggaacaauggugaccgucuccagc

SEQ ID NO: 40136 - RNA, 432 nt, Artificial Sequence
  derived and/or modified sequence opt5 from anti-HIV_cap256-119-042606_VR-Chain
cagaugcaacugguggagagcggcgggggagucguucagcccggcagaucccuccggcugucuugcgccgcuagccaguucaccuuuggguccuacggaaugcacugggugcgccagaucccuggcaaggggcuugaaugggugacaggaauuucuuucgccgcgacgaaaaccuauuacggcgacagcgucagaggccgguuuacagugucccgcgauaucucuaagaacacccuguaucuccaaaugaauagccugagaccggaggacacagcuauguacuauugugcccgggaucagcgcuacuaugaaugcgaggaaugggccuccgacuacuacgauuucgggagagagcagcccugucaggacccucggggaguugugggcauucuugaucugugggggcaaggaaccauggucacagugagcucu

SEQ ID NO: 40137 - RNA, 432 nt, Artificial Sequence
  derived and/or modified sequence opt5 from anti-HIV_cap256-119-042444_VR-Chain
caggugcaacuggucgagagcggcggggacguugugcaccccggaggcucccucagacugucuugcgccgcuagcggguucaccuuuuccucuuacggaauccauugggugcggcaggccccuggcaaggggcuugaaugggucgcggcuauuagcuaugauggauccgacaaauaccacacaaacucuguguggggccgcuucacgguuagcagagauaauuccaagaacaccguguaucugcagaugaauagccuccgggccgaggacacagcccuguacuuuuguguccgcgauagacgggaaucugagugcgaacuuugggaguccgacuauuacgauuucggcaaacgccugccgugugugaagcccagagggguugcuggaguguuugacaucuggggccaggggaccauggucacagugagcucu

SEQ ID NO: 40138 - RNA, 432 nt, Artificial Sequence
  derived and/or modified sequence opt5 from anti-HIV_cap256-119-040328_VR-Chain
caggugcaacuggucgagagcggcgggggaguugugcagcccggcgggucccucagacugucuugcgccgcuagcggauucaccuuuuccucuuacagcaugaacugggugcggcaggccccuggcaaggggcuugaaugggucgcguccaucucuuucgcuggaacaaaacagcacuauggcaauagcgugaagggccgcuuuacgauuuccagagacaacagcaaaaauaccguuuaccugcaaaugaacucucuccggcuggaggauacagcccuuuauuacugugccaaggaccugcgcgaauaugagugcgaagaguggaccuccgauuacuaugacuucgggagaccgcagcccuguaucgauagccggggaguggucggcauucucgacaucugggggcagggaacaauggugaccguuucuucc

SEQ ID NO: 40139 - RNA, 432 nt, Artificial Sequence
  derived and/or modified sequence opt5 from anti-HIV_cap256-119-040164_VR-Chain
cagaugcaccugguggagagcggcgggggagucguucaacccggcaugucccucagacugucuugcgccgcuagccaguucaacuuuggguccuucggaaugcauugggugcggcaggccccuggcaaggggcuugaauggguggcgaccaucucuuacgacggaacgaaaaaguaucacagcgauuccgucuggggccgcuuuucuauuagcagagacaauuccaaaaacacacuguaccuccagaugaauagccugcggaccgaggauacagcucuuuauuucugugccaaggaccugcgcgaauacgagugcgaagaguggaccucugauuauuacgacuuuggcagaccgcaacccuguaucgauucccggggagugguugggauucucgacaucuggggccaggggacaauggugaccgucagcucu

SEQ ID NO: 40140 - RNA, 432 nt, Artificial Sequence
  derived and/or modified sequence opt5 from anti-HIV_cap256-119-039130_VR-Chain
gaggaacagcugguggagagcggcgggggacucguccaacccggcagaucccugcggcuuucuugcaccgggagcggauuccgcuuuggcgacuacgccaugaacuggguuagacaggcuccugggaagggacuggaaugggugacauucaucuccuaugauggcucuaauaaacacuacgccgacagcgugaagggccgguuuacggucucccgcgauaacucuaaaaauacccuccaucugcagaugaacagccuuagaccggaggacacagcgcuguauuucugugcucgggaucuccgcgaauccgagugcgaggaaugggagagcuacuauuacgacuuugggaagaaaggacccugugugaagccuagaggcguuguggggguccuggauauuuggggacagggcacccuggugacaguuucuucc

SEQ ID NO: 40141 - RNA, 432 nt, Artificial Sequence
  derived and/or modified sequence opt5 from anti-HIV_cap256-119-038138_VR-Chain
caggugcaacuggucgagagcggcgggggaguugugcagaccggcagaucccuccggcugucuugcacagggagccaguucacguuuggacgcuacggcauguauugggugagacaggcccccgggaagggacuugaaugggucgcuuccaucucuuacgacggccgggauuucuaucacgcccgcagcguguggggcagauuuaccauuucccgggacaacucuaaaaauacacugcaucuccaaaugaacagccugcgcccugaggauaccgcgcuuuacuucugugcuagagaccugcgggaauccgagugcgaagagugggagagcuauuacuaugauuuugggaagaaaggaccguguguuaagccccgcggcguggucggggugcucgacaucuggggacagggcacacugguuaccgugucuucc

SEQ ID NO: 40142 - RNA, 432 nt, Artificial Sequence
  derived and/or modified sequence opt5 from anti-HIV_cap256-119-037868_VR-Chain
caggugcaacuggucgagagcggcgggggaguugugcagcccggcagaucccuccggcugucuugcgccgcuagccaguucaccuuuuccaaguacgggaugcacugggugcgccaggccccuggaaaaggccuucaaugggucgcggggaucucuuaugacggaagcgauaaguaccaugcucacuucguguggggcagauuuuccauuucucgggacaacagcaaaaaugcccuguaucuccagaugaacucccugcgcacagaagauacggcccuuuacuucuguguuagagaccugcgggagagcgaaugcgaggaauggaagucugauuauuacgacuuuggccgcaaagggccgugucucaagcccagaggaguggcuggcuccuucgauaucugggggcagggaaccgucgugacaguuagcucu

SEQ ID NO: 40143 - RNA, 432 nt, Artificial Sequence
  derived and/or modified sequence opt5 from anti-HIV_cap256-119-037102_VR-Chain
caggugaagcuggucgagagcggcgggggaguugugcaacccggcaaaucccucagacugucuugcaccgccagccaguucacauuuuccaacuucgggaugcacugggugcggcaggcuccuggaaagggccuugaaugggucgccucuaucagcuuuguggggauuaaaaagcauuacgcgaauuucguucgcggaagauuuacgaucucccgggaccagucuaaaaacacccuguaucuccaaaugaauagcgugcgcgucgaggauacagcuagauacuauugugcccgggacaugcgcgaauacgagugcgaacugugggccuccgauuauuacgacuucggcaagccgcagcccugugaggauccuagaggcgugguugggaccuuugacauguggggacuuggcacacuggugaccgucagcucu

SEQ ID NO: 40144 - RNA, 438 nt, Artificial Sequence
  derived and/or modified sequence opt5 from anti-HIV_cap256-119-036683_VR-Chain
ggcgugcagcuggucgagagcgggggagccguugugagacccggcgggucccucacccugucuugcgcugccagccaauucauccuuuccucuuacggaaugcacugggugcggcaggcgccuggcaaggggcuggaaugggucgcuagcauuuccaaugacggaacgaaaaaguaucaugccgagucugugugggaucgcuuuagcaucuccaaagacaauagcaagaacacacucuuccugcagaugaacucucuuagaguugaagauaccgcccuguacuuuugugugaaagaccagcgggaggaugaaugcgaggaguggugguccgacuauuacgauuucggccgcgaacucccguguagaaagagccggggccuggggcuggcuggaauuuuugacauguggggccacgggacaauggucaccgugucuucc

SEQ ID NO: 40145 - RNA, 432 nt, Artificial Sequence
  derived and/or modified sequence opt5 from anti-HIV_cap256-119-036495_VR-Chain
caggugcaacuggucgagagcggcgggggaguugugcagcccggccggucccuccggcugucuugcgccgcuagcggguucuccuuuucuagcuacggaaugcacugggugcgccaggccccuggcaaggggcuugaaugggucgcguccaucucuuucgugggaauuaaaacccauuaugcuaacagcguuagaggccgguuuacaaucucccgcgaccagagcaagaauacgcuguaccuccaaaugaacucugugagaauugaggauaccgcccgguauuucugugcccgcgacaugagagaauacgagugcgaacugugggcuuccgauuauuacgacuuuggcaaaccgcagcccugugaggauccuagaggggucgugggaacauucgacauguggggccuugggacccugguuacagugagcucu

SEQ ID NO: 40146 - RNA, 438 nt, Artificial Sequence
  derived and/or modified sequence opt5 from anti-HIV_cap256-119-035375_VR-Chain
gaggugcagcuggucgaaagcggcgggggacucguucaacccggcagaucccugcggcuuucuugcgccgcuagcggguucacccuggaggacuacggaaugcacugggugcgccaggccccuggcaaggggcucgaauggguggcguccaucucuaaugauggaacgaaaaaguaucaugcugagagcgucugggacagauuuuccauuucuaaagauaauagcaagaacacacuguuccuucagaugaacucccugcggguggaagacaccgcccucuacuuuuguguuaaagaucagcgcgaggacgagugcgaagagugguggagcgauuauuacgacuucggcagagaacugccgugucggaagucucgcggccuggggcucgccggaaucuuugauauguggggccacgggacaauggugaccgucuccagc

SEQ ID NO: 40147 - RNA, 438 nt, Artificial Sequence
  derived and/or modified sequence opt5 from anti-HIV_cap256-119-035165_VR-Chain
caggugcaccuggucgagagcggcgggggaguuggccaacccgccagaucccuccggcugucuugcgcugccagcggguucauccuuuccucuuacggacugcauugggugcgccaggcgccuggcaaggggcucgaauggguggcucugauuagcuaugacggaaacaaugaguacuaugccgaauccgucuggggcagauuuaccaucucuaaagauaacagcaagaauacacuuuuccugcagaugaacucccuccggguggaggacacggcccuguacuuuuguguuaaagaucagcgcgaagacgagugcgaggaaugguggagcgauuauuacgacuucggcagagagcugccgugucggaagucucgcgggcucggacuggcuggcauuuuugauaugugggggcacggaaccauggugacagucuccagc

SEQ ID NO: 40148 - RNA, 432 nt, Artificial Sequence
  derived and/or modified sequence opt5 from anti-HIV_cap256-119-035109_VR-Chain
caggugcaacuggucgagagcggcgggggaguugugcagcccggcagaucccuccggcugucuugcgccaccgcuggguucacauuuagcuccuacgccaugcacugggugcgccaggcgccuggaaagggccuugaaugggucgcuucuaucagcuaugacggguccgauaaauaccaugccgaccugguguggggaagauucacgauuucucgggauaacagcaagaauacccucuaucugcagaugaacucccuucgcgccgaggacacagcucuguacuauuguguuagagaugcccgggaaagcgagugcgaacucugggagucugacuacuauaauuuuggccgcaaacugccgugugugaagcccagaggcgucgcugggacccuggauaucuggggacaaggcacaauggugaccguuuccagc

SEQ ID NO: 40149 - RNA, 339 nt, Artificial Sequence
  derived and/or modified sequence opt5 from anti-HIV_cap256-119-033789_VR-Chain
cagguguaccuggucgagagcggcgggggaguugugcaacccggcagaucccuccggcugucuugcgccgcuagccacuucucccuuucuagcuaugggaugcauugggugcgccaggccccugacaucuccaagaacacccuguaccuccaggucaauucucugagaccggaagauacagcgauguauuacugugcucgggaccagcgcuauuacgagugcgaagagugggccagcgauuauuacgacuuuggaaaagaacaacccugucuugauccuagaggcgugguugggauuuucgacaucuggggacagggcacgauggugaccgucuccagc

SEQ ID NO: 40150 - RNA, 432 nt, Artificial Sequence
  derived and/or modified sequence opt5 from anti-HIV_cap256-119-033641_VR-Chain
caggugcaacuggucgagagcggcgggggaguugugcagaccggcagaucccuccggcugucuugcacagggagccaguucacguuuggacgcuacggcauguauugggugagacaggcccccgggaagggacuugaaugggucgcugccaucuccuacgacggcucugauaaauaucacaccaacagcguguggggccgguucacaguuucccgcgacaauucuaagaacaccguguaccugcaaaugaauagccucagagcggaggauacagcucuguauuuuuguguccgggaccgcagagaauccgagugcgaacuuugggagagcgauuacuaugacuucgggaaacggcugccuugugugaagccgcgcggaguugccggcguguuugauauuugggggcagggaaccauggucacagugucuucc

SEQ ID NO: 40151 - RNA, 432 nt, Artificial Sequence
  derived and/or modified sequence opt5 from anti-HIV_cap256-119-032113_VR-Chain
caggugcaacuggucgagagcggcgggggaguugugcagcccggccggccucuccggcuguccugcguggggucuggauucagcuuuaucaccuccgccaugcacuggguccgccaggcuccggacaagggccuugaauggguggccauuaucucugaugggggaaacaauagacauuacgcggacagcguuaaaggccgguucacaauuucccgcgauaacucuaagaauacgguguuucuggaggucaacaaucucagacccgaagacaccgcuauguauuacugugcccgggaucagcgcuauuacgagugcgaagagugggccagcgacuauuacgauuucggcagagagcaaccuugucaggaccccagaggggugguuggaguguuugauauguggggccaggggacaauggucaccguguccagc

SEQ ID NO: 40152 - RNA, 432 nt, Artificial Sequence
  derived and/or modified sequence opt5 from anti-HIV_cap256-119-031739_VR-Chain
caggugcaacuggucgagagcggcgggggaguugugcagcccggcagaucccuccggaucucuugcgccgcuagccaguucaccuuuaaccgcuacgggaugcacugggugagacaggccccuggaaagggccuggaaugggucgcguccauuucuuaugacgggagcgauaaauaccaugcuggacuuguguggggccgguucaucauuucccgcgacaauucuaagaacacacuguaucuccaaaugaauagccugagagccgaggauacggcccuuuacuauuguguucgggacgaacgcgaguccgaaugcgagcugugggagagcgauuacuaugacuuuggcaaaaagcucccgugugugaaacccagaggggucgcuggaacccuggauaucuggggccaggggacacgggugaccguuucuucc

SEQ ID NO: 40153 - RNA, 432 nt, Artificial Sequence
  derived and/or modified sequence opt5 from anti-HIV_cap256-119-030932_VR-Chain
gaggugcagcugcucgaaagcggcgggggagucguucaacccggcagaucccugcggcuuucuugcgccgcuagcggguucgccuuuucccacuacggaaucuucugggugcgccaggcgccuggcaaggggcuggagugggugaccgucauuucuggagacggcagcacacagugguaugcugauuccgugcagggcagauuuacgaucucucgggacagcuccaaaaacacccucuaccugcaaauggaugggcuucgcggagaagacacagcccuguauuacugugccaaggaucucagagagcuggaaugcgaggagugggcuagcgacuauuacgauuucggccggccgcagcccugucuggacccucgcgggguuucuggaauuuccaauguguggggccaggggaccauggucacagugagcucu

SEQ ID NO: 40154 - RNA, 438 nt, Artificial Sequence
  derived and/or modified sequence opt5 from anti-HIV_cap256-119-030740_VR-Chain
caggugcaacuggucgaguucggcgggggaguugugcagaccggcagaagccuccggcuguccugcgccgcuucuggguuuacauucagcgacuacggaaugcacugggugcgccaggcccccggcaaggggcuugaaugggucgcguccaucucuaacgauggaagcaaaaaguaucauggcgacuccgugugggcuagauuuauuaucucucgggauaauagcaaaaacacgcuguuccuccagauguccagccugcgcgccgaggacaccgcccuuuacuuuuguguuagagaucaccgggaagacgagugcgaagagugguggucugauuauuacgacuucggccgcgagcugccuuguagaaaguuucgggggcucggacuggcuggcauuuucgauaucugggggcauggaacaauggugaccgucuccagc

SEQ ID NO: 40155 - RNA, 438 nt, Artificial Sequence
  derived and/or modified sequence opt5 from anti-HIV_cap256-119-030197_VR-Chain
caggugcaccuggucgagagcggcgggggaguugugcaacccggcaagucccucagacugucuugcgccgcuagccaguucaccuuuugucgguacgggaugcauugggugcgccaggccccuggaaaaggccuugaaugggucgcguccaucucuaacgacgggacagauaaguaucacgcugacaauguguggggaagauucacgauuagccgggauaacuccaaaaauacccuguaccucgagaugaacucucugcgcggcgaagacacagcccuuuauuacugcgccaaggauaugagagaggacgaaugugaggagugguggagcgauuauuacgacuuuggcaaagaacugccgugccggaaguggaagacccgcgggguugcuggaauccucgauaauuggggccaggggacaauggugaccgucuccagc

SEQ ID NO: 40156 - RNA, 438 nt, Artificial Sequence
  derived and/or modified sequence opt5 from anti-HIV_cap256-119-027047_VR-Chain
cagaugcaacugguggagagcggcgggggagucguucagcccggcagaucccucacccugucuugcgccgcuagccaguucacauuucggaacuacgggaugcacugggugcgccaggccccuggaaagggccuugaauggguggcguccaucucuaaagacgggacgaagaaauaucauggagauagcgucuggggcagauucauuaucucccgggacaauucuaagaacacccuguuucuccaaaugagcucccugcgcgcugaggauacagcccuuuacuucugugugagagaccagcgggaagccgagugcgaagagugguggagcgauuauuacgacuuuggccgcgagcugccguguagaaaauuccgggggcucggacuggcuggcauuuuugauaucugggggcacggaaccaugguuacagugucuucc

SEQ ID NO: 40157 - RNA, 432 nt, Artificial Sequence
  derived and/or modified sequence opt5 from anti-HIV_cap256-119-026950_VR-Chain
caggugcaacuggucgagagcggcgggggaguugugcagcccggcaagucccucagaaucucuugcgccgcuagccgguucaccuuugggcgcuucggaaugcacugggugagacaggccccuggcaaagggcuggaaugggucgcguccauuucuuacgacggaagcgauaaguaucaugcuggccuuguguggggccgguuuaucauuucccgcgacaacucuaaaaauacacuguaccuccagaugaacagccugagagccgaggauacggcccuuuauuacuguguucgggacgaacgcgaguccgaaugcgagcugugggagagcgauuauuacaauuucgggaagaacuauccgugugugaaacccagaggagucgcuggcacccucgacaucugggggcaaggaacaaccgugauuguuucuucc

SEQ ID NO: 40158 - RNA, 438 nt, Artificial Sequence
  derived and/or modified sequence opt5 from anti-HIV_cap256-119-026279_VR-Chain
cagaugcaacugguggagagcggcgggggagucguucagcccggcaccucccucacacugucuugcgccgcuagccaguucuccuuuacgucuuacgggaugcacugggugagacaggccccuggaaagggccuugaauggguggcgagcaucuccaacgacgggaccaaaaaguaucaugcugagucugucuggggacgguucacaauuagcaaagauaauuccaagaacacccuguuucuccaaaugaauagccugcgcguggaagacacagcccuuuacuucuguguuaaagaucagagagaggacgaaugcgaggagugguggucugauuauuacgacuuuggccgggaacugccgugucgcaaguccagaggccucgggcuggccggaaucuucgauauuuggggccacgggaccguggucaucgugagcucu

SEQ ID NO: 40159 - RNA, 432 nt, Artificial Sequence
  derived and/or modified sequence opt5 from anti-HIV_cap256-119-025355_VR-Chain
gaggugcagcuggucgaaagcggcgggggacucguucaacccggcagaucccugcggcuuucuugcgccgcuagcggguucuccuuuucugacuacgccaugcacugggugcgccaggcgccuggacagggccuggaguggguggcuuucaucagcuaugaugggaccaagaaauaccauuccgacucugucuggggaagacucacaauuagccgggauaacucccgcaauacgcuguuucuucagaugaacagccugagaaccgaagacacagcccucuauuucugugugcgggaucaacgcgaggacgauugcgaagagugguggucugacuacuaugauuuuggcaagaaacugccguguagaaagucccggggccuggccgggaucuucgacauuuggggacacggcaccaugguuacagugagcucu

SEQ ID NO: 40160 - RNA, 432 nt, Artificial Sequence
  derived and/or modified sequence opt5 from anti-HIV_cap256-119-025301_VR-Chain
caggugcaccuggucgccagcggcgggggaguugugcccccuggcagaucccuccggcugucuugcguggcuagccaauucaccuuuuccggguucggacuuuacuggguccgccaggccccgggcaaggggcuggaguggguggcggcuaucucuuuugccggaacgaaaaagcauuaugccaacagcguuaaaggcagauucacaauuucccgggacaauucuaagaacacccucuaccugcagaugaauagccuucgccccgaugacacagcucuguauuacugugccaaagaucucagagaauaugagugcgaagaguggaccuccgacuacuaugauuuuggccggccucagcccuguaucgacagccgcgggguggucggcauucuggauaucuggucucaaggaacaauggugaccguuuccagc

SEQ ID NO: 40161 - RNA, 438 nt, Artificial Sequence
  derived and/or modified sequence opt5 from anti-HIV_cap256-119-025010_VR-Chain
caggugcaacuggucgagagcggcgggggaguugugcagcccggcagaucccuccggcugucuugcccugccagcggguucuccuuuucuaccuacggaaugcacugggugcgccaggcuccgggcaaggggcuugaaugggucgccagcaucuccaacgacggaaauaaaaaguaucauggcgagucugugugggauagauucacaauuagccgggacaacuccaaaaauacgcuguuucuccagaugaaccgccugagaguugaagauaccgcgcuuuacuucugugugaaggaccaacgggaggaugaaugcgaggagugguggagcgacuauuacgauuuuggccgcgaacugcccuguagaaaauuccgggggcucggacuggcuggcaucuuugacgucugggggcacggaacaauggugaccguuucuucc

SEQ ID NO: 40162 - RNA, 432 nt, Artificial Sequence
  derived and/or modified sequence opt5 from anti-HIV_cap256-119-024631_VR-Chain
caggugcaacugauggagagcggcgggggagucguucagcccggcgggucccucagacugucuugcgccgcuagcggauucaccuuuuccucuuacggcaugcacugggugcggcaggccccugggaagggacuugaauggguggcgggcaucagcuaugacggcuccgauaaauaccaugcucacuucgucugggggcgcuuuauuaucucuagagacaacagcaagaaugcccuguaucuccagaugaacucccugcggccggaggauacagcccuuuacuucugugugcgcgaccugagagaaagcgagugcgaagaguggcaaucuuauuacuaugauuuuggacggaaaggccccugucucaagccucgcgggguugcuggauccuucgacauuuggggccaggggacgguggucaccgugagcucu

SEQ ID NO: 40163 - RNA, 432 nt, Artificial Sequence
  derived and/or modified sequence opt5 from anti-HIV_cap256-119-024467_VR-Chain
gaggugcagcuggucgaaagcggcgggggacucguucaacccggcgggucccugaacgugucuugcgccgcuagcggauucaccuuuagaacauacgccaugcacugggugcggcaggcgccuggcaaggggcuugagugggucgcugccaucuccuaugacggagauaauaaauacucugccgacagcgugaagggccgcuucacgauuuccagagaucagucuaaaaacacccuguaucuccagaugaauagcguucggguggaagacacagcucgcuacuauugugccagagauaugcgggaguacgaaugcgagcugugggcuuccgacuauuacgauuuuggcaagccgcaacccugugaggacccucgcggggucgugggaaccuucgauauguggggccuugggacacugguuaccgugagcucu

SEQ ID NO: 40164 - RNA, 432 nt, Artificial Sequence
  derived and/or modified sequence opt5 from anti-HIV_cap256-119-023805_VR-Chain
caggugcaacuggucgagagcggcgggggaguugugcagcccggcaagucccucagacugucuugcgccgcuagccaguucggguuuggauccuacggcaugcacugggugcggcaggccccugggaaaggacuugaaugggucgcgaccaucucuuucgacggcgcugauaaguaucaugccgacgauguguggggccgcuuuagcauuuccagagacaacucuaaaaauacacuguaccuccaaaugaacaaucugcggccggaggauacggcccuuuauuacugugcuaaggaccugcgcgaagaugagugcgaagagagauggagcgacuauuacgauuucgggaaacagcuccccugucggaagucccgcggaguugccggcguguuugacaacugggggcagggaaccauggucacagugagcucu

SEQ ID NO: 40165 - RNA, 432 nt, Artificial Sequence
  derived and/or modified sequence opt5 from anti-HIV_cap256-119-021736_VR-Chain
caggugcaacuggucgagagcggcgggggaguugugcagcccggcagauccgugcggcucucuugcgucgccagccaguucuccuuugaccgcuacgggaugcacugggugagacaggcuccuggaaagggccuggaauggguugccucuaucagcuaugaugggaccgacaaauaccaugcggauaagguguggggacgguucacaauuucccgcgacaacucuaaaaagacgcuuuaucugcaaaugaauagccucagaccggaggaugcugcccuguacuauugugccaaagaccuucgggaagaugagugcgaagaguggugguccgacuacuaugauuuuggcaagcagcugcccugucgcaagagcagaggcgucgcugggaucuucgacucuuggggacagggcaccauggugacaguuuccagc

SEQ ID NO: 40166 - RNA, 438 nt, Artificial Sequence
  derived and/or modified sequence opt5 from anti-HIV_cap256-119-021203_VR-Chain
cagaugcaacugguggagagcggcgggggagucguucagcccggcagaucccucacccugucuugcgccgcuagccaguucacauuuuccaacuacgggaugcacugggugcggcaggccccuggaaagggccuugaauggguggcgucugucagcaaugacgggacgaaaaaguaucauggagauuccgugugggaccgcuucaccaucucuagagauaacagcaaaaauacacuguuucuccaaauguccagccugcgggcugaggacaccgccguuuacuucugugugcgcgaugaaagagaggacgaaugcgaggagugguggucugauuauuacgacuuuggccgggaacuuccgugucgcaaguucagaggccuggggcucgccggaauuuuugauaucuggggccacgggacacuggucaccguguccagc

SEQ ID NO: 40167 - RNA, 432 nt, Artificial Sequence
  derived and/or modified sequence opt5 from anti-HIV_cap256-119-020569_VR-Chain
caggugcaacuggucgagagcggcgggggaguugugcagcccggcgaaucccucagaaucucuugcgccgcuagccaguucaccuuuucccgguacgggaugcacugggugcgccaggccccuggaaagggccuggagugggucgcgucuauuagcuucgacgggagagauaaauaucauuccucucuuguguggggacggcugacaaucagccgcgacaauuccaagagcacgcucuuucugcaaaugaacucucuuagaccggaagauaccgcucuguacuauugugcccgggacguucgcgaguccgaaugcgaggaguggcagagcgauuacuaugccuucuacagaaaacuccccugugugaagccucggggcgucgcuggcacacuggacauuugggggcagggaaccauggugacaguuucuucc

SEQ ID NO: 40168 - RNA, 432 nt, Artificial Sequence
  derived and/or modified sequence opt5 from anti-HIV_cap256-119-019432_VR-Chain
caggugcaacugguccagagcggcgggggaguugugcagcccggcagaucccuccggaucucuugcgccgcuccuuacuucaccuuugggcgcuauggauuccacugggugagacaggccccgggcaaggggcuggagugggucgcgagcauuuccuuugacggacgggauuacuaucauucuccccacguguggggccgccuuacaaucagcagagacaacuccaaaaauacgcuguaccuccaaaugaacucucugcgggcugaagauaccgcccuuuauuacugugcccgcgaccugagagagagcgaaugcgaggaaugggaguccgauuauuacgacuucggcaagaaagggccuuguguuaagccccggggaguggcuggcagccucgauaugugggggcagggaacaauggucaccgugucuucc

SEQ ID NO: 40169 - RNA, 432 nt, Artificial Sequence
  derived and/or modified sequence opt5 from anti-HIV_cap256-119-018827_VR-Chain
caggcccaacugguggagagcggcgggggagucguucagcccggcagaucccuccggcugucuugcgcugccagccacuucuccuuuaaucgcuacgggaugcauugggugagacaggcgccuggaaagggccuugaauggguggcugggaucucuuaugacggacgggauuucuaccacgccgacauugucuggggccgccugaccaucagcagagauaauuccaaaaacacaguguaucuccagaugaacucucugcgggccgacgauacgggccuuuacuauugugcucgcgacguuagagagagcgaaugcgaggaaugggaguccuacuauuacgauuuugggcggaagggaccgugucugaaaccccgcggcguggccgggaccuucgacauguggggacaaggcacaauugucagcgugucugcu

SEQ ID NO: 40170 - RNA, 432 nt, Artificial Sequence
  derived and/or modified sequence opt5 from anti-HIV_cap256-119-018483_VR-Chain
cuggugcagcucgucgagagcggcgggggaguugugcaacccggcaagucccugagacuuucuugcguggccagccaguucaccuuuaaucgguacgggaugcacuggguccgccaggcuccuggaaaaggccuggaauggguggccgggaucuccuaugacggaagagauaaguaccaugcgcacuucguuuggggccggauuacaaucucucgcgacaauagcaaaaacacgcucuaucugcagaugaacucccuuagagcugaggauaccgcccuguaccauugugugcgggaccuccgcgaaucugagugcgaacugugggagagcgauuauuacgacuuuggcaagaaacugccgugugucaagcccagagggguggccggaauuuucgaucucuggggccaagggacaaugguuaccguguccagc

SEQ ID NO: 40171 - RNA, 432 nt, Artificial Sequence
  derived and/or modified sequence opt5 from anti-HIV_cap256-119-018118_VR-Chain
caggugcaccuggucgccagcggcgggggaguugugcccccuggcagaucccucacccugucuugcguggcuagccaauucacauuuuccggguguggacuucauuggguccggcaggccccgggcaaggggcuggaguggguggcgucuaucagcuucgcuggaacgaaaaagcacuacggcaauuccguuaaaggccgcuuuaccauuucuagagacaauagcaagaacacacucuaucugcagaugaacucccuucggcccgaagauaccgcccuguacuauugcgccaaagaccuccgcgaguacgaaugugaggaauggacaagcgauuauuacgacuucgggagagaucagccuugcaucgacucucggggaguggucggcauucuggauaucugggggcaaggaaccauggugacaguuuccagc

SEQ ID NO: 40172 - RNA, 432 nt, Artificial Sequence
  derived and/or modified sequence opt5 from anti-HIV_cap256-119-017782_VR-Chain
caggugcaacuggucgagagcggcgggggaguugugcagcccggcaagucccucagacugucuugcgccgcuagcggguucccuuuuuccaacuacgccaugcacugggugcggcagaccccgggacgcggccuugaaugggucgcggggaucucuuucgcugccacgaaaaaguauuacagacccagcgugcggggacgcuuuacaguuuccaccgacauuucuaaaaauacacuguaucucgagaugaacagccugagaccugaagauaccgcccuuuacuucugugcucgggaccagcgcuauuacgagugcgaagagugggccuccgauuauuacgacuuuggcagagagcaacccugucuggauccucggggcguggucgggaucuucgaccucuggggacagggcacaauggugaccguuagcucu

SEQ ID NO: 40173 - RNA, 432 nt, Artificial Sequence
  derived and/or modified sequence opt5 from anti-HIV_cap256-119-017669_VR-Chain
caggugcaacuggucgagagcggcgggggaguugugcagcccggcuccucucuccggcugagcugcgccgcuucccacuucgccuuuaaccgguacgggaugcauugggugcgccaggcgccuggaaagggccuugaaugggucgcugggaucucuuucgacggagccgauaaauuucacgccgacaagguguggggcagauucaccauuagccgggauaauuccaaaaacacacugucucuccagaugaauagccugcgcccggaggacacggcucuuuauuacugugccaaggaucugagagaagacgagugcgaagaguggugguccgauuauuacgacuuuggccggcgccuccccuguagaaaaagcagagggguuucuggaaucuucgauaacuggggccaagggaccauggugacagucuccagc

SEQ ID NO: 40174 - RNA, 432 nt, Artificial Sequence
  derived and/or modified sequence opt5 from anti-HIV_cap256-119-016976_VR-Chain
caggugcaacuggucgagagcggcgggggaguugugcagcccggcagaucccuccggcugucuugcgccgcuagccaguucuccuuuggggacuucggaaugcacugggugcgccaggccccuggcaaggggcuugaaugggucgcggcuaucucuuuugccggaaccaaaaagaacuacgccgauagcgugagaggccgguucacaauuucccgcgacucuagcaaaaauacgcuguaucuccaaaugaacucccugagaccggaggauaccgcucuuuacuauuguguuaaggacaugcggggcuacgaaugcgaggaauggacaagcgauuauuacgacuuugggcgcccccagccuuguaucgauucuagaggaguggucggcaccuucgacgugugggggcagggaacaaugguuaccguguccagc

SEQ ID NO: 40175 - RNA, 432 nt, Artificial Sequence
  derived and/or modified sequence opt5 from anti-HIV_cap256-119-015432_VR-Chain
gaggugcagcugcucgaaagcggcgggggacugguccaacccggcgggucccuuagacugucuugcgccgcuagcggauucaccuuuuccggcuacucucucaacuggguucggcaggccccugggaagggacuggaguggguggcgagcaucuccuaugacggcucugauaaauaccacgcugaccgcguguggggcagauucacaauuagccgggauaauuccaagaacacgcuuuaucugcagaugaauagccuccgcgccgaagacaccgcccuguacuauugugucagagaugcucgggagucugaaugcgagcugugggaguccgacuacuauaacuuugggcgcaaacucccgugugugaagcccagaggaguugccggcacacuggauaucugggggcagggaaccauggugacagucagcucu

SEQ ID NO: 40176 - RNA, 432 nt, Artificial Sequence
  derived and/or modified sequence opt5 from anti-HIV_cap256-119-015281_VR-Chain
cugggcagacucguggccagcgggggaggcgucguucccccugggcggucccugcgccuuucuugcguggcuagccaguucaccuuuuccggauguggccugcacugggugagacaagccccggggaagggacucgagugggucgcgucuaucagcuucgcuggcacgaaaaagcauuacggcaauuccgugaaagggcgguuuacaauuucucgcgacaauagcaagaacaccguuuaucuggaaaugaacucccuuagagccgaggauacagcccuguacuauugcgcuaaagaccuccgggaauacgagugugaagaguggaccagcgauuauuacgacuucggacgcccccagccuugcaucgauucuagaggcguggucgggauucuggacaucuggggacagggcacaauggugaccguuuccagc

SEQ ID NO: 40177 - RNA, 432 nt, Artificial Sequence
  derived and/or modified sequence opt5 from anti-HIV_cap256-119-014957_VR-Chain
caggugcaagucguugagagcggcgggggaguggugcagcccggcaccucccugagacucucuugcacagucagcggguucuccuuuucuaacuacgaccugcacugggugcggcagacgccugccaagggacuugaauggguugcuguggucagcuaugauggcucccgcgaguacuauaccgacucugugaaagggagauucaucauuagccgggaucaguccaagaauacacuguaccuccaaaugaacagcguucgccuggaagacaccgccagauauuacugugcgcgggauaugcgcgaguaugaaugcgagcuuugggcuucugacuacuacgauuuuggaaaaccgcagcccugugaggacccuagaggcguggucggcacauucgauaugugggggcugggaacccucgugacaguguccagc

SEQ ID NO: 40178 - RNA, 432 nt, Artificial Sequence
  derived and/or modified sequence opt5 from anti-HIV_cap256-119-014777_VR-Chain
caggugcaccuggucgagagcggcgggggaguugugcaacccggcagaucccuccggcugucuugcgccgcuagccauuucucccuuucuagcuacgggaugcacugggugcgccaggccccuggaaagggccuggaaugggucgcggggaucuccuuugcugccaccaaaacauauuacggaggcucugugaagggcagauucacgguuagccgggacauuuccaaaaacacccucuaucugcagaugaauagccuucgcccggaggauacagccauguacuauugugcuagagaccagcgguacuaugaaugcgaggaaugggccucugauuacuacgacuuugggcgcgagcaacccugucaggauccuagaggaguggucggcguguucgacaugugggggcagggaaccaugguuacaguguccagc

SEQ ID NO: 40179 - RNA, 432 nt, Artificial Sequence
  derived and/or modified sequence opt5 from anti-HIV_cap256-119-014313_VR-Chain
caggugcaacuggucgagagcggcgggggaguugugcagcccggcagaucccuccggaucucuugcgccgcuagccaguucaccuuuucccgcuacgggaugcacugggugagacaggccccuggaaagggccuggaaugggucgcgucuauuagcuaugacgggcgggauuaccaucacgcuggagccguguggggccgcuucaucauuuccagagacaacucuaaaaauagccuucaucugcaaaugaacucccuccggccggaggauacagcccuguauuuuugugcucgcgaccuuagagaaagcgagugcgaagagugggagucugauuacuauaauuucuggaagaaacugcccuguguuaagccucggggcguggucgggauccucgacauuuggggacagggcacggugguuaccguguccagc

SEQ ID NO: 40180 - RNA, 438 nt, Artificial Sequence
  derived and/or modified sequence opt5 from anti-HIV_cap256-119-014219_VR-Chain
cagaugcaacugguggagagcggcgggggagucguucagcccggcuccucucucacccugagcugcgccgcuucccaguucacauuuucuaacuacgggaugcacugggugagacaggccccuggaaagggccuugaauggguggcgagcaucuccaaugacgggacgaaaaaguaucauggagauucugucugggaccgguucaccauuagccgcgauaacuccaaaaauacacuguuucuccaaaugaacagccugagagcugaggacaccgcccuuuacuucugugugaaggaucagcgggaagacgagugcgaagagugguggucugauuauuacgacuuuggccgcgagcugccguguagaaaauuccggggccucgggcuggccggaacauuugauaucuggggccacgggaccaugcugauuguuuccagc

SEQ ID NO: 40181 - RNA, 432 nt, Artificial Sequence
  derived and/or modified sequence opt5 from anti-HIV_cap256-119-013631_VR-Chain
caggugcaacuggucgagagcggcgggggaguugugcagcccggcagaucccuccggcugucuugcgccgcuagccaguucaccuuuggguccuacggaaugcacugggugcgccagaucccuggcaaggggcuugaaugggucgccacaauuucuuaugacggaacgaaaaaguaccaugcggauagcgugugggacagauucaucauuucccgggauaacucuaaaaauacccuguuucuccaaaugaacagccugcgcccggaggacacagcucuuuauuucuguguuaaggaucagagacaggacgaaugcgaggaauggugguccgauuacuaugacuuuggccggcgccugcccuguagaaaaagccggggccucgccgggaucuucgauguguggggacacggcaccauggucacagugucuucc

SEQ ID NO: 40182 - RNA, 432 nt, Artificial Sequence
  derived and/or modified sequence opt5 from anti-HIV_cap256-119-012924_VR-Chain
caggugacccuggucgagagcggcgggggauucguucaacccggcgggucccucagacugucuugcgccacaagcggauuuacguucuccucuuacgcuaugcacugggugcggcaggccccuggcaaggggcuugaauggguggcggcuaucagcuuugacggagccgauaaauaucaugccgacaacgucuggggccgccuguccauuucuagagauaauagcaaguccacccucuaccugcagaugaacagccuucggccggaggacacagcuguguauuucugugccaaagaucugcgcgaagacgagugcgaagagagauggucugauuacuaugacuuuggcaagcagcuccccugucggaaaucccgcgggguugcuggaaucuucgauaauuggggccaagggaccauggugacagucagcgcc

SEQ ID NO: 40183 - RNA, 432 nt, Artificial Sequence
  derived and/or modified sequence opt5 from anti-HIV_cap256-119-011793_VR-Chain
caggugcaacuggucgagagcggcgggggaguugugcagcccggcgggucccuccggcugucuugcguggccagccaguucaccuuuucccgguacggaaugcacuggguccgccaggcuccuggcaaggggcuugaauggguggccucuaucagcuaugacggaagagauaaauaccaugcggacuucguuuggggccggcugacaauuucccgcgaugacucuaagaaaacgcucuaucugcaaauggauagccuuagaguggacgauaccgcucuguacuauuguguccgggacaugcgcgaguccgaaugcgagcucugggaaagcgauuacuaugacuuuggcaagagacugccgugugugaaacccagagggguugccggaaucuucgauauuuggggccaggggacaauggugaccgucucuucc

SEQ ID NO: 40184 - RNA, 432 nt, Artificial Sequence
  derived and/or modified sequence opt5 from anti-HIV_cap256-119-011413_VR-Chain
caggugcaacuggucgagagcggcggggacguugugcagcccggaagaucccuccggcugucuugcgccgcuagcggcuucaccuuuuccacauacgggaugcacugggugcgccaggccccuggaaagggccuugaaugggucgcggcuaucucuuucgccgggacgaaaaagaacuaugccgauagcgugagaggacgguuuaccauuucccgcgacucuagcaaaaauacacuguaccucgagaugaacucccugagaccggaagauaccgcucuuuauuacugugccaaggacaugcggggcuaugagugcgaagaguggacaagcgauuacuaugacuucggccgcccccagccuuguaucgauucuagagggguugugggaaccuuugacgucuggggccaagggacaauggugaccguuuccagc

SEQ ID NO: 40185 - RNA, 432 nt, Artificial Sequence
  derived and/or modified sequence opt5 from anti-HIV_cap256-119-011323_VR-Chain
caggugaagcuggucgagagcggcgggggaguugugcccccuggcaaaucccucagacugucuugcaccgccagccaauucacauuuuccaauuucgggaugcacugggugcggcaggcuccgggaaagggccuugaaugggucgccucuaucagcuuuguggggauuaaaacgcauuacgcuaauuccguucgcggaagauucaccaucucucgggaccagagcaagaacacacuguaucuccagaugaacuccgugcgcgucgaggauaccggcagauacuauugugcgcgggacaugcgcgaauacgagugcgaacugugggccagcgauuauuacgacuuuggcaaaccccaaccuugugaggaucccagaggggugguuggaacauucgacauguggggccuugggacccuggugacagucucuucc

SEQ ID NO: 40186 - RNA, 432 nt, Artificial Sequence
  derived and/or modified sequence opt5 from anti-HIV_cap256-119-011233_VR-Chain
caggugcaccuggucgagagcggcgggggaguugugcaacccggcagauccgugcggcucucuugcgccgcuagccauuucucccugucuagcuacgggaugcacuggguccgccaggccccuggaaagggccuugaaugggugaccgggaucuccuuugcgggaacaaaaacguauuacggcgacucuguuagaggccgguucaccgugagccgcgauauuuccaagaacacacuguuucuccagaugaauagccugagaccggacgauaccgcuauguauuacugugcccgggaccagcgcuauuacgagugcgaagagugggccucugauuauuacgacuucgggagagaacaacccugucuugauccucggggagucgugggcaucuuugaccugugggggcagggaacaaugguuaccguguccagc

SEQ ID NO: 40187 - RNA, 432 nt, Artificial Sequence
  derived and/or modified sequence opt5 from anti-HIV_cap256-119-009038_VR-Chain
caggagcaacugguggaaagcggcgggggagucguucagcccggcagaucccuccggcugucuugcguggccagccgcuucaccuuuuccgcuuucgggaugcacugggugagacaggccccuggaaagggccuugagugggucgcgucuaucagcuuugcugggauuaaaaaguacuauggagacuccgugaaaggccgguucacaaucucucgcgauaacagcaagaauacgcuguaccuccagauggacggccugagaggggaagauaccgcccuuuauuacugugccaaagaccugcgggagcucgaaugcgaggagugggcuuccgauuauuacgacuuuggacgcccgcaacccugucuggauccuagaggcguuagcgggauuucuaacguguggggacagggcacaauggucaccguguccagc

SEQ ID NO: 40188 - RNA, 432 nt, Artificial Sequence
  derived and/or modified sequence opt5 from anti-HIV_cap256-119-008756_VR-Chain
caggugcaacuggucgagagcggcgggggaguugugcagcccggcaagucccuccggcugucuugcguggucagccaguucaccuuugggcgguacggaaugcacugggugcgccaggccccuggcaaagggcuugaauggguugcuuccaucucuuaugacggaagcgauaaguaccauacauccucucuguggggcagauucauugugagccgggacaacuccaaaaauacgcucuaucugcaaaugaacagccuucgcccggaggauaccgcccuguacuauugugucagagaccggcgcgaaucugagugcgaagagagaugguccgauuacuaugacuuuggcaagcagcuccccugugugaaaccuagagggguugcgggaaucuucgauauuuggggccaggggacaauggugaccgucagcucu

SEQ ID NO: 40189 - RNA, 438 nt, Artificial Sequence
  derived and/or modified sequence opt5 from anti-HIV_cap256-119-008055_VR-Chain
cagaugcaacugguggagagcggcgggggagucguucagcccggcagaucccucacccugucuugcgccgcuagccaguucuccuuugccaacuacgggaugcacugggugcggcaggcgccuggaaagggccuugaauggguggcuucuaucagcaaugacgggacgaaaaaguaucaugaggaauccgucuggggacgcuucacaauuucuaaagauaacagcaagaauacccuguuucuccaaaugaacucccugagaaucgaggacacagcccuuuacuucugugugaaagaucagcgggaagacgagugcgaggaaugguggagcgauuauuacgacuuuggccgcgagcugccguguagaaagucucggggccucgggcuggccggaauuuucgauauguggggccacgggaccaugguuacaguguccagc

SEQ ID NO: 40190 - RNA, 435 nt, Artificial Sequence
  derived and/or modified sequence opt5 from anti-HIV_cap256-119-006949_VR-Chain
caggugcaccuggucgagagcggcgggggaguugugcaacccggccggucccuccggcugucuugcgccgcuagcggguucuccgugucuaacaauuacaugaacuggguccgccaggccccuggagaaggccuugaguggguggcgcugaucagcuuugacgggagacagaaggaucucgcugacuccguuaaaggacgguucgccauuucucgcgauaauagcaagaacacccuguaucuucagaugaacucccugagacucgaagacacagcccuguacuauugugcucgggaucugcgcgagcucgacugcgaagaguggacgcuguacaauuauuacgauuuuggcagcagaggcccguguguggaccccagaggggucggaggcucuuucgaugugugggggcaaggaaccaugguuacaguguccagc

SEQ ID NO: 40191 - RNA, 432 nt, Artificial Sequence
  derived and/or modified sequence opt5 from anti-HIV_cap256-119-006685_VR-Chain
caggugcaacuggucgagagcggcgggggaguugugcagcccggcagaucccuccgggugucuugcgccgcuagccacuucaccuuuucccgcuacgggaugcauugggucagacaggccccuggaaagggccuggaauggguggcgucuaucagcuaugacgggcgggauuucuaccacgcucgcuccguuuggggaagauuuacaauuucucgggacaacagcaaaaauacgcuucaucugcagaugaacucccuccgcccggaggauaccgcccuguauuucugugccagagaccuucgggaaagcgagugcgaagagugggagucuuacuauuacgauuuuggcaagaaaggccccugugugaagccucgcggggucgugggaguucuggacaucuggggccaagggacacucgugaccgucuccagc

SEQ ID NO: 40192 - RNA, 432 nt, Artificial Sequence
  derived and/or modified sequence opt5 from anti-HIV_cap256-119-006015_VR-Chain
caggugcaacuggucgagagcggcgggggaguugugcagcccggcaagucccucagacugucuugcgccgcuagccgguucaccuuuaaucgcuacgggaugcacugggugagacaggccccuggaaaaggccuugaaugggucgcggcuaucuccuucgacgggacagauaaguaucauucugacgauguguggggacgguuuacgauuagccgcgacaauuccaaaaacacccuguaccuccagaugaacucucugagaccggaggauacagcccuuuauuacugugccaaggaccugcaagaagaugagugcgaagagugguggagcgacuauuacgauuucggcaaacagcuccccugucggaagucccgcggcguugcugggaucuuugacgauuggggacagggcaccauggugacagucagcucu

SEQ ID NO: 40193 - RNA, 432 nt, Artificial Sequence
  derived and/or modified sequence opt5 from anti-HIV_cap256-119-005841_VR-Chain
caggugcaacuggucgagagcggcgggggaguugugcagcccggcagaucccuccggcugucuugcgccgcuagccaguucuccuuugggaacuucggaaugcacugggugcgccaggccccuggcaaggggcuugaaugggucgcggcuaucucuuuugccggaaccaaagagaauuacgccaacagcgugagaggccgguucacaauuucccgcgacaauucuaagaacacgcuguaucuccaaaugaauagccugagagcugaagauaccgcccuuuacuauuguacaaaagacaugcgggaguacgaaugcgaggaguggaccuccgauuauuacgacuuuggccgcccgcagcccuguaucgauagcagagggguugugggaacauucgacgucuggggccaggggaccauggugacaguuucuucc

SEQ ID NO: 40194 - RNA, 432 nt, Artificial Sequence
  derived and/or modified sequence opt5 from anti-HIV_cap256-119-005824_VR-Chain
caggugcaacuggucgagagcggcgggggaguugugcagcccggcgggucccucagacugucuugcgccgcuagcggauucaccuuucggcgcuacgccaugcacugggugagacaggcgccuggcaaggggcuugaaugggucgcuuccaucucuuaugacggaagcgauaaauaccauacauccucucuguggggccgguucauugugagccgcgacaacuccaagaauacgcucuaucugcagaugaacagccuuagaccggaggauaccgcccuguacuauuguguucgggaccgcagagaaucugagugcgaggaacggugguccgauuacuaugacuuuggcaaacaacuccccugugugaagccucgcggggucgccggaaucuucgauauuuggggccaggggacaauggugaccguuagcucu

SEQ ID NO: 40195 - RNA, 432 nt, Artificial Sequence
  derived and/or modified sequence opt5 from anti-HIV_cap256-119-005494_VR-Chain
caggugagacuggucgagagcggcgggggaguugugcaacccggccggucccuccgcaucucuugcgccgcuagccaguucauguuuaacaaguacgggaugcacugggugagacaggccccuggaaaaggccuggaaugggucgcguccauuucuuaugacgggagcgauaaguaccaugcugaccuuguguggggacgguucaccaucucccgcgauaauucuaaaaacacacuguaucuccagaugaauagccugagagccgaggacacggcccuuuacuauuguguucgggaugcucgcgaauccgagugcgaacugugggagagcgacuacuauaacuuuggcagaaagcucccgugugugaaaccccggggcgucgccgggacccuggauauuuggggacaaggcacaauggugaccguuucuucc

SEQ ID NO: 40196 - RNA, 432 nt, Artificial Sequence
  derived and/or modified sequence opt5 from anti-HIV_cap256-119-004949_VR-Chain
caggugcaacuggucgagagcggcgggggaguugugcagcccggcagaucccuccggcugucuugcgccgcuagcaaguucucccuuucuagcuacgggaugcacugggugcgccaggccccuggaagaggccuggaaugggucgcggggaucuccuuugcugccaccaaaaaguauuaccggccgucugugcgcggaagauucacaguuagcacggacauuuccaaaaacacccucuaucuggagaugaauagccuucggcccgaagauacagcccuguacuuuugugcucgcgaccagagauauuacgagugcgaagagugggccucugauuauuacgacuucggccgggagcaaccuugucucgauccccgcggcguggucgggaucuuugaccuguggggacagggcaccauggugacaguuuccagc

SEQ ID NO: 40197 - RNA, 432 nt, Artificial Sequence
  derived and/or modified sequence opt5 from anti-HIV_cap256-119-004422_VR-Chain
cacgugcagcuggucgagagcggcgggggaguugugcaacccggcagaucccuccggcugucuugcgccgcuagcgggcuuuccuucucuagcuacgccaugcauugggugcgccaggcgccuggaaagggccuggaaugggucgcugugguuuccuaugacgggaccacaaaauuuuacgccgauucugugaagggaagauucacgaucagccgggacaacuccaaaaauacccucuaucugcagaugaacagccuucgcggcgaggauacagcccuguacuauugugcuaaggaccucagagaauacgagugcgaagaguggaccucugauuauuacgacuuuggccggccgcagcccuguauugauucccgcggggucgugggaauccuggacauuuggagccaaggcacaaugguuaccgugucuucc

SEQ ID NO: 40198 - RNA, 432 nt, Artificial Sequence
  derived and/or modified sequence opt5 from anti-HIV_cap256-119-003932_VR-Chain
caggugcaacugcucgagagcggcgggggagucguucagcccggcgggucccugagacuuucuugcaaggccagccacuucuccuuugaccgguacggaaugcauugggugcgccaggcuccuggcaaagggcuggaauggguggccgcgaucucuuucgauggagcugacaaguaucacgccgauaacgucuggggcagacucagcauuucccgggacaauucuaaaagcacccuguaccuucagaugaacucccugcgcccggaggauacagccguguauuuuugugcuaaggaccucagagaagaugagugcgaggaacgguggagcgacuacuaugauuucggcaaacaacugcccugucgcaagucuagagggguugccggaaucuuugacaauuggggccaggggacgauggugaccgucuccgcu

SEQ ID NO: 40199 - RNA, 438 nt, Artificial Sequence
  derived and/or modified sequence opt5 from anti-HIV_cap256-119-003577_VR-Chain
caggugcaacuggucgagagcggcgggggaggcguucagcccgggagaucccuccggcugucuugcgccgcuagcggauucaccuuucgcuccuacgccaugcacugggugagacaggcgccuggcaaggggcuugaauggguggcugucaucucuaaugacggaacgaaaaaguaucaugccgagagcgugugggaucgguucuccauuucuaaagacaauagcaagaacacacuguuucuccagaugaacucccugcgcguugaagauaccgcccuuuacuucugugugaaagaccaaagagaggaugaaugcgaggagugguggagcgacuauuacgauuuuggccgggaacugccgugucgcaagucuagaggccucgggcuggcuggaaucuucgacauguggggccacgggacaauggucaccguguccagc

SEQ ID NO: 40200 - RNA, 432 nt, Artificial Sequence
  derived and/or modified sequence opt5 from anti-HIV_cap256-119-002155_VR-Chain
cugggcagacucguggccagcgggggaggcgucguucccccugggcggucccugcgccuuucuugcguggcuagccaguucaccuuuuccggauguggccugcacugggugagacaagucccggggaagggacucgaguggguggccucuaucagcuucgcgggcacaaaaacgcauuacggcaacuccguuaaggggcgguuuucuauuagccgcgacaauuccaucaacaccguguaucugcagaugaauagccuuagagcugaagauacagcccuguacuauugcgccaaagaccuccgggaguacgaaugugaggaauggaccucugauuauuacgacuucggacgcccccagccuugcauugauuccagaggcgucguggggauccuggacauuuggagccagggaacaaugguuaccgugucuucc

SEQ ID NO: 40201 - RNA, 432 nt, Artificial Sequence
  derived and/or modified sequence opt5 from anti-HIV_cap256-119-002017_VR-Chain
caggugcaacuggucgagagcggcgggggaguugugcagcccggccggucccuccggcugucuugcgccgcuagcggguucaccuuuuccuacuauggaauccacugggugcgccaggccccuggcaaggggcuugaaugggucgcgucuauuagcuacgacgagagagauuucuaucaugcucgguccguguggggacgcuuugccaucucuagagacaacagcaaaaauacacugcaccuccagaugaacucccugcggccggaagauacggcccuuuacuucugugcucgcgaccugagagagagcgaaugcgaggagugggaaucuuauuacuaugauuuuggcaagaaaggccccuguguuaagccuagagggguggucggagugcucgacauuuggggccaagggacccugguuacaguguccagc

SEQ ID NO: 40202 - RNA, 432 nt, Artificial Sequence
  derived and/or modified sequence opt5 from anti-HIV_cap256-119-001312_VR-Chain
caggugcaacugauggagagcggcgggggagucguucagcccggcagaucccuccggcuggccugcgcugccucuggguucaccuuuagcuccuacgcgauccacugggugcgccaggcuccuggaaagggccuugaauggguggccgccauuucuuucgcugggacgaaaaagaacuaugccgacagcgucagaggacgguuuacaaucucccgcgauucuagcaaaaauacccuguaccucgagaugaacucccugagaccggaagacacagcucuuuauuacugugccaaggauaugcggggcuaugagugcgaagaguggaccagcgacuacuaugauuucggccgcccccagccuuguauugacucuagaggggugguuggaacauuugauguguggggccaagggaccauggucacaguguccagc

SEQ ID NO: 40203 - RNA, 438 nt, Artificial Sequence
  derived and/or modified sequence opt5 from anti-HIV_cap256-119-001017_VR-Chain
cagaugcaacugguggagagcggcgggggagucguucagcccggcagaucccucacccugucuugcgccgcuagccaguucuccuuuacaaacuacgggaugcacugggugcggcaggccccuggaaagggccuugaauggguggcgucuaucagcaaugacgggaacaaaaaguaucauggagaguccgucugggaucgcuucacgauuucuagagacaauagcaaaaacacccuguuucuccaaaugaaucggcugcgcguggaagauacagcucuuuacuucuguguuaaggaccagagagaggaugaaugcgaggaguggugguccgacuauuacgauuuuggccgggaacugccgugucgcaaauucagaggccucgggcuggccggaaucuuugacguguggggccacgggaccauggucacagugagcucu

SEQ ID NO: 40204 - RNA, 432 nt, Artificial Sequence
  derived and/or modified sequence opt5 from anti-HIV_cap256-119-000594_VR-Chain
caggugcaacuggucgagagcggcgggggacucguucagcccggcaccucccugagacuuucuugcgccgcuagcgccuucacauuuaagaacuacgggaugcacugggugcggcaggcgccuggaaaaggccuggacuggguggcuuccaucucuuaugaugggcgcgacaaguaccauagcucccucgucuggggaagacugacgauuucucgggauaauagcaaauccacccuuuuccugcagaugaacagccuccgcgccgaagacacagcccuguauuacugugcuagagaucugcgggagucugaaugcgaggaauggcaauccgacuauuacgccuuuuauaagaaacucccgugugugaagccccgcggcguugcuggcacccuggauaucugggggcagggaacaauggugaccgucagcucu

SEQ ID NO: 40205 - RNA, 432 nt, Artificial Sequence
  derived and/or modified sequence opt5 from anti-HIV_cap256-059-241099_VR-Chain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuauguugauucugugcagggcagauucacaauuagccgggacaauuccaagaacacgauguuucugcaaaugaauagccuccgcaccgaggauacagcugucuacuauugugccagagaccugggcgaaucugagguggaagagugggccaccgauuacuaugacuucuccaucgcuuacccgguugaggggccccggggaguggucggcauuuuugauaucugggggcagggaacaauggugaccgugagcucu

SEQ ID NO: 40206 - RNA, 432 nt, Artificial Sequence
  derived and/or modified sequence opt5 from anti-HIV_cap256-059-207529_VR-Chain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcgggaaucagcuucgcuggcauuaacaaauauuacggcaauuccgugaaggggagauuuacaaucucucgggacaacagccgcaauacgcuguaucuccagaugaacucccugagagccgaggauaccgcccuuuacuauugugcucgggaccugcgcgaaauggagugcgaagagugggccagcgauuacuaugacuucggaagaggcgggccgugucaagauccccggggaguugugggcacauuugacauuugggggcagggaaccauggucacagugucuucc

SEQ ID NO: 40207 - RNA, 435 nt, Artificial Sequence
  derived and/or modified sequence opt5 from anti-HIV_cap256-059-205541_VR-Chain
cagaugcaacugguggagagcggcgggggagucguucagcccggcgggucccucagacugucuugcgccgcuagcggauucuccuuuucuuacuaugccauggacugggugcggcaggcgccuggcaaggggcuugaauggguggcuuucaucagcuccgauggaucugacaaaaacuacgccgauagcgucaagggccgcuuuaccauuuccagagacaauagcaaaaacacacuguaucuccagaugaacucucugcgggccgaggauacggcuguguacuauugugccaaggacguuggcgggcacaaaaaugaugaaugggcuaccaauuacuauuacgacaucuccauugccuacccgauccaagauccccgcgcgguggccggagcuuucgacgucuggggccaggggacaauggugaccguuagcucu

SEQ ID NO: 40208 - RNA, 432 nt, Artificial Sequence
  derived and/or modified sequence opt5 from anti-HIV_cap256-059-188439_VR-Chain
caggugcaacuggucgagagcggcgggggaguugugcagcccggcagaucccuccggcugucuugcgccgcuagccaguucaccuuuuccaacuacgggaugcacugggugcgccaggccccuggaaagggccuugaaugggucgcggcuaucucuuucgccgggauuaauaaauauuacacagacagcgugaagggaagauuuacgaucucccgggauaacucuaaaaauacccuguaucuccaaaugaacagccugcgcgccgaggacacagcucuuuacuauugugccaaggaucugagaggcuucgaaugcgaggaaugggcuuccgacuacuaugauuuuggccgggaccucccgugucaggauccccgcgggguugugggaaccuucgacgucuggggccaggggacaaaagugaccguuagcucu

SEQ ID NO: 40209 - RNA, 432 nt, Artificial Sequence
  derived and/or modified sequence opt5 from anti-HIV_cap256-059-187234_VR-Chain
caggugcaacuggucgagagcggcgggggaguugugcaggccggcagaucccuccggcugucuugcgcugccagccaguucaccuuuggguccuacggaaugcacugggugcgccaggcgcccggcaaggggcuugaaugggucgcugccaucucuuucgccggaacaaaaauucauuaugcugacagcgugaagggcagauuuacgaucucccgggauaacucuaaaaaugcccuguaccuccaaaugcacagccugcgcgcugaggacaccgcccuuuauuacugugcgaaggaucugagagaauaugagugcgaagagugggccuccgacuacuaugauuucggccgggaccagccuugucaggauccgcgcgggguugugggaauuuuugacaucuggggccaggggacaauggucaccgugagcucu

SEQ ID NO: 40210 - RNA, 432 nt, Artificial Sequence
  derived and/or modified sequence opt5 from anti-HIV_cap256-059-187047_VR-Chain
caggugcaacuggucgagagcggcgggggaguugugcagcccggcagaucccuccggcugucuugcgccgugagccagcuuaccuucuccucuuacgggaugcacuggguccgccaggcuccuggaaagggccuggaauggguggccgcgaucagcuuuguugggauuaaaaaguauuacgcugacuccgugaaaggaagauucacaaucucucgggauaacagcaagaauacgcucuaucugcaaaugaacucccuucgcgucgaggacaccgcccuguacuauugugccaaagaucucagagaauacgagugcgaagagugggcuagcgacuauuacgauuuuggccgggaccagccgugucaggaugcccgcggcgugguugggacaucugacauuuggggacagggcaccauggugacagucuccagc

SEQ ID NO: 40211 - RNA, 432 nt, Artificial Sequence
  derived and/or modified sequence opt5 from anti-HIV_cap256-059-186068_VR-Chain
caggugcaacuggucgagagcggcgggggaguugugcagcccggcagaucccuccggcugucuugcgccgcuagccaguucuccuuuucuaacuacgggaugcacugggugcgccaggccccuggaaagggccuugaaugggucgcggggaucagcuucgcugccaccaaaaaguauuacgccgacuccgugaaaggaagauuuucuguuagccgggauaauuccaagaacgcucuguaucuccaaaugaauagccugcgcgccgaggacacagcucuuuacuauugugccagagaucugcgggacuacgaaugcgaggaaugggcgucugauuauuacgacuucggccgcgaguacccgugucaggaucccagaggcguggucgggacguuugacauuuggggacagggcaccauggugacaguuuccacc

SEQ ID NO: 40212 - RNA, 435 nt, Artificial Sequence
  derived and/or modified sequence opt5 from anti-HIV_cap256-059-182835_VR-Chain
caggugcaacuggucgagagcggcgggggacucguucagcccggcagaucccugcggcuuucuugcgccgcuagcggguucuccuuuaacaauuucgccauggacugggugcgccaggcgccuggaaagggccuggaauggguggcuuuugucucuagcgauggguccaacaaaaauuacgccgacucugugaagggaagauucaucauuagccgggauaacuccaaaaauaccguuuaucuccagaugaacagccugcgcguggaggacacagccgucuacuauugugcuaaggaucuuggcgccaauaaagacgaugaaugggcuacggacuacuauuacgaucugucuguggccagaccgguucccgacccucgggcgguggucggcgccuuugaugugugggggcaaggaaccauggugacagucuccagc

SEQ ID NO: 40213 - RNA, 432 nt, Artificial Sequence
  derived and/or modified sequence opt5 from anti-HIV_cap256-059-176659_VR-Chain
agagugcagcuggucgagagcggcgggggaguugugcaacccggccggucccuccgccugucuugcgccgcuagccaguucuccuuuucuaauuacgggaugcacugggugagacaggccccuggaaagggccuugaaugggucgcggggaucagcuucgcugccauuaaaaaguauuacgccgacuccgugaaaggacgguuuaccaucucucgcgauaauagcaagaacgcucuguaucuccagaugaacucccugagagccgaggacacagcucuuuacuauugugcccgggaucugcgcgaauacgagugcgaagagugggcgagcgacuauuacgauuucggcagagagcucccgugucaagacccccggggcguuguggggacguuugauaccuggggacagggcacaauggucaccgugucuaca

SEQ ID NO: 40214 - RNA, 432 nt, Artificial Sequence
  derived and/or modified sequence opt5 from anti-HIV_cap256-059-172956_VR-Chain
caggugcaacuggucgagagcggcgggggaguugugcagcccggcagaucccuccggcugucuugcgccgcuagccaguucuccuuuucuagcuacgggaugcacugggugcgccaggccccuggaaagggccuugaaugggucgcggcuauguccuucgccgggaccaaccaauauuacgccgcuucugugaaaggaagauuuacaaucagccgggacaauuccaagaacacgcuguaucuccauaugaauagccugcgcccggaggauaccgcccuuuacuauugugcuagagaccugcgggaauacgagugcgaagagugggccgcggauuauuacgacuucggccgcgaguaccccugucaggauccuagaggcguuguggggauuuuugacgucuggggacagggcacacucgugaccguuucuucc

SEQ ID NO: 40215 - RNA, 432 nt, Artificial Sequence
  derived and/or modified sequence opt5 from anti-HIV_cap256-059-171272_VR-Chain
caggugcugcucgucgagagcggcgggggaguugugcaacccggcagaucccugcggcuuucuugcgccgcuagccaguucaccuuuuccaacuacgggaugcacugggugcgccaggccccuggaaagggccuggaaugggucgcggcuaucucuuucgccgggaugaaaaaguauuacgccgacagcgugaaaggaagauuuacaauuucccgggauaauucuaagaacacgcucuaucugcagaugaauagccuucgcgcugaggacaccgcccuguacuauugugcuaaagaucucagagaguucgaaugcgaagagugggccuccgacuacuaugauuuuggccgggcgcaaccgugucaggacccccgcggcguuguggggacauucgaucuguggggacagggcaccauggucacagugagcucu

SEQ ID NO: 40216 - RNA, 432 nt, Artificial Sequence
  derived and/or modified sequence opt5 from anti-HIV_cap256-059-168734_VR-Chain
caggugcaacuggucgagagcggcgggggaguugugcagcccggcagaucccuccggcugucuugcaccgccagccaguucuccuuuucuagcuacgggaugcacugggugcgccaggcuccuggaaagggccuugaaugggucgccgcgaucuccuucgcugggacgaaaaaguauuacgugggaacaguuaaaggcagauuuaccauuucucgggacaacagcaagaauacacuguaucuccaaaugaacucccugcgcgccgaggauaccgcccuuuacuauugugcuaaagacaugagagaauacgagugcgaagagugggccagcgauuauuacgacuucggccgggaguacccgugucaggauccccgcgggguggucggaacauuugacaucuggggccaggggaccauggugacaguuucuucc

SEQ ID NO: 40217 - RNA, 432 nt, Artificial Sequence
  derived and/or modified sequence opt5 from anti-HIV_cap256-059-155838_VR-Chain
caggugcaacuggucgagagcggcgggggaguugugcagcccggcagaucccuccggcugucuugcgccgugagccaguucaccuuuuccaauuacgggaugcacuggguccgccaggcuccuggaaagggccuugaauggguggccgcgaucucuuucgcugggacgaaaaagagcuaugccgccuccguuaaaggaagauuuacaauuucucgggacaauagcaagaacacccuguaccuccaaaugaacucccugcgcccggaggauacagcucuuuauuacugugccaaagacaugagaggcuucgaaugcgaggaaugggcuagcgauuauuacgacuuuggccgggagcagcccugucaggauccucgcgggguggucggaaucuucgaccuguggggccaggggaccauggugucuguuuccagc

SEQ ID NO: 40218 - RNA, 432 nt, Artificial Sequence
  derived and/or modified sequence opt5 from anti-HIV_cap256-059-149799_VR-Chain
caggugcaccuggucgagagcggcgggggaguugugcaacccggcagaucccuccggcugucuugcgccgcuagccaguucaccuuuuccaacuacggguuccauugggugcgccaggccccuggaaagggccuugaaugggucgcggcuaucucuuuugccggggugaaaaagcacuaugccgacagcguuaaaggaagauucacaauuucccgggauaauucuaagaacacgcuguaccuccagcugaauagccuucgcgcugaggacaccgcccuguauuacugugcuaaagaucucagagaauaugagugcgaagagugggccuccgacuacuaugauuuuggccgggacuucccgugucaagauccccgcggcguggucgggacauuugacaucuggggacagggcaccauggugacaguuagcucu

SEQ ID NO: 40219 - RNA, 432 nt, Artificial Sequence
  derived and/or modified sequence opt5 from anti-HIV_cap256-059-148168_VR-Chain
caggugcaacuggucgagagcggcgggggaguugugcagcccggcagaucccuccggcugucuugcaccgccagccaguucacauuuuccaauuacgggaugcacugggugcgccaggcuccuggaaagggccuugaaugggucgccgggaucucuuucgcggcuacgaaaaaguauuacagcgacuccgugaaaggaagauuuaccauuucucgggauaauagcaagaacgcccuguaucuccaaaugaacucccugcgcgccgaggacacagcucuuuaccauugugccaaagaucugagagaauaugagugcgaagagugggcuagcgacuacuaugauuucggccgggagcagccgugucaggacccccgcggcguuguggggaccuuugauaucuggggacagggcacaauggucaccgugucuaca

SEQ ID NO: 40220 - RNA, 435 nt, Artificial Sequence
  derived and/or modified sequence opt5 from anti-HIV_cap256-059-144685_VR-Chain
caggugcaccuggucgagagcggcgggggaguugugcaacccggcagaucccuccggcugucuugcgccgcuagcggguucaccuuuuccaacuucgccauggacugggugcgccaggcgccuggaaagggccuugaaugggucgcuuuugugucuagcgaugggaauaacaaaaauuacggagacuccguuaagggcagauucacaaucucucgggauaacagcaaaaauacgcuguuucuccagaugaacucccugcgcgccgaggacaccgcccuuuauuacugugugaaggaugucggcgacuauaaaagcgaugaaugggcuacacauuacuauuacgaccugucuauugccgauccgauccaggaccccagagcugugguuggggccuucgauauuuggggacggggcaccaugguggcggucuccagc

SEQ ID NO: 40221 - RNA, 432 nt, Artificial Sequence
  derived and/or modified sequence opt5 from anti-HIV_cap256-059-140017_VR-Chain
caggugcaacuggucgagagcggcgggggaguugugcagcccggcagaucccuccggcugucuugcgccgcuagccaguucuccuuugggaacuucggaaugcacugggugcgccaggccccuggcaaggggcuugaaugggucgcgggaaucucuuuugcuggcaccaaaaaguacuaugccgacagcgugaaaggcagauucacaauuucccgggauaauucuaagagcgcccuguuucuccaaaugaacucccugcgcgcugaggacacggcccuuuacuauugugcuaaagaucugagauacuaugaaugcgaggaaugggccagcgacuacuaugauuucgggcgggaccagccgugucaggauccccgcggaguugugggcaccuuugacaugugggggcagggaacaauggucaccgugucuucc

SEQ ID NO: 40222 - RNA, 432 nt, Artificial Sequence
  derived and/or modified sequence opt5 from anti-HIV_cap256-059-137547_VR-Chain
caggugcaacuggucgagagcggcgggggaguugugcagcccggcagaucccuccggcugucuugcgccgcuagccaguucaccuuuucccgcuacgggaugcacugggugagacaggccccuggaaagggccuugaaugggucgcggcuaucucuuucgccgggauuaaaaagaacuaugccgacagcgugaaaggacgguuuacaaucucccgcgauaauucuaagaacacgcuguaccuccaaaugaauagccugagagcugaggacaccgcccuuuauuacugugcucgggaucugcgcgaguucgaaugcgaagagugggccuccgacuauuacgauuuuggcagagacuucccgugucaggauccccggggcguuguggggauuuuugacaucuggggacagggcacaauggucaccgugagcucu

SEQ ID NO: 40223 - RNA, 435 nt, Artificial Sequence
  derived and/or modified sequence opt5 from anti-HIV_cap256-059-131908_VR-Chain
caggugcaacuggucgagagcggcgggggaguugugcagcccggcagaucccuccggcugucuugcaccgccagcggguucacauuuuccaacuacggaauccacugggugcgccaggcuccuggcaaggggcuugaaugggucgccgcgauuucuuaugagggaagcaucaaauacuauguggacuccguuaagggcagauucacgauuucucgggaugacagcaaaaauacccuguuucuccagaugaacucccugcgcacagaagauaccgcuguguacuauuguacaagagacguccgggagugggaaaccgaggagugggccacaaauuacuauuacgaucuuagcaucgccuacccgauucgccaucccagaggcgugguugggaucuucgacguguggggacugggcacccgggucacggugucuucc

SEQ ID NO: 40224 - RNA, 432 nt, Artificial Sequence
  derived and/or modified sequence opt5 from anti-HIV_cap256-059-116006_VR-Chain
caggcccaacugguggaaagcggcgggggagucguucagcccggcagaucccuccggcugucuugcgcugccagccaguucuccuuuucuagcuacgggaugcacugggugcgccaggcgccuggaaagggccuugaauggguggcuuccaucucuuucgccggggucaaaaagaccaacgccgacagcgugaaaggaagauuuacaauuucccgggauaauagcaagaacacgcugcaucuccaaaugaauggccugcgcaacgacgauaccgcucuuuauuacugugccagagaccugcgggauuucgagugcgaagagugggcuucugacuauuacgauuuuggccgcgaguucccgugucaggaccccagagggguugugggaacauuugauaucuggggccaggggaccaaagucacaguguccagc

SEQ ID NO: 40225 - RNA, 411 nt, Artificial Sequence
  derived and/or modified sequence opt5 from anti-HIV_cap256-059-115783_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuaugccgacuccgugaaagggagauucacaauuucucgggauaacagcaagaauacgcuguaccuccaaaugaacucccugcgcgccgaggacaccgcucuuuauuacugugccaaagaucugagagaaauggagugcgaagagugggcuagcgacuauuacgauuuuggacgggaccucccgugucaggauccccgcggcguugugggcacacuggacaucugggggcagggaaccauggucacagugucuucc

SEQ ID NO: 40226 - RNA, 432 nt, Artificial Sequence
  derived and/or modified sequence opt5 from anti-HIV_cap256-059-114609_VR-Chain
caggugcaacuggucgagagcggcgggggaguugugcagcccggcagaucccuccggcugucuugcgccgcuagccagcuuaccuucuccaacuuugggaugcacugggugcgccaggccccuggaaagggccuggaaugggucgcggggaucucuuucgcuggaacgaaaaaguacuaugccgacagcgugaaaggcagauuuacaauuucccgggauaauucuaagaacgcccucuaccugcaaaugaauacccuucgcgcugaggacacagcccuguauuucugugcuaaagaucucagagaauacgagugcgaagagugggccagcgacuauuacgauuuuggccgggaccagccgugucaggauccccgcgggguugugggaaucuucgacauuuggggccaggggaccauggucacaguguccagc

SEQ ID NO: 40227 - RNA, 432 nt, Artificial Sequence
  derived and/or modified sequence opt5 from anti-HIV_cap256-059-113952_VR-Chain
caggcccaacugguggagagcggcgggggagucguucagcccggcagaucccuccggcugucuugcgcugccagccacuucaccuuuuccucuuacggguuccauugggugcgccaggcgccuggaaagggccuugaauggguggcugggaucagcuuugccgccacgaaaaaguauuacgcugacuccgucaaaggaagauucacaauuucucgggauaauagcaaggacgcccuguaucuccagaugaacucccugcgcgcugaggauaccgcccuuuacuauugugcgagagaccugcggggcuacgaaugcgaggaaugggccagcgauuauuacgacuuuggccgcgaucaaccgugucaggaccccagaggggugguuggaaucuucgaucucuggggccaggggacaauggugaccgucucuucc

SEQ ID NO: 40228 - RNA, 432 nt, Artificial Sequence
  derived and/or modified sequence opt5 from anti-HIV_cap256-059-113878_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgccacgaacaaauacuauguggauagcguuaaggggagauucaccauuucccgggacaauucuaaaaacacacucuaccugcagaugagcucccuuaccgccgaggauacagcuguguauuacugugccaaggaccugggaggcaucaaaauugaugaauggggcaccgacuauuacgauaucagcgucucuuacccggugcaagacccccgcgcuguugccgggauuuuugauguguggggacauggcacaauggucuccgugagcucu

SEQ ID NO: 40229 - RNA, 432 nt, Artificial Sequence
  derived and/or modified sequence opt5 from anti-HIV_cap256-059-113622_VR-Chain
caggugcaacuggucgagagcggcgggggaguugugcagcccggcagaucccuccggcugucuugcgccgcuagccaguucaccuuuacauccuacgggaugcacugggugcgccaggccccuggaaagggccuugaaugggucgcggggaucucuuucgcuggaacgaaaaagcauuaugccgacagcgugaaaggcagauuuaccauuucccgggauaauucuaagagcacacuguaccuccaaaugaacucccugcgcgccgaggacaccgcucuuuauuacugugccaaagauaugagagaauaugagugcgaagagugggcuagcgacuacuaugauuucggccgggaccagccgugucaggauccccgcgggguugugggaaucuuugaccuguggggccaggggacaauggucaccgugucuucc

SEQ ID NO: 40230 - RNA, 432 nt, Artificial Sequence
  derived and/or modified sequence opt5 from anti-HIV_cap256-059-109427_VR-Chain
caggugcaacuggucgagagcggcgggggaguugugcagcccggcagaucccuccggcugucuugcgccgcuagccaguucaccuuuuccaauuacgggaugcacugggugcgccaggccccuggaaagggccuugaaugggucgcgucuaucagcuucgcugggauuaaaaagcauuauacagacuccgugaaaggaagauuuacgaucucucgggauaauagcaagaacacccuguuccuccaaaugaacucccugcgcgccgaggacacagcccuuuacuauugugcuagagaucugcgggaauacgagugcgaagagugggccagcgacuauuacgauuuuggccgcgaccagccgugucaggaucccagaggcguuguggggaccucugacauuuggggacagggcacaaaagucaccguguccagc

SEQ ID NO: 40231 - RNA, 432 nt, Artificial Sequence
  derived and/or modified sequence opt5 from anti-HIV_cap256-059-109081_VR-Chain
caggagcaacugguggaaagcggcgggggagucguucagcccggcagaucccuccggcugucuugcgccgcuagccaguucuccuuuucugccuacgggaugcacugggugcgccaggcgccuggaaagggccuugaguggguggcugggaucagcuucgccgccaccaaaaaguauuacgaagacuccgucaaaggaagauuuacaauuucucgggauaacagcaagaauacgcuguaucuccaaaugaacucccugcgcggcgaggacaccgcucuuuacuauugugccaaagauaugagagaaauggagugcgaggaaugggcuagcgacuacuaugauuucggccggccgcagcccugucaggacccucgcggggugguuggaaucuuugauauguggggccaggggacaauggugaccgucucuucc

SEQ ID NO: 40232 - RNA, 432 nt, Artificial Sequence
  derived and/or modified sequence opt5 from anti-HIV_cap256-059-107590_VR-Chain
caggagcaacugguggaaagcggcgggggagucguucagcccggcagaucccuccggcugucuugcgccgcuagccaguucuccaucucugccuacgggaugcacugggugcgccaggcgccuggaaagggccuugaguggguggcugggauuagcuuugccggaaccaaaaaguauuacgccgacuccgucaaaggcagauucacaaucucucgggauaacagcaagaauacgcuguaucuccaaaugaacucccugcgcggcgaagacaccgcucuuuacuauugugccaaagauaugagagagauggaaugcgaggagugggcuagcgacuacuaugauuuugggcgggaccagccgugucaggauccccgcggagugguuggcauuuucgacaugugggggcagggaacaauggugaccgucucuucc

SEQ ID NO: 40233 - RNA, 435 nt, Artificial Sequence
  derived and/or modified sequence opt5 from anti-HIV_cap256-059-107504_VR-Chain
caggugcugcucgucgagagcggcgggggaguugugcaacccggcaagucccugagacuuucuugcagcgccucccgguucaccuuuucuaacuacgggaugcacugggugcgccaggcuccuggaaaaggccuggaaugggucgccgcggugagcuucgcugggaucaagaaaacaaaugccgacuccguuaagggaagauuuacgauuucucgggauaacagcaaaaauacccucuaucugcagaugaacucccuucgcgccgaggacacagcucuguacuauugugccagagaucuccgggacuucgaaugcgaggaaugggcuagcgauuacuaugacuuuuggggcgauccgcagcccugucaagacccucgcggcguggucgggaccuucgaucuguggggacagggcacaauggugaccguuucuucc

SEQ ID NO: 40234 - RNA, 432 nt, Artificial Sequence
  derived and/or modified sequence opt5 from anti-HIV_cap256-059-099614_VR-Chain
gaggugcugcuccuggaaagcggcgggggacuuguccagcccggcagaucccugcggcucucuugcgccgcuagccaauucaccuuuuccucuuacgggaugcacuggguucgccaggccccuggaaagggccuggaguggguggcggggaucagcuucgugggaauuaaaaaguauuacgcugacuccgucaaaggcagauuuacaaucucucgggauaacagcaagaauacgcuuuaucugcagaugaacucccuccgcgccgaagacaccgcccuguacuauugugcuagagaucugcgggaguacgaaugcgaggagugggccagcgacuauuacgauuucggccgcgaccagccgugucaagaucccagaggggugguuggaacauuugacauuuggggccaggggaccauggugacagucucuucc

SEQ ID NO: 40235 - RNA, 432 nt, Artificial Sequence
  derived and/or modified sequence opt5 from anti-HIV_cap256-059-098972_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcgagcaucuccuucgcugggauuaaaaagaacuauagagacucugugaaaggacgguuuacaaucagccgcgauaauuccaagaacacgcuguaccuccaaaugaccagccugagaccggaggacacagcccuuuauuacugugccaaagaucugcggggcuucgaaugcgaggaaugggcuucugacuauuacgauuuuggccgcgagcuccccugucaggacccuagagggguugugggaaccuucgauauguggggccaggggacaauggucaccguguccagc

SEQ ID NO: 40236 - RNA, 432 nt, Artificial Sequence
  derived and/or modified sequence opt5 from anti-HIV_cap256-059-097236_VR-Chain
caggugcaacuggucgagagcggcgggggaguugugcagcccggcagaucccuccggcugucuugcgccgcuagcggguucuccuuuucuaacuucggauuucacugggugcgccaggccccuggcaaggggcuugaaugggucgcggcuaucagcuucgugggaaauaaaaaguacuaugccgaguccguuaaaggcagauuuaccauuucucgggaaaacagcaagaauaugcuguuccuccagaugaacucccugcgcggcgaggacacagccguguacuauugugcuaaagaucuuagagaauuugagugcgaggaaugggccagcgacuacuaugauuucgggcgggagcaaccgugucaggacccccgcggagucgugggcucuaucgauguuugggggcauggaucccuggugacggucagcucu

SEQ ID NO: 40237 - RNA, 432 nt, Artificial Sequence
  derived and/or modified sequence opt5 from anti-HIV_cap256-059-091487_VR-Chain
caggugcaacuggucgagagcggcgggggaguugugcagcccggccggucccuccggcugucuugcgccgcuagccaguucaccuuuaaccgcuacgggaugcacugggugagacaggccccuggaaagggccuugaaugggucgcggugaucuccuaugacgggacaaauaaauacuauggagagucuguuaagggccgguucacgauuagccgcgauaacuccaaaaauacccuguaccuccaaaugaacucucugagagcugaagacacagcccuuuauuacugugccaaggaucugcgggaggacgaaugcgaggagugguggagcgauuauuacgacuuuggccgcgaacucccguguagaaaauccagagggguggcuggaaucuucgauauuuggggccaggggaccauggucacagugagcucu

SEQ ID NO: 40238 - RNA, 432 nt, Artificial Sequence
  derived and/or modified sequence opt5 from anti-HIV_cap256-059-089812_VR-Chain
caggugcaacuggucgagagcggcgggggaguugugcagcccggcagaucccuccggcugucuugcgccgcuagccagcuuaccuucuccucuuacgggaugcacugggugcgccaggccccuggaaagggccuggaaugggucgcggggaucagcuuugcuggaacgaaaaagcauuauuccgacucugugaaaggcagauucacaauuagccgggauaacuccaagaaugcccucuaccugcaaaugaacagccuucgcgccgaggacaccgcucuguauuacugugccaaagaucucagagaauaugagugcgaagagugggcuucugacuacuaugauuuuggccgggagcagccgugucaggacccccgcgggguugugggaaucuucgauauguggggccaggggacaauggucaccguguccagc

SEQ ID NO: 40239 - RNA, 432 nt, Artificial Sequence
  derived and/or modified sequence opt5 from anti-HIV_cap256-059-088468_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuucguggggauuaaaaaguauuacgccaauuccguuaaaggaagauuuacaaucucucgggacaauagcaagaacacgcuguaucuccaaaugaacucccugcgcgccgaggauaccgcucuuuacuauugugccagagaccugcgggaauacgagugcgaagagugggcuagcgauuauuacgacuucggccgcggcgggccgugucaggaucccagaggaguggucggcucuuuugacauuugggggcagggaacaauggugaccguuuccagc

SEQ ID NO: 40240 - RNA, 432 nt, Artificial Sequence
  derived and/or modified sequence opt5 from anti-HIV_cap256-059-088341_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuucgccgggauuaaaaagcauuaugccgacuccgugaaaggaagauuuacaaucucucgggauaacagcaagaauaugguuuuccugcaaaugaacucccuccgcgcugaggacacggcccuguacuauugugcuagagaucuucgggaauacgagugcgaagagugggccagcgacuauuacgauuuuggccgcgaccagccgugucaggaucccagaggcguggucgggaccucugacauuuggggacagggcacaauggugaccguuuccagc

SEQ ID NO: 40241 - RNA, 432 nt, Artificial Sequence
  derived and/or modified sequence opt5 from anti-HIV_cap256-059-086533_VR-Chain
caggugcugcucgucgagagcggcgggggaguugugcaacccggcagaucccugcggcuuucuugcgccgcuagccaguucaccuuuuccaacuucgggaugcacugggugcgccaggccccuggaaagggccuggaaugggucgcggggaucucuuuugugggaauuaaaaaguacuaugcuggcagcguuaaaggcagauucacaaucucccgggacaauucuaagaacacgcucuaccugcagaugaauagccuucgcgccgaggauaccgcccuguauuacugugcuaaagaccucagagaauuugagugcgaagagugggccuccgauuauuacgacuucgggcggccgcaacccugucaggauccucgcggaguggucggcacauuugaccugugggggcugggaacccucgugacaguuagcucu

SEQ ID NO: 40242 - RNA, 432 nt, Artificial Sequence
  derived and/or modified sequence opt5 from anti-HIV_cap256-059-086043_VR-Chain
gaggugcaccuggucgaaagcggcgggggacucguuaagcccggcgggucccugagacuuucuugcgccgcuagcggauucaccuuuuccacauacucuaugaacugggugcggcaggccccuggcaaagggcuggaguggguggcguucgucgcuuuugacgaaagcgauaaguauuacgccgacuccgugaaaggacgcuucacgaucucuagagauaauagcaagaacacccucucccugcaaaugaauagccuucggguugaggacacagccauuuauuacugugcuaaagaagugggcgauaacaaggacgaugagugggccucugacuauuacgaucuguccaucgcuuauccgauucaggacccccgcgccgucggcagaggguacgauaucuggggacagggcaccauggugacaguuagcucu

SEQ ID NO: 40243 - RNA, 432 nt, Artificial Sequence
  derived and/or modified sequence opt5 from anti-HIV_cap256-059-084191_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuucguggggauuaaaaaguauuacgccgacuccguuaaaggaagauuuacagugucucgggauaacagcaaguccacgcuguaucuccaaaugaauagccugcgcgccgaggacaccgcucuuuacuauugugccagagaucugcgggaauacgagugcgaagagugggcuucugacuauuacgauuucggccgcgaccagccgugucaggaucccagaggcgucguggggaucuuugacauuuggggacagggcacagccguuaccguguccagc

SEQ ID NO: 40244 - RNA, 417 nt, Artificial Sequence
  derived and/or modified sequence opt5 from anti-HIV_cap256-059-082135_VR-Chain
caggugcaacuggucgagagcggcgggggaguugugcagcccggcagaucccuccggcugucuugcaccgccagcggguucacauuucgcuccuacgcuauccacugggugagacaggccccuggaaagggccuugaaugggucgcgcugauuucuuaugacgggagcaauaaauacuaugcugauuccgugaagggacgguucacgaucucucgcgacaauagcaaaaacacccucuaccugcagaugaacucccuuacaagcgaggauaccgccguuuauuacugugccaaggaccugggcggcucuaaaacagaugaaugggggaccgacuauugcuacccggugcaagaucccagagucgugguuggagcuuuugacauuuggggccaugggacaauggugaccgucuccagc

SEQ ID NO: 40245 - RNA, 432 nt, Artificial Sequence
  derived and/or modified sequence opt5 from anti-HIV_cap256-059-079417_VR-Chain
caggugcaacuggucgagagcggcgggggaguugugcagcccggcagaucccuccggcugucuugcgccgcuagcggguucuccuuuucuaacuacgccauggacugggugcgccaggcgccuggaaagggccuugaaugggucgcuuucgugagcuccgaugggaauaacaaaaaguaugccgacucuguuaaaggaagauuuacccugagccgggauaauuacaagaacacaguguaucuccagaugaacucccugacggucgaggacaccgccguguacuauugugcuaaagaucuuggcgccaauaaggacgaugaauggggcacagacuacuaugauaugagcguuucuuacccgauccccgacccucgcgcuguggucggggccuucgauguguggggacaaggcacccuggugacagucuccagc

SEQ ID NO: 40246 - RNA, 435 nt, Artificial Sequence
  derived and/or modified sequence opt5 from anti-HIV_cap256-059-076027_VR-Chain
caggugcaacuggucgagagcggcgggggaguugugcagcccggcagaucccuccggcugucuugcgccgcuagcggguucuccuuuucuaaguacggaaugcacugggugcgccaggccccuggcaaagggcuugaaugggucgcguucguggcuuuugacgagagcgaaaaguauuacgccgccuccguuaaaggaagauucaccaucucucgggauaacagcaagaauacacugucccuccagaugaacagccugcgcacggaggacaccgcuauuuauuacugugccaaagaagugggcgauaauaaggacgaugaguggacaucuccguauuacuaugacaucuccauugcuuaccccguccaugauccuagagccgugguuggcgugagcgacgucugggggcaaggaaccauggugacagugucuucc

SEQ ID NO: 40247 - RNA, 432 nt, Artificial Sequence
  derived and/or modified sequence opt5 from anti-HIV_cap256-059-075082_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuucguggggauuaaaaaguauuacgccgacuccguuaaaggaagauuuacaaucucucgggauaacagcaagaauacgcuguaucuccaaaugaacucccugcgcgccgaggacaccgcucuuuacuauugugccaaagaucugagagaaauggagugcgaagagugggcuagcgacuacuaugauuucggccgggaccucccgugucaggauccccgcggcguggucgggacacuggacauuuggggacagggcaccauggugacaguuucuucc

SEQ ID NO: 40248 - RNA, 432 nt, Artificial Sequence
  derived and/or modified sequence opt5 from anti-HIV_cap256-059-072575_VR-Chain
cagggccaacugguggagagcgggggaggcgucguucagcccgggagaucccuccggcugucuugcgccgcuagccaguucaccuuuuccaacuucggaaugcacugggugcgccaggccccuggcaaggggcuugaauggguggcggucaucucuuacgacggaacgaaaaaguauuacgcugauagcgugaaaggcagauuuacaauuucccgggacaauucuaagaacacccuguaucuccaaaugaauagccugcgcgccgaggauacagcccuuuacuauugugcuaaagacaugagagaagaugagugcgaagaguggggcgccgacuacuaugauuucgggaaggacuacccgugucaggcuucccggggaguugugggcaucuuugauauuugggggcagggaaccauggucacagugagcgcc

SEQ ID NO: 40249 - RNA, 432 nt, Artificial Sequence
  derived and/or modified sequence opt5 from anti-HIV_cap256-059-071926_VR-Chain
caggugcaacuggucgagagcggcgggggaguugugcagcccggcagaucccuccggcugucuugcgccgcuagccagcuuuccuucucuaauuacgggaugcacugggugcgccaggccccuggaaagggccuggaaugggucgcggggaucagcuuugugggaauuaaaaaguauuacagagacuccguuaaaggccgguucaccaucucucgcgauaauagcaagaacacacucuaucugcaaaugaacucccuuagaacggaggacaccgcucuguacuauugugugaaagaucuccgggaauuugagugcgaagagugggccagcgacuacuaugauuucggccgcgaccagccgugucuggaucccagaggggucgugggaacauuugacauuuggggccaggggaccaugguuacagugucuucc

SEQ ID NO: 40250 - RNA, 432 nt, Artificial Sequence
  derived and/or modified sequence opt5 from anti-HIV_cap256-059-069638_VR-Chain
caggugcaacuggucgagagcggcgggggaguugugcagcccggcagaucccuccggcugucuugcgccgcuagcggguucaccuuuuccaagaacgccaugcacugggugcgccaggcgccuggaagaggccuugaaugggucgcuucuguggccuucgacgggagcgauaaauacuaugccgacuccguuaagggacgguuuacaaucucucgcgauaauagcaaaaacacgcugucccuccagaugaauagccugagagcugaggacaccgccguguacuauugugcuaaggaagucgaucuuuacaaagacgaugaguggggcucugacuauuacgaucuguccauugccuauccgauccaagacccccgggcggugguuggcggguucggaauuuggggccaggggacaauggugaccgucagcucu

SEQ ID NO: 40251 - RNA, 432 nt, Artificial Sequence
  derived and/or modified sequence opt5 from anti-HIV_cap256-059-069165_VR-Chain
cuggugcagcucgucgagagcggcgggggaguugugcaacccggccggucccugcggcuuucuugcgccgcuagccgcuucaccuuuuccaacuacgggaugcacugggugagacaggccccuggaaagggccuggaaugggucgcggggaucucuuucgcuggaacaacgaaauauuacgccgacagcgugcggggccgcuuuaccauuuccagagauaauucuaagaacacacucuaucugcagaugaauagccuucgggccgaggacaccgcucuguacuauugugccaaagauaugcgcgaaauggagugcgaagagugggcuuccgacuacuaugauuucggcagaccgcagcccugucaagacccuagagggguugugggaaucuuugauauuuggggccaggggacaauggucaccgugagcucu

SEQ ID NO: 40252 - RNA, 432 nt, Artificial Sequence
  derived and/or modified sequence opt5 from anti-HIV_cap256-059-068956_VR-Chain
caggugcaacuggucgagagcggcgggggaguugugcagcccggcagaucccuccggcugucuugcgccgcuagcggguucaccuuuuccacauacgccaugcacugggugcgccaggcgccuggaagaggccuugaaugggucgcucugaucucuuaugacgggagcaauaaguacuauguggauuccguuaaaggacgguucacgauuucucgcgacaauagcaagaacacccucuaccugcagaugaacucccuuacagccgaggauaccgccguguauuacugugcuaaagaccugggcggcagcaaggaugacgaaugggccacagauuauuacgaccucucuaucgcuuacccgauucaagaucccagagccgucgcggggaucuuugacguguggggacggggcaccguugugacagucuccagc

SEQ ID NO: 40253 - RNA, 432 nt, Artificial Sequence
  derived and/or modified sequence opt5 from anti-HIV_cap256-059-068876_VR-Chain
caggugcaacuggucgagagcggcgggggaguugugcagcccggccggucccuccggcugucuugcgccgcuagccaguucaccuuuuccucuuacgggaugcacugggugcgccaggccccuggaaagggccuugaaugggucgcggcuaucagcuucgccgggacgaaaaaguauuacgccaacuccgugaaaggaagauuuacaauuucucgggacaauagcaagaacacccugucccuccaaaugaauagccugcgcggcgaggauacagcuagauauuacugugcccgggacccgcgcgaauaugagugcgaagagugggcuucugauuacuaugacuucggcagagaucagcccugucaggacccuagagggguuaucggaauuuuugauaucuggggccaggggaccauggugacagucuccagc

SEQ ID NO: 40254 - RNA, 432 nt, Artificial Sequence
  derived and/or modified sequence opt5 from anti-HIV_cap256-059-067733_VR-Chain
caggugcaacuggucgagagcggcgggggaguugugcagcccggcagaucccuccggcugucuugcaccgccagccaguucuccuuuucuagcuacgggaugcacugggugcgccaggcuccuggaaagggccuugaaugggucgccgcgaucuccuucgcugggacgaaaaagaacuauguggacucuguuaaaggaagauuuacaauuagccgggauaauuccaagaacacccuguaccuccaaaugaauagccugcgcgccgacgauacagcccuuuauuacugugcuaaagacaugagagaguaugaaugcgaggaaugggccucugauuacuaugacuucggccgggaguacccguguaccgauccccgcggcguggucgggacauuugacguguggggacagggcaccaugguuacaguguccagc

SEQ ID NO: 40255 - RNA, 432 nt, Artificial Sequence
  derived and/or modified sequence opt5 from anti-HIV_cap256-059-067450_VR-Chain
caggugcaacuggucgagagcggcgggggaguugugcagcccggcagaucccuccggcugucuugcgccgcuagccaguucaccuuuuccaauuacgggaugcacugggugcgccaggccccuggaaagggccuugaaugggucgcggggaucucuuucgcuggaauuaaaaaguauuacgccgacagcgugaaaggcagauuuacaaucucccgggauaaugccaagaacacgcuguaucuccaaaugaacucucugcgcgcugaggacaccgcccuuuacuauugugcuaaagaucugagagaauacgagugcgaagagugggccagcgacuauuacgauuucggccgggagcucccgugucaggacccccgcgggguugugggaacauuugauauuuggggccaggggaccauggucacaguguccagc

SEQ ID NO: 40256 - RNA, 432 nt, Artificial Sequence
  derived and/or modified sequence opt5 from anti-HIV_cap256-059-065694_VR-Chain
caggugcaacuggucgagagcggcgggggaguugugcagcccggcagaucccuccggcugucuugcgccgcuagccagcuuaccuucaacaauuacgggaugcacugggugcgccagacaccuggaaagggccuggaaugggucgccgggaucuccuuugcgggaauuaacaaauauuacgcugacucugugaagggcagauucacgaucagccgggauaauuccaaaaacgcccucuaucugcaaaugaccucucuucgcgccgaggacacagcucuguacuauuguguuaaggaucucagagaaauggagugcgaagagugggccagcgacuacuaugauuuuggccgggaccagccgugucaggauccccgcgggguggucggaaccuucgacauuuggggccaggggacaauggugaccguuuccagc

SEQ ID NO: 40257 - RNA, 432 nt, Artificial Sequence
  derived and/or modified sequence opt5 from anti-HIV_cap256-059-065109_VR-Chain
caggugcaacuggucgagagcggcgggggaguugugcagcccggcaagucccucagacugucuugcgccgcuagcggguucaccuuuacaaacaaugccaugaacugggugcggcaggcgccuggaaaaggccuugaaugggucgcuuucguguccucugacgggcgcaauaagaacuacgccgauagcguuaaaggaagauuuacgaucucccgggacaauucuaagaacaccguguaucugcagaugaauagccuccgcgucgaggauacagcccuguacuauugugcuaaagaccuuggcgccaacaaggaugacgaaugggcuaccgauuacuaugaccuguccguggccuacccgauucccgauccuagagcgguugugggcgccuucgacgucugggggcaaggaacaauggugaccgugagcucu

SEQ ID NO: 40258 - RNA, 432 nt, Artificial Sequence
  derived and/or modified sequence opt5 from anti-HIV_cap256-059-065060_VR-Chain
caggugcaacuggucgagagcggcgggggaguugugcagcccggcaccucccucagacugucuugcgccgcuagcggguucacauuuuccaacuacgccaugggaugggugcggcaggcgccuggcaaggggcuugaaugggucgcugugguuucuuaugacggaagcaaaaaguccuacgccgauucugugaaaggccgcuucacgaucagcagagacaauucccggaacacccuguaucuccagcugaauagccuucgcgccgaggauacagcuauguuuuacugugccaaggaccugggcaaaggggaaauugaggaaugggcuaccgauuauuacgacuggucuaaggccuauccgaucgagggacccagagaugucgugggcgcguucgacacaugggggcaaggaacccucguuacaguguccagc

SEQ ID NO: 40259 - RNA, 432 nt, Artificial Sequence
  derived and/or modified sequence opt5 from anti-HIV_cap256-059-064001_VR-Chain
caggugcaacuggucgagagcggcgggggaguugugcagcccggcagaucccuccggcugucuugcgccgcuagccaguucaccuuuuccaacuacgggaugcacugggugcgccaggccccuggaaagggccuugaaugggucgcggggaucucuuucgcuggaacgaaaaauuauuacgccaagagcgugaaaggcagauuuacaauuucccgggacaacucuaagaaugcccuguaucuccaaaugaacagccugcgcgcugaggauaccgcccuuuacuauugugcuaaagacaugagagaauacgagugcgaagagugggccuccgauuauuacgacuucggccgggaucagccgugucaggacccccgcgggguugugggaacauuugauaucuggggccaggggaccauggucgcggugagcucu

SEQ ID NO: 40260 - RNA, 432 nt, Artificial Sequence
  derived and/or modified sequence opt5 from anti-HIV_cap256-059-063270_VR-Chain
caggugcaacuggucgagagcggcgggggaguugugcagcccggcagaucccuccggcugucuugcgccgcuagccaguucaccuuuuccaacuacgggaugcacugggugcgccaggccccuggaaagggccuugaaugggucgcggcuaucucuuucgccgggacgaaaaagcauuaugccgacagcgugaaaggaagauuuacaauuucccgggauaauucuaagaacgcucuguaccuccaaaugaauagccugcgcgccgaggacaccgcucuuuauuacugugccaaagaucugagagaauaugagugcgaagagugggcguccgacuacuaugauuucggccgggaccagccgugucucgauccccgcggcguuguggggaucuuugacauuuggggacagggcacacuggucaccgugagcucu

SEQ ID NO: 40261 - RNA, 432 nt, Artificial Sequence
  derived and/or modified sequence opt5 from anti-HIV_cap256-059-061357_VR-Chain
caggugcaacuggucgagagcggcgggggaguugugcagcccggcagaucccuccggcugucuugcgccgcuagcggguucaccuuuuccaacuucggauuucacugggugcgccaggccccuggcaaggggcuugaaugggucgcgggaaucucuuucgcuggcacaaaaauuuacuaugccgacagcgugaagggcagauuuacgaucucccgggaaaauucuaaaaacaugcuguaccuccagaugaauagccugcgcggggaggauaccgccguuuauuucugugcuaaggaccuuagagaguuugaaugcgaggagugggccuccgauuacuaugacuucggacgggaauuuccgugucaagauccccgcggcguggucgggacauucgacguguggggacauggcgcuguugugaccgucagcucu

SEQ ID NO: 40262 - RNA, 435 nt, Artificial Sequence
  derived and/or modified sequence opt5 from anti-HIV_cap256-059-059834_VR-Chain
caggugcaacuggucgagagcggcgggggaguugugcagcccggcagaucccuccggcugucuugcgccgcuagcggguucaccuuuuccaacuucggaaugcacugggugcgccaggccccuggcaaggggcuugaaugggucgcguuuguggcuuucgacgagucugauaaauacuaugccgccagcguuaagggaagauuuacagugucccgggacaauucuaaaaacacggucagccugcagaugaacucccuccgcaccgaagauacagcuguguacuauugugccaaggagguuggcgacaauaaagaugacgaauggaccagcccguacuauuacgauuucucuaucgcuuaucccgugcaugacccuagagccgucgugggcggguacgauguguggggacaaggcacaauggucaccguuuccagc

SEQ ID NO: 40263 - RNA, 432 nt, Artificial Sequence
  derived and/or modified sequence opt5 from anti-HIV_cap256-059-059313_VR-Chain
caggugcaccuggucgagagcggcgggggaguugugcaacccggcaagucccucagacugucuugcgccgcuagccaguucaccuuuuccaacuucgggaugcauugggugcggcaggccccuggaaaaggccuugaaugggucgcggggaucucuuuugcuggaacaaagaaauacuaugccgacagcgugaagggccgcuucacgauuuccagagauaauucuaaaaacacccuguaccuccagaugaauagcguucgggccgaggacacagcucuguauuacugugccaaggauaugcgcgaauaugagugcgaagagugggcuuccgacuacuaugauuuuggcaagccgcaacccugucaggacccuagagggguggucggaaccuucgauauguggggccuugggacacuggugaccguuagcucu

SEQ ID NO: 40264 - RNA, 432 nt, Artificial Sequence
  derived and/or modified sequence opt5 from anti-HIV_cap256-059-057130_VR-Chain
caggugcaacuggucgagagcggcgggggaguugugcagcccggcagaucccuccggcugucuugcgccgcuagccaguucuccuuuucuagcuacgggaugcacugggugcgccaggccccuggaaagggccuugaaugggucgcggcuaucuccuucgccgggauuaaaaagcauuaugccgacucugugaaaggaagauuuaccaucagccgggauaacuccaagaauacacuguaccuccaaaugaacagccugcgcguugaggacacggcucuuuauuacugugccaaagaucugagagaauaugagugcgaagagugggcuucugacuacuaugauuucggccggccgcagcccugucaggacccucgcggcguggucgggaccuccgauauuuggggacagggcacaauggugaccguuagcucu

SEQ ID NO: 40265 - RNA, 411 nt, Artificial Sequence
  derived and/or modified sequence opt5 from anti-HIV_cap256-059-050520_VR-Chain
caggugcaacuggucgagagcggcgggggaguugugcagcccggcagaucccuccggcugucuugcgccgcuagccaguucaccuuuaaucgcuacgggaugcacugggugagacaggccccuggaaagggccuugaaugggucgcggugaucuccuaugcugacucuguuaaagggcgguucacaauuagccgcgauaauuccaagaacacgcuguaccuccaaaugaacucucugagagccgaggacaccgcccuuuauuacugugcuaaagaucugcgggaagacgagugcgaagagugguggagcgauuauuacgacuuuggacgcgagcucccguguagaaagucccggggcguggccggcaucuucgauauuugggggcagggaacaauggucaccgugagcucu

SEQ ID NO: 40266 - RNA, 432 nt, Artificial Sequence
  derived and/or modified sequence opt5 from anti-HIV_cap256-059-049839_VR-Chain
caggugcaacuggucgagagcggcgggggaguugugcagcccggcagaucccuccggcugucuugcgccgcuagcggguucuccuuuucuaacuacgccauggacugggugcgccaggcgccuggaaagggccuugaaugggucgcugugguuagcuccgaugggaaaaccaagaauuaugccgacucugugaaaggaagauucacaaucagccgggauaacuccaagaauacggucuaccugcagaugaacagccuccgcccggaggacaccgccguguauuacugugcuaaagaucugggcgccaauaaggacgaugaauggacaaccgacuauuacgauuggucuguugcuuaucccgugccugaccccagagccgucgugggcgcguuugaugugugggggcaaggaacaauggucaccguuuccagc

SEQ ID NO: 40267 - RNA, 432 nt, Artificial Sequence
  derived and/or modified sequence opt5 from anti-HIV_cap256-059-048503_VR-Chain
caggugcaacuggucgagagcggcgggggaguugugcagcccggcagaucccuccggcugucuugcgccgcuagccagcuuuccuucucuaauuacgggaugcacugggugcgccaggccccuggaaagggccuggaaugggucgcggggaccagcuuugcuggaacgaaaaaguauuacgccgacuccgugaaaggcagauucacaaucucucgggauaauagcaagaacgcccucuaucugcaaaugaacucccuucgcgcugaggacaccgcccuguacuauugugcuaaagaucucagagaauacgagugcgaagagugggccagcgacuauuacgauuuuggccgggaccagccgugucaggauccccgcgggguugugggaacauucgacauuuggggccaggggaccauggucacagugucugcg

SEQ ID NO: 40268 - RNA, 432 nt, Artificial Sequence
  derived and/or modified sequence opt5 from anti-HIV_cap256-059-045516_VR-Chain
caggugcaacuggucgagagcggcgggggaguugugcagcccggccggucccuccggcugucuugcgccgcuagccaguucaccuuuuccggguacggaaugcacugggugcgccaggccccuggcaaggggcuugaaugggucgcggcuaucucuuucgccggaaacaaaagauauuuugccgacagcgugaagggccgguucacaauuucccgcgauaauucuaaaaacacgcuguuucuccaaaugaauagccugagagcugaggacaccgcccuuuacuauugugcucgggauaugcgcgaauacgagugcgaagagugggccuccgacuauuacgauuucggcagaccgcagcccugucaggacccuagagggguugugggagucuuugauaucuggggccaggggacaauggugaccguuagcucu

SEQ ID NO: 40269 - RNA, 432 nt, Artificial Sequence
  derived and/or modified sequence opt5 from anti-HIV_cap256-059-044188_VR-Chain
caggugcaccuggucgagagcggcgggggaguugugcaacccggcagaucccuccggcugucuugcgccgcuagccaguucaccuuuuccucuuacgggaugcauugggugcgccaggccccuggaaagggccuugaaugggucgcggggaucagcuucgcuggaacaaauaaauauuacgccgacuccgugaagggcagauuuacgguuucucgggauaauagcaaaaacacccuguaugugcagaugaacucccuccgcgccgaggacacagcucuguacuauugugccagagaucuucgggaauacgagugcgaagagugggcuagcgacuauuacgauuucggccgcgagcaaccgugucaggaccccagaggggucgugggaauuuuugauaucuggggcccugggaccaugguuacagugucuucc

SEQ ID NO: 40270 - RNA, 435 nt, Artificial Sequence
  derived and/or modified sequence opt5 from anti-HIV_cap256-059-044105_VR-Chain
cagggccaacugguggagagcgggggaggcgucguucagcccgggagaucccucucucugagcugcgccgcuuccggauucucuuuuaacaauuacgccauggacugggugcggcaggcgccuggcaaggggcuugaauggguggcugucgugagcuccgauggaaacaauaaaaacuaugccgacucuguuaagggccgcuucaccaucagcagagauaauuccaaaaacacaguguaccugcagaugaauagccuccgggccgaggacacggcuauuuauuacugugccaaggaugucggcgcuaacaaagacgaugaaugggccaccaauuauuacuaugacuggucuguggcguacccgguucccgauccucgcgccgugaucggggcuuuugacgucuggggacaaggcacaauggugaccguguccagc

SEQ ID NO: 40271 - RNA, 432 nt, Artificial Sequence
  derived and/or modified sequence opt5 from anti-HIV_cap256-059-042100_VR-Chain
caggugcaacuggucgagagcggcgggggaguugugcagcccggcagaucccagcggcucucuugcgccgcuagccaguucaccuuuuccucuuacgggaugcacugggugcgccaagccccuggaaagggccuggaaugggucgcggcuaucagcuucgccgggacaaauaaauauuacggagacuccgugaagggcagauuuacgauuucucgggauaauagcaaaaacacccuuuaucugcagaugaacucccuccgcgccgaggacacagcucuguaccauugugccagagauaugcgggaauaugagugcgaagagugggcuagcgacuacuaugauuucggccgcgaccagccgugucaggaucccagagggguugugggaaucuuugaccuuuggggccaagggaccauggucacagugucuucc

SEQ ID NO: 40272 - RNA, 432 nt, Artificial Sequence
  derived and/or modified sequence opt5 from anti-HIV_cap256-059-040742_VR-Chain
caggugcaacuggucgagaccggcgggggaguuggccagcccggaaagagccucagacuguccugcgccgcuucuggguucacauuuagcaacuucgccauggacugggugcggcaggcgccuggcaaagggcuugaauggguggcuuuuaucuccucugauggaauuaauaagaaauacggcgacuucgucaagggccgcuuuacgaucagcagagauaacuccaaaaauacccuguuccuccagaugaacucucugcgggccgaggacacagcccuuuauuacugugcuaaggaugugggggacuauaagagcgaugaauggggaaccgacuacuaugaucuguccauugaguacccgauccaagacccccgcgccguugugggcgcuuuugauaauugggggcagggaacaauggucauugugagcucu

SEQ ID NO: 40273 - RNA, 432 nt, Artificial Sequence
  derived and/or modified sequence opt5 from anti-HIV_cap256-059-040554_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggggaucagcuucgcugccacaaauaaauauuacggaggcuccgugaagggcagauuuacgauuucucgggacaauagcaaaaacacccuguaucuccaaaugaacucccugcgcgccgaggauacagcucuuuacuauuguaccagagacaugcgggaauacgagugcgaagagugggccagcgauuauuacgacuucgggaaggaucagccgugucaggacccccgcggaguugugggcacacuggauaucugggggcagggaaccauggucacagugucuucc

SEQ ID NO: 40274 - RNA, 432 nt, Artificial Sequence
  derived and/or modified sequence opt5 from anti-HIV_cap256-059-039660_VR-Chain
caggugcaacuggucgagagcggcgggggaguugugcagcccggcagaucccuccggcugucuugcgccgcuagccaguucuccuuuucuaacuacgggaugcacugggugcgccaggccccuggaaagggccuugaaugggucgcgagcaucuccuucgcugggaccaaaaagaaauaugccgacucugugaagggaagauuuacaauuagccgggauaauuccaaaaacacgcuguuccuccaaaugaauagccugcgcaccgaggacgccgcucuuuacuauugugccaaggauaugagagaauuugagugcgaagagugggcuucugacuacuaugauuucggccgggagcagccgugucaggacacacgcgauguugugggcaucuuugacauuugggggcagggaaccauggucacaguguccagc

SEQ ID NO: 40275 - RNA, 435 nt, Artificial Sequence
  derived and/or modified sequence opt5 from anti-HIV_cap256-059-039298_VR-Chain
caggugcaacuggucgagagcggcgggggaguugugcagcccggcagaucccuccggcugucuugcgccgcuagcggguucaccuuuuccaaguacggaaugcacugggugcgccaggccccuggcaaagggcuugaaugggucgcguucguggcuuuugacgagucugauaaguauuacgccgccagcgcuaaaggaagauucaucauuucccgggacaacucuaagaauacacugagccuccagaugaacucccugcgcacggaagauaccgccguuuauuacugugcuaaagaggugggcgacaauaaggaugacgaauggacaagcccguauuacuaugauaucucuauugccuaccccguccaagacccuagagcggugguuggcggguacgauguguggggacagggcaccauggucacaguguccagc

SEQ ID NO: 40276 - RNA, 432 nt, Artificial Sequence
  derived and/or modified sequence opt5 from anti-HIV_cap256-059-037873_VR-Chain
caggugcaacuggucgagagcggcgggggaguugugcagcccggcagaucccuccggcugucuugcgccgcuagccaguucaccuuuuccaacuacgggaugcacugggugcgccaggccccuggaaagggccuugaaugggucgcggcuaucucuuucgccgggauuaauaaauauuacgccgacagcgugaagggaagauuuacacugucccgggauaacacgaaaaauacccucuaucugcaaaugaacucucuucgcgcugaggacacagcccuguacuauugugcuagagaucuccgggaauacgagugcgaagagugggccagcgacuauuacgauuucggccgcccgcagcccugucaggacccuagaggcguuguggggaccuccgauaucuggggacagggcacaauggucaccgugagcucu

SEQ ID NO: 40277 - RNA, 432 nt, Artificial Sequence
  derived and/or modified sequence opt5 from anti-HIV_cap256-059-037633_VR-Chain
caggugcaacuggucgagagcggcgggggaguugugcagcccggcagaucccuccggcugucuugcgccgcuagccaguucaccuuuuccaacuucgggaugcacugggugcgccaggccccuggaaagggccuugaaugggucgcggcuaucucuuuugccgggauuaauaaaaacuacgccgacagcgugaagggaagauucacaaucucccgggauaauucuaaaaacacgcugcaucuccaacugaauagccuucgcgcugaggacaccgcccuguauuacugugcuaaggaucucagagaauaugagugcgaagagugggccuccgacuacuaugauuuuggccgggaccagccgugucaggauccccgcggcguuguggggacauucgacauuuggggacagggcaccauggucacagugagcucu

SEQ ID NO: 40278 - RNA, 432 nt, Artificial Sequence
  derived and/or modified sequence opt5 from anti-HIV_cap256-059-036817_VR-Chain
caggugcaacugcucgagagcggcgggggagucguucagcccggcagaucccugcggcuuucuugcgaagccagccaguucaccuuuuccaacuucgggaugcacugggugcgccaggcuccuggaaagggccuggaguggguggccgcgaucucuuuugcugggauuaaaaagaauuacgccgacagcgucaaaggaagauucacaaucucccgggauaacucuaagaauacgcucuaucugcaaaugaacagccuucgcguggaagacaccgcccuguacuauugugcuaaagaucucagagaguacgaaugcgaggagugggccuccgacuauuacgauuuuggccgggaacagccgugucaggacccccgcggcguuauugggacauucgauaucuggggacagggcaccauggugacagucagcucu

SEQ ID NO: 40279 - RNA, 432 nt, Artificial Sequence
  derived and/or modified sequence opt5 from anti-HIV_cap256-059-032787_VR-Chain
caggugcaacuggucgagagcggcgggggaguugugcagcccggcagaucccuccggcugucuugcgccgcuagcggguucaccuuuuccaaguacgccaugcacugggugcgccaggcgccuggaaaaggccuugaaugggucgcuuucguggccuuugacgagucugauaaguauuacguugacagcgugaaagggagauucacaaucucccgggauaacucuaagaauacgcugagccuccagaugaacucccugcgcgccgaagacaccgcugucuauuacugugccaaagaggugcauguuaauaaggaugacgaaugggcuagcgauuauuacgaccuuucuauugccuauccgauccaagaucccagagcgguggucggaggccuggacauuuggggccaggggacaauggugaccguguccagc

SEQ ID NO: 40280 - RNA, 432 nt, Artificial Sequence
  derived and/or modified sequence opt5 from anti-HIV_cap256-059-032427_VR-Chain
caggugcaacuggucgagagcggcgggggaguugugcagcccggcagaucccuccggcugucuugcgccgcuagccaguucaccuuuuccaacuucgggaugcacugggugcgccaggccccuggaaagggccuugaaugggucgcggggaucucuuuuccgggaacgaaaaaguacuaugcugacagcgugaaaggcagauucacaauuucccgggauaauucuaagaacgcccuguaccuccaaaugaauagccugcgcgccgaggacaccgcucuuuauuacugugccagagaucugcgggaauaugagugcgaagagugggcuuccgacuacuaugauuuuggcaaaccccagccuugucucgacccccgcgggguugugggaacauucgauaucuggggccaggggaccauggucacagugagcucu

SEQ ID NO: 40281 - RNA, 435 nt, Artificial Sequence
  derived and/or modified sequence opt5 from anti-HIV_cap256-059-029390_VR-Chain
caggugcaacuggucgagagcggcgggggaguugugcagcccggcagaucccuccggcugucuugcgccgcuagcggguucaccuuuaaccagcacggaaugcauugggugcgccaggccccugacaagggccuugaaugggucgcguucgugggguuugaugaguccgaaaaauacuaugcugacucuguuaagggaagauucacaaucagccgggauaauuccaaaaacacgcugucucuccaaaugaauagccugcgcccggaggacaccgccguguacuauugugccaaggaagucggcgauaacaaagaggacgagugggcuuccgauuacuauuacgaccuuagcaaugccuaucccauucacgauccuagagcugugguuggcggguacgacaucuggggacagggcacaauggugaccgucugcucu

SEQ ID NO: 40282 - RNA, 435 nt, Artificial Sequence
  derived and/or modified sequence opt5 from anti-HIV_cap256-059-027877_VR-Chain
caggugcaacuggucgagagcggcgggggaguugugcagcccggcagaucccuccggcugucuugcagcgccuccgcuuucucuuuuagcuacuucgccauggacugggugcgccaggcgccugggaagggacuugaaugggucgcuuuuguguccucugauggcaacaauaaaaacuaugccgacagcguuaaggggagauucaccaucucccgggauaauagcaaaaacacaguguuucugcagauggacucucuccgcccggaggauacggccgucuacuauugugcuaaggaccugggaggcaauaaagaugacgaaugguccaccaacuacuauuacgauauuagcaucgccgaccccgugccugaucccagagcuguugccggcgcguucgacgugugggggcaaggaacaauggucaccgugucuucc

SEQ ID NO: 40283 - RNA, 435 nt, Artificial Sequence
  derived and/or modified sequence opt5 from anti-HIV_cap256-059-026640_VR-Chain
caggugcaacuggucgagagcggcgggggaguugugcagcccggcagaucccuccggcugucuugcgccgcuagcggguucuccuuuucuaaguacggaaugcacugggugcgccaggccccuggcaaagggcuugaaugggucgcguucguggcuuuugacgagagcgauagauauuacgccgccuccguuaagggacgguucaccaucucucgcgacaacagcaaaaauacacugucccuccagaugaacagccugagaacggaagauaccgcuauuuauuacugugccaaggaggugggcgacaauaaagaugacgaauggacaucuccguauuacuaugauauguccaucgcuuaccccguccaagacccucgggccgugguuggcggguacgauauuuggggacagggcaccauggugacagucagcucu

SEQ ID NO: 40284 - RNA, 432 nt, Artificial Sequence
  derived and/or modified sequence opt5 from anti-HIV_cap256-059-026017_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgggacgaacaaauacuauguggauagcgccaagggaagauucaccauuucccgggacaauucuaaaaacacacucuaccugcagaugaauagccuuaccccggaggauacagccguguuuuauugugcuaaggaccugggcggcuacaaagaugacgaaugggggaccgaguauuacgauaucuccguuagcuaccccguccaagacccucgcgccguggcuggaguuuucgauguguggggccaugggacaauggucaccgugucuucc

SEQ ID NO: 40285 - RNA, 432 nt, Artificial Sequence
  derived and/or modified sequence opt5 from anti-HIV_cap256-059-024100_VR-Chain
ugccaggugcuggucgagagcggcgggggaguugugcaacccggcagaucccuccggcugucuugugccgcuagccaguucaccuuuuccucuuacgggaugcacugggugcgccaggccccuggaaagggccuugaaugggucgcggcuaucagcuucgccgggacgaaaaaguauuacgccgacuccgugaaaggaagauuugcuauuucucgggauacaagcaagaacgcccuguaucuccagaugaauacccugcgcgcugaggacacagcccuuuacuauugcgcgagagaucugcgggaguucgaaugugaagagugggccuccgacuacuaugauuuuggccgcccgcaacccugccaggacccuagaggcguuguggggagcuucgauaucuggggacagggcaccauggucacagugucucuc

SEQ ID NO: 40286 - RNA, 432 nt, Artificial Sequence
  derived and/or modified sequence opt5 from anti-HIV_cap256-059-023966_VR-Chain
caggugcaacuggucgagagcggcgggggaguugugcagcccggcagaucccuccggcugucuugcgccgcuagccaguucuccuuuucuagcuacgggaugcacugggugcgccaggccccuggaaagggccuugaaugggucgcggcuaucuccuucgccgggauuaaaaagcauuauaccgacucugugaaaggaagauuuacaaucagccgggauaacuccaagaauacgcuguaccuccaaaugaacagccugcgcgccgaggacaccgcucuuuauuacugugccaaagaucugagaggcuucgaaugcgaggaaugggcuucugacuauuacgauuuuggccgggaccagccgugucaggauccccgcgggguugugggaacauucgacauuuggggccaggggacccucgucacaguguccagc

SEQ ID NO: 40287 - RNA, 432 nt, Artificial Sequence
  derived and/or modified sequence opt5 from anti-HIV_cap256-059-020534_VR-Chain
caggugcaacuggucgagagcggcgggggaguugugcagcccggcagaucccuccggcugucuugcgccgcuagccaguucaccuuuuccaacuacgggaugcacugggugcgccaggccccuggaaagggccuugaaugggucgcggggaugucuuucgcuggaacaaauacguauuacgccgacagcgugaaaggcagauuuaccaucucccgggauaacucuaagaauacacuguaucuccaaaugaacagccugcgcgccguugacaccgcucuuuacuauugugccagagauaugcgggaguacgaaugcgaggaaugggcuuccgacuauuacgauuucggccgcgaguacccgugucaggaccccagagggguggucggaauuuuugaucuguggggccaggggacaauggugaccguuagcucu

SEQ ID NO: 40288 - RNA, 435 nt, Artificial Sequence
  derived and/or modified sequence opt5 from anti-HIV_cap256-059-019513_VR-Chain
caggugcaacuggucgagagcggcgggggaguugugcagcccggcagaucccugcggcugucuugcgccgcuagcggguucaccuuuuccaacuucgccaugggaugggugcgccaggcgccuggcaaggggcuugaaugggucgcugugaucucuagcgacggaacaaauaaaaacuacggcgauuccguuaagggcagauuuacgauuucucgggacaauagcaaaaacacccuguuccuccagaugaacucccugcgcgccgaggauacaagccuuuauuacugugccaaggaccucgggggauauaaaaccgaugaaugggcuacaaauuacuauuacgacaucucuauugccuccccgauccaagaucccagagcuguggucggcgccuuugacauuugggggcagggaaccauggugacaguuaccagc

SEQ ID NO: 40289 - RNA, 432 nt, Artificial Sequence
  derived and/or modified sequence opt5 from anti-HIV_cap256-059-012963_VR-Chain
caggugcaacuggucgagagcggcgggggaguugugcagcccggcagaucccuccggcugucuugcguggccagcggguucuccuuuucuagcuacggaauggcuuggguccgccaggccccuggcaaggggcuugaaugggugaccguuaucuccuucgcgggagugaaaacauauuacgcugacucugucaagggcagauuuacgauuagccgggauaacuccaaaggcacccuguaucuccagauggacgggcugcgcccggaggauacagcccuuuacuauugugccaaggaccuggcugaaagagagugcgaagagugggccagcgauuacuaugacuucggacgggagcuccccugucaagauccucgcggcgugguugggaccuuugacguguggggacagggcacaauggucaccgugucuucc

SEQ ID NO: 40290 - RNA, 435 nt, Artificial Sequence
  derived and/or modified sequence opt5 from anti-HIV_cap256-059-010396_VR-Chain
caggugcaacuggucgagagcggcgggggaguugugcagcccggcagaucccuccggcugucuugcgccgcuagcggguucuccuuuaacaauuacgccaugaacugggugcgccaggcgccuggaaagggccuugaaugggucgcuuucgugucuagcgacggguccaauaaaaacuaugccgauucuguuaccggaagauuuacacugagccgggacaauuccaagaacacgguguuccuccagaugaauagccugcgcgucgaggauaccgccguguacuauugugcuaaagacguuggcgccaacaaggaugacgaauggacaaccaauuacuauuacgauaucucuauugcugacccggugcccgauccuagagccgucaucggcgcguuugacgugugggggcaaggaacaauggugaccgucuccagc

SEQ ID NO: 40291 - RNA, 432 nt, Artificial Sequence
  derived and/or modified sequence opt5 from anti-HIV_cap256-059-008136_VR-Chain
caggugcaacuggucgagagcggcgggggaguugugcagcccggcagaucccuccggcugucuugcgccgcuagcggguucaccuuuaauacauacgccaugcacugggugcgccaggcgccuggaaagggccuugaaugggucgcucugaucuccuaugacgggacggagaaauacuaugccgauucugugaagggaagauucaccauuagccgggacaauucccgcaacacacucuaccugcagaugaacucucuuagacuggaagaugccgcucucuaucaaugugccaaagaccugggcggcagcaaguccgaugagugggggaccgacuacuaugauaugagcaucucuuacccgauucaggacccccgggcuguugccggaguguuugauaucuggggccaggggacacuggucaccguguccagc

SEQ ID NO: 40292 - RNA, 432 nt, Artificial Sequence
  derived and/or modified sequence opt5 from anti-HIV_cap256-059-006147_VR-Chain
caggugcaagucguugagagcggcgggggaguggugcagcccggcagaucccugcggcucucuugcaccgccagcggguucacauuuuccaacuucgcuaugggauggguccgccaggccccuggcaaggggcuggaauggguggcguuuaucucuagcgacggauccaauaaaaacuacggcgauucuguuaagggcagauucacgauuagccgggacaauuccaaaaacaccguguuucuucagaugaauagccugcgcgucgaggauacagcucucuauuacugugccaaggacgugggggauuauaaaucugacgaauggggaaccgaguacuaugauaucuccauuagcuacccgauccaagaccccagagccaugguuggcgcuuucgaucugugggggcagggaacaauggugaccgucucuccu

SEQ ID NO: 40293 - RNA, 432 nt, Artificial Sequence
  derived and/or modified sequence opt5 from anti-HIV_cap256-059-005081_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggggaucagcuucgcugccacgaaaaaguauuacuccgagucugugaaaggaagauuuacaauuagccgggacaacuccaagaaugcccugcaucuccacaugaacagccugcgcgcugaagauaccgcccuuuauuacugugcuaaagaccugagagaguucgaaugcgaggagugggccucugauuauuacgacuuuggccgggaucaaccgugucaggacccccgcggcguuguggggaucuucgauauguggggacagggcacaauggucaccguguccagc

SEQ ID NO: 40294 - RNA, 432 nt, Artificial Sequence
  derived and/or modified sequence opt5 from anti-HIV_cap256-059-005006_VR-Chain
caggcccaacugguggagagcggcgggggagucguucagcccgcuaagucccucagacugucuugcgccgcgagcggcuucaccuuuaacaaauacgcuaugcacugggugcggcaggccccugggaagggacuugaauggguggccuucgucgcuuuugacgaguccgauaaauauuacgccgacucugugaagggccgcuucacaaucagcagagauaauuccaaaaacacgcugucucuccagaugaauaaccugcgggcugaagacaccgccguuuauuacugugcgaaggaggugggggauaauaaggacgaugaaugggccagcgacuauuacgaucuuuccauugcuuauccgauccaagacccccgcgccgucggaagaggcuacgauauuuggggccaggggacaauggugaccguuagcucu

SEQ ID NO: 40295 - RNA, 432 nt, Artificial Sequence
  derived and/or modified sequence opt5 from anti-HIV_cap256-059-004451_VR-Chain
caggugcaccuggucgagagcggcgggggaguugugcaacccggcaagucccucagacugucuugcaccgccagcggguucacauuuacgaacuucgcuauggacugggugcggcaggccccuggaaaaggccuugaaugggucgcguuuaucuccucugaugggagcaauaaguacuauuccgagucugugaaaggacgcuucaccauuagcagagacaacuccaagaauacacuguacguucagaugaacagccuccggaccgaagauacagcuguguauuacugugccaaagaccugggcggcuauaaggaugacgaguggucuaccgauuacuaugacugguccacagccuacccgguccaggauccccgcgcuguggccggggcuuuugaccuuuggggacaaggcaccaugguuagcgugucuucc

SEQ ID NO: 40296 - RNA, 432 nt, Artificial Sequence
  derived and/or modified sequence opt5 from anti-HIV_cap256-059-003571_VR-Chain
caggagcaacugguggaaagcggcgggggagucguucagcccggcagaucccuccggcugucuugcgccgcuagccaguucaccuuuggggccuacggaaugcacugggugcgccaggcgccuggcaaggggcuugaguggguggcuggagucuccuucgugggcaacaauaaauauuacgccgacucuguuaagggcagauuuacaaucagccgggauaacuccaaaaauacgcuguaucuccaaaugaacucucugcgcggggaagacaccgcccuuuacuauugugcuagagauaugcgggagauggaaugcgaggagugggccagcgacuacuaugauuucggacgcccgcagcccugucaggacccuagaggcguggucgggauuuuugauauguggggacagggcacaauggugaccguuuccagc

SEQ ID NO: 40297 - RNA, 432 nt, Artificial Sequence
  derived and/or modified sequence opt5 from anti-HIV_cap256-059-003449_VR-Chain
caggugcaacuggucgagagcggcgggggaguugugcagcccggcaagucccucagacugucuugcgccgcuagccaggugaccuucuccucuuacgggaugcacuggguccggcaggccccuggaaaaggccuugaauggguggcggggaucagcuuugcuggaacaaagaaauauuacgccgacuccguuaagggccgcuucacgauuucuagagauaacagcaaaaaugcccuguaucuccaaaugaaccggcugcgcgcuggcgacaccgcccuuuacuauugugcuaaggaucugagagaguacgaaugcgaggaaugggccuccgacuauuacgauuuugggcgggagcagccgugucaggacccccgcggaguggucggcaucuucgauauuugggggcucggaacaauggugaccguuagcucu

SEQ ID NO: 40298 - RNA, 432 nt, Artificial Sequence
  derived and/or modified sequence opt5 from anti-HIV_cap256-059-002712_VR-Chain
caggugcaacuggccgagagcggcgggggagucguucagcccggcagaucccuccggcugucuugcgcugccagccaguucaccuuuuccucuuacgggaugcacugggugcgccaggcgccuggaaagggccuugaauggguggcugccaucagcuucgccgggacgaaaaagcauuaugcugacuccgucaaaggaagauuuacaauuucucgggauaauagcaagaauacccugaaccuccaaaugaacucccugcgcgccgaggacacagcucuuuacuauugugccagagauaugcgggaauacgagugcgaagugugggcgagcgacuauuacgauuucggccgcgagcagccgugucaggaccccagaggcguuguggggaccuuugauaucuggggacagggcacaauggucaccgugucuccu

SEQ ID NO: 40299 - RNA, 432 nt, Artificial Sequence
  derived and/or modified sequence opt5 from anti-HIV_cap256-059-001573_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggggaucagcuaugacggaacauccaaauacuaugcugauucugugaagggcagauucacgauuagccgggacaacuccaaaaauacccuguaccuccaaaugaacagccugcgcgccgaggauacagcccuuuauuacugugcuaaggaccugagagaagaugagugcgaagagugguggucugacuauuacgauuuuggccgggagcucccgugucgcaaauccagagggguugccggaaccuucgacaucuggggccaugggacaauggugaccgucagcucu

SEQ ID NO: 40300 - RNA, 432 nt, Artificial Sequence
  derived and/or modified sequence opt5 from anti-HIV_cap256-059-001379_VR-Chain
caggugagacuggucgagagcggcgggggaguugugcaacccggccggucccuccgccugucuugcgccgcuagcggguucaccuuuaacuccuacccuaugcacugggugagacaggccccgggaaagggccuugacugggucgcgcugaucucuuaugaugggacaaauaaauucuacguggacagcguuaagggacgguuuacgauuucccgcgauaacucuaaaaauacccucuaucugcagaugaacagccuuacagcugaagacaccgccauguacuauugugccaaggaucugggcggcaauaaagacgaugagugggggacagacuacuaugauaucuccguggcuuaccccauucaugacccuagagccgucgcuggaaucuucgauguguggggccacgggaccaugguuacagugagcucu

SEQ ID NO: 40301 - RNA, 432 nt, Artificial Sequence
  derived and/or modified sequence opt5 from anti-HIV_cap256-059-001029_VR-Chain
caggagcaacuggugcagagcggcgggggagucguucagcccggcagaucccuccggcugucuugcgccccuagccaguucaccuuuuccgcucacgggaugcauugggugcgccaagccccgggaaagggccuugaauggguggcggggaucucuuucgcuggaacgaaaaacuacuaugccgacagcgucaagggcagauuuacaauuucccgggauaauucuaaaaacacccuguaccuccagaugaauagccugcgcguggaggacacagcccuuuauuacugugcuaaggauaugagagaaauggagugcgaagagugggccuccgacuauuacgauuucggccggcaccagcccugucaggacccucgcgggguugugggaaucuuugauauuuggggccaagggaccauggucacagugagcucu

SEQ ID NO: 40302 - RNA, 432 nt, Artificial Sequence
  derived and/or modified sequence opt5 from anti-HIV_cap256-048-165087_VR-Chain
gaggugaagcugcucgaaagcggcgggggacugguccagcccggcggguacagacggcuuuccugcgccgcuucuggauucaccuuuagccgcuaugccaugcacugggcgagacaagcuccuggcaaagggcuggaguggguugccgugguguccgacgauggagucaagaaauacuauccggacucugugcggggccgcuucacaaucagcagagauaacucccggaauacgguuucucuccagaugaacagccugcgccccgaagacaccgccguguacuauugugcuaaggaugucggcgccaauaaagacgaugagugggcuacagacuacuaugaucuuuccauugccuacccugugcccgacccuagagcgguugugggggccuuugauaucuggggacagggcaccauggucacagugagcucu

SEQ ID NO: 40303 - RNA, 432 nt, Artificial Sequence
  derived and/or modified sequence opt5 from anti-HIV_cap256-048-158861_VR-Chain
gaggugcagcuggucgaaagcggcgggggacucguucaacccggcgggucccugcggcuuucuugcguggacuucggauuucgguucagcgaguacuggauguccugggugcgccaggccccuggcaaggggcuggaaugggucgcugugaucucuuaugauggaaccaacaaauacuaugccgacagcguuaagggcagauuuacaauuucccgggauaauucuaaaaacacgcucuaccugcagaugaauagccuucgcgcggaggacaccgcucuguauuacugugccaaggauaugagagaauccgagugcgaggaaugggccagcgacuauuacgauuucggcaaagacuacccgugucaggaucccagagggguggucggaacauuugacaucuggggccaagggaccauggugacaguuucuucc

SEQ ID NO: 40304 - RNA, 435 nt, Artificial Sequence
  derived and/or modified sequence opt5 from anti-HIV_cap256-048-158280_VR-Chain
caggugcaccuggucgagagcggcgggggaguugugcaacccggcagaucccuccggaucuacugcgccgugucugaguucaccuuucgcaacuaugcuaugcauugggucagacuggccccugggaagggacuucaguggguggcgguuauuagccacgacggcaucaaugauuacuaugcugacuccgugaaagggcgguucacaauuucucgcgauaacagcaagaauacggucucccugcagaugaacucucucagaccggaagacaccgccguguacuauugugccaaagaucugggagcuaauaaggacgaugaaugggccacagacuacuaugaucuuagcaucgcuuaccccguuccugaccccaccggcccuugguuuggcgccuucgauauuugggggcagggaacaauggugaccgucuccagc

SEQ ID NO: 40305 - RNA, 432 nt, Artificial Sequence
  derived and/or modified sequence opt5 from anti-HIV_cap256-048-157928_VR-Chain
caggugcaacugauggagagcggcgggggagucguucagcccggcagaucccuccggcugucuugcgccaucagcggguucaccuuuuccaacuacuggaugucuugggugcgccaggcuccuggaaagggccuugaauggguggccgucauuagcuccgacgggucuagcaaaaauuaugcggauuccgugaagggaagauucacaaucagccgggacaacucuaaaaauacgguuucccugcagaugaacagccuccgcccggaggauaccgcuguguacuauugugccaaggacgucggcgccaauaaagaugacgaaugggcuacagauuacuaugaccugucuauugccuaccccgugccugaucccagagcuguugugggcgccuuugacaucugggggcaaggaaccauggucacaguguccagc

SEQ ID NO: 40306 - RNA, 432 nt, Artificial Sequence
  derived and/or modified sequence opt5 from anti-HIV_cap256-048-157056_VR-Chain
caggugcaacuggucgagagcggcgggggaguugugcagcccggcagaucccuccggcugucuugcgccgcuagcggguucacccuuuccucuuacgccaugcacugggugcgccaggcgccuggaaagggccuggaaugggucgcuuuuaucagcaacgacggguccaauaaauauuucgccgauucugugaagggaagauuuacaauuagccgggacaacuccaaaaauacgcucuaccugcagaugaacagccuucgcgccgaggauaccgcuguuuauuacugugccaaggaccugggcggcaauaaagaugacgaaugggcuacagauuauuacgaccucucuaucgccuauccggugcaagaucccagagucgugguugggauuuucgacaucuggggacagggcaccauggugacagucuccagc

SEQ ID NO: 40307 - RNA, 432 nt, Artificial Sequence
  derived and/or modified sequence opt5 from anti-HIV_cap256-048-156422_VR-Chain
caggugcaacuggucgagagcggcgggaccguugugcagcccggaagaucccuccggcugucuugcgugggcagcggguucucccuuucuuacuaugccauccacuggguccgccaggcuccuggaaagggccuggaauggguggccguuauuagcuacgacggguccaacuauuacuaugcggauucugugaaaggaagauuuacaaucagccgggacaauuccaagaacacggucuaccuccagaugaauagccugcgcggcguggauaccgcuguuuauuacugugccaaagaccuuggcgggggagagguggaagagugggccacagauuacuaugacuggucuauugcuuacccggucgaacaucccagagccguggugggcgucuucgauaucugggggcaaggaaccaagguuacaguguccagc

SEQ ID NO: 40308 - RNA, 432 nt, Artificial Sequence
  derived and/or modified sequence opt5 from anti-HIV_cap256-048-152863_VR-Chain
gaggugcagcugcucgaaagcggcgggggacugguccaacccggcgggucccuuagacugucuugcgccggaagcggcuucaccuuuuccaagcacgggaugcauuggguucggcaggcuccuggaaaaggccucgaguggguggccuucguggcguuugacgaaucugauaaguacuaugcugacagcgucaaaggccgcuucacaaucuccagagauaacucuaagaauacgcugagccuucagaugaacucccugcgggccgaggacaccgccauguacuauugugcuaaagaagugggggauaauaaggacgaugagugggccagcgacuacuaugaucucucuauugcuuacccgguucacgacccccgcgccguggucggaggcuaugauaucugggggcagggaacaauggugaccguuuccagc

SEQ ID NO: 40309 - RNA, 432 nt, Artificial Sequence
  derived and/or modified sequence opt5 from anti-HIV_cap256-048-152770_VR-Chain
caggugcaacuggucgagagcggcgggggaguugugcagcccggcagaucccuccggcugucuugcgccgcuagcggguucaccuuucgcuccaaugccaugcacugggugagacaggcgccuggaaagggccuugaaugggucgcugugaucucuuacgacgggagcaaaacauauuacgccgauuccguuaagggacgguucacgauuucucgcgacaauagcaaaaacacccuguaucuccagaugaacucccugagagccgaggauacagcuguguacuauugugccaaggaccuuggcgaauacaaaagcgaugagugggcuaccgacuauuacgaucugucuaucgccuacccgguccaagacccccggggcguggcgggggccuuugauauuuggggacagggcacaaugguuaccguguccagc

SEQ ID NO: 40310 - RNA, 432 nt, Artificial Sequence
  derived and/or modified sequence opt5 from anti-HIV_cap256-048-150027_VR-Chain
gaggugcagcuggucgaaagcggcgggggacucguucaacccggcgggucccugcggcuuucuugcgccgugagcggauucaccuuuuccucuuacaucaugcacugggugcggcaggcuccuggcaaggggcuggagugggucgccgugauuagcuaugacggauccaacaaagauuacgcggacucuguuaagggccgcuucacaaucagcagagauaauuccaaaaacacgcucuaucugcagaugaauagccuucgggcugaagacaccgcccuguacuauugugccaaggaucuccgcgaguacgaaugcgaggagugggcuucugacuauuacgauuuuggcagagacuacccgugucaggaucccagagggguggucggaacauucgacauuuggggccaagggaccauggugacaguuuccagc

SEQ ID NO: 40311 - RNA, 432 nt, Artificial Sequence
  derived and/or modified sequence opt5 from anti-HIV_cap256-048-148246_VR-Chain
caggugcaacuggucgagagcggcgggggaguugugcagcccggcagaucccuccggcugucuugcgccaccagcggguucacauuuuccacguacucuaugcacugggugcgccaggcuccuggaaagggccuugaaugggucgccgugaucagcuaugacggguccaacgaguacuauguugauucugugaaaggaagauucaccauuagccgggacaauuccaagaacacacuguaccuccagaugaauagccugcgcgucgaagauaccgcgcuuuauuacugugcuaaagaccugggcggcaacaaggaugacgagugggggacagauuauuacgacuuuucuguggccuacccgguucaagaucccagagccguguccggaaucuucgacgucuggggccaugggaccauggugacagugagcucu

SEQ ID NO: 40312 - RNA, 432 nt, Artificial Sequence
  derived and/or modified sequence opt5 from anti-HIV_cap256-048-147428_VR-Chain
caggugcaacuggucgagagcggcgggggaguugugcagcccggcagaucccuccggcugucuugcagcgccuccggguucaccuuuucuaacuacggaaugcacugggugcgccaggcuccuggcaaggggcuugaaugggucgccgugaucagcuucgacggauccaauaaaguuuaugcggauucugugaagggcagauuuacaauuagccgggacaacuccaaaaauacgcuguaccucgagaugaacagccugcgcgcugaagauaccgccgaguauuacugugccaaggaccuuggcgaaucugauaaagaggaguggccguccgacuauuacgauuucgggagagacuuuacaggacaggucccccgggcugugguuggcaucuucgauaugugggggcaaggaaccauggugacagucagcucu

SEQ ID NO: 40313 - RNA, 432 nt, Artificial Sequence
  derived and/or modified sequence opt5 from anti-HIV_cap256-048-146603_VR-Chain
gaggugcagcuggucgaaagcggcgggggacucguucaacccggcagaucccugcggcuuucuugcgccgcuagcggguucaccuuugacgauuacgccauccacugggugcgccaggcgccuggaaagggccuggaguggguggcucucauuuccuaugacgggacagauaaauacuaugccgacucugucaagggaagauucacgaucagccgggauaacuccaaaaauacccuguaccuucagaugaacucucugcgcguggaagacacagccguuuaucauugugcuaaggaucucggcggcaccaaaagcgacgagugggccacagauuacuaugaccuguccauugcuuacccgauccaggaucccggggccguggucggaguguuugacauuuggggccaagggaccaugguuacagugagcucu

SEQ ID NO: 40314 - RNA, 432 nt, Artificial Sequence
  derived and/or modified sequence opt5 from anti-HIV_cap256-048-145735_VR-Chain
caggugcaacugguccagagcggcgggggaguugugcagcccggcagaucccuccggcugucuugcggggccagcggauucaccuuuuccaacuacgcuaugcacugggugcgccaggccccuggcaaggggcuugacugggucgcggugaucucuuaugauggaacaaaugagaaccaugcugacagcguuaaaggcagauucacgauuucccgggauaauucuaagaacaccguguaccugcaaaugaauagccuccgcgccgaagacacagccgucuauuacugugcuaaagaugugggcggguccaaggacgaugagugggccaccgacuauuacgaucugagcaucgcuuauccgguucccgacccuagagccguggucggagcguuugauauuuggggccaggggacaauggugaccgugucuucc

SEQ ID NO: 40315 - RNA, 432 nt, Artificial Sequence
  derived and/or modified sequence opt5 from anti-HIV_cap256-048-145116_VR-Chain
caggugcaccuggucgagagcggcgggggaguugugcaacccggcgggucccucagacugucuugcgccgcuagcggauucaccuuuuccaacuacggcaugcauugggugcggcaggccccugggaagggacuugaaugggucgcggcuaucucuuucgccggcacaaauaaauauuacgccgacagcgugaagggccgcuuuacgauuuccagagauaacucuaaaaaugcucuguaucuccagaugaacagccugcgggccgaggacaccgcucuuuacuauugugccaaggaucugcgcgaauccgagugcgaagagugggcgagcgacuacuaugauuucgggagagacuacccgugucaggauccccggggaguugugggcacacucgacaucugggggcaaggaaccauggucacagugucuucc

SEQ ID NO: 40316 - RNA, 432 nt, Artificial Sequence
  derived and/or modified sequence opt5 from anti-HIV_cap256-048-144077_VR-Chain
caggugaagcuggucgagagcggcgggggaguugugcaacccggcagaucccuccggcugucuugcgccgcuagcggguucacccuuuccucuuacgccaugcacugggugcgccaggcgccuggaaaaggccuggaaugggucgcugugaucagcuaugacggguccaacagauacacagccgauucuguuaagggacgguuuacgauuagccgcgacaauuccaaaaacacccucaaucugcagaugaacagccuuagaccggaggauacagccguguauuacugugcuaaggacgucggcgccaauaaagaugacgaaugggcuaccgauuauuacgaccugucuaucgccuaucccgugccugauccccgggcgguugugggcgccuucgacauuugggggcagggaacaaccgucacaguguccagc

SEQ ID NO: 40317 - RNA, 432 nt, Artificial Sequence
  derived and/or modified sequence opt5 from anti-HIV_cap256-048-142876_VR-Chain
caggugcaacuggucgagagcggcgggggaguugugcagcccggcgggucccucagacugucuugcguggccagcggauucaccuuuuccacauacggcaugcacuggguccggcaggcuccugggaagggacuugaauggguggccuucaugcgcuuugacggcucuaacagauauuacggcgauagcguuaaagggcgguucacgaucucccgcgacaauucuaagaacacccuguaucuccagaugauuagccugagagcggaggauacagcuguguaccauugugccaaagaccuuggaggcaauaagccggaugaaugggccaccgacuauuacgaucuguccaucgcuuaucccguccaagacccucgggccgugguugggguguuugauauuuggggacagggcacaaucauuaccgucagcucu

SEQ ID NO: 40318 - RNA, 432 nt, Artificial Sequence
  derived and/or modified sequence opt5 from anti-HIV_cap256-048-140582_VR-Chain
caggugcaacuggucgagagcggcgggggaguugugcagcccggcagaucccuccggcugucuugcgccgcuagcggguucuccuuuucuaacuacgccauggacugggugcgccaggcgccuggaaagggccuugaaugggucgcuuucgugagcuccgaugggucuaauaaaaacuaugccgacagcguuaagggaagauuuaccaucucccgggauaauagcaaaaacacaguguaccugcagaugaacucucuccgcgucgaggacacggccguguauuacugugcuaaggaucugggcgccaauaaagacgaugaaugggcuaccgacuauuacgaucuuuccguugccuauccggugcccgacccuagagcggucgugggcgccuucgaugugugggggcaaggaacaauggucaccguuagcucu

SEQ ID NO: 40319 - RNA, 432 nt, Artificial Sequence
  derived and/or modified sequence opt5 from anti-HIV_cap256-048-139355_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcuaucauuagcuaugacggguccaacaaauacuaugccgauucugugaagggaagauucacaaucagccgggacaauuccaaaggcacgcuguaccuccagauggauggcccgcgccccgaggacaccgcccuguauuacugugcuaaggaucuuggggaaagagagugcgaagagugggccagcgacuauuacgauuuuggacgggacuucccuugucaagauccccgcggcguuguggggacauuugacauuuggggacagggcaccauggucacagugucuucc

SEQ ID NO: 40320 - RNA, 432 nt, Artificial Sequence
  derived and/or modified sequence opt5 from anti-HIV_cap256-048-139151_VR-Chain
caggugcaacuggucgagagcggcgggggaguugugcagcccggcaagucccucagacugucuugcgccgcuagcggguucaccuuuaacacauacggaaugcacugggugcggcaggccccuggcaaagggcuugaaugggucgcggugaucuccuaugacggaucuauucagaaguacgcugauagcguuaaaggccgcuucacgaucuccagagacaauucuaagaacacccuguaucuccaaaugaauagccuguccguggaggauacagccgucuacuauugugccaaagaccuuggcaagaacaaggaugacgaaugggcuaccgauuacuaugacauuagcaucgccuacccggugcccgauccucgggcuguugugggggucuuugacauuuggggacagggcacaguggugaccgucucuucc

SEQ ID NO: 40321 - RNA, 432 nt, Artificial Sequence
  derived and/or modified sequence opt5 from anti-HIV_cap256-048-137672_VR-Chain
gaggugcagcuggucgaaagcggcgggggaguugccagacccggcgggucccuccggcugucuugcgcugccagcggauucaucuuuacccacuacgcgauggacugggugcgccaagcuccuggcaaggggcuugaguggguggccgucauuuccucugauggaagcuccaaaaacuaugccgacucugugaagggcagauucacaaucagccgggauaauuccaaaaacacgguuagccugcagaugaacucucuccgcccggaagacaccgcuguguacuauugugccaaggaugucggcgcuaauaaagacgaugagugggccacagacuacuaugaucuguccauugcguaccccgugccugaccccagagccguugugggggcuuuugauaucuggggacagggcaccauggucacagugagcucu

SEQ ID NO: 40322 - RNA, 432 nt, Artificial Sequence
  derived and/or modified sequence opt5 from anti-HIV_cap256-048-137506_VR-Chain
caggugagacuggucgacagcggcgggggaguugugcaacccggcgggucccuccggcugucuugcgccgcuagcggauucaccuuuuccacauacggcaugcacugggugcgccaggccccugggaagggacuugagugggucgcguucaucagaucugauggcagcaacaaauauuacgcugacuccgugcagggccgguuuucuauuagccgcgauaauuccaagaacacgcuguaucuccagaugaauagccugagagccgaagacaccgccguuuacuauugugcuaaagaucuuggggagucugacaaggaagaguggccguccgauuacuaugacuucggacgggauuuuacaggccaagacccccgcgccguggucgggguguucgauaucuggggacagggcaccacaguuauugugagcucu

SEQ ID NO: 40323 - RNA, 432 nt, Artificial Sequence
  derived and/or modified sequence opt5 from anti-HIV_cap256-048-137270_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaugagcccggacggguccaacagauauuacacagauucuguuaaaggacgguucacgaucagccgcgacaauuccaagaacacccugagccuccagaugaacucucugagacccgaggauacagccguguauuacugugccaaagacgucggcgcuaauaaggaugacgaaugggccaccgauuauuacgaccuuuccauugcuuauccugugcccgauccucgggccguugugggcgcguuugacaucugggggcaaggaacaauggucaccgugagcucu

SEQ ID NO: 40324 - RNA, 432 nt, Artificial Sequence
  derived and/or modified sequence opt5 from anti-HIV_cap256-048-135447_VR-Chain
gaggugcagcuggucgaaagcggcggggccguugugcaacccggaagaucccuccggcugucuugcaccgcuagcggcuucuccuuuacaucuuacacgauccacugggugcgccaggccccugggaagggacuugagugggucgcguucauuagcuaugacggcaccgagaaaaaguacacagauuccgugaaagggagauuuaccaucucucgggacaacagcaagaauacacugucccuccagaugaacagccugcgcccggaagauaccgcuguuuauuacugugccaaagaccuuggagccucuaaggaugacgaaugggcuacagauuauuacgacuucuccauugccuaucccgugcaggauccuagagcugucgugggcgccuuugacaucuggggccaagggaccaugguuacggugagcucu

SEQ ID NO: 40325 - RNA, 432 nt, Artificial Sequence
  derived and/or modified sequence opt5 from anti-HIV_cap256-048-131966_VR-Chain
caggagcaacugguggaaagcggcgggggagucguucagcccggcagaucccuccggcugucuugcgccgcuagcggguucaccuuuuccaauuacgccaugcacugggugcgccaggcgccuggaaagggccuugaguggguggcugccaugucucaugacgggagcgauaaauauuacgccgacuccgucaagggaagauucacaaucucucgggauaauagcaaaaacacgcuguauaugcagaugaacucccuccgcgcugaagacaccgccguguacuauugugcuaaggaucaaggcgagagcgaaaaagaggagugggccucugacuacuaugauuuuggcagagacuacccggggcaggauccccggcgcguuguggcgacauucgccauuuggggacagggcaccauggucacaguguccagc

SEQ ID NO: 40326 - RNA, 432 nt, Artificial Sequence
  derived and/or modified sequence opt5 from anti-HIV_cap256-048-131008_VR-Chain
gaggugagacuggucgaaagcggcgggggacucguuaagcccggcgggucccugcggcuuucuugcgccgcuagcggauucaccguguccucuaacuacaugagcugggugcgccaggccccuggcaaagggcuggagugggucgcggcuaucuccuuugccggaacaaauaaguauuacgccgacucugugaaaggcagauucacgauuagccgggauaacuccaagaaugcucucuaucugcaaaugaacagccuucgcgccgaagacaccgcucuguacuauugugccaaagaucucagagagucugaaugcgaggagugggcguccgacuacuaugauuuuggccgggacuacccgugucaggauccccgcgggguugugggaacacuggacaucuggggccaggggaccauggucacagugagcucu

SEQ ID NO: 40327 - RNA, 432 nt, Artificial Sequence
  derived and/or modified sequence opt5 from anti-HIV_cap256-048-129369_VR-Chain
caggugcaacuggucgagagcggcgggggaguugugcagcccggcagaucccuccggcugucuugcgccgcuagcggguucaccuuuuccaacuacgugaugcacuggguccgccaggccccuggaaagggccuugaauggguggcgcugguuucuuucgacgggagcaauaaauauuacgcugauuccgugaagggaagauuuacaaucucucgggacaacagcaaaaauacggucuaucuccagaugaacucccugcgcggcguggauaccgccguuuacuauugugccaaggaccuuggcgggggagagguggaagagugggcuacagauuacuaugacuggagcauugccuacccggucgaacaucccagagcuguggugggcgucuucgauaucugggggcaaggaaccaaaguuacagugucuucc

SEQ ID NO: 40328 - RNA, 432 nt, Artificial Sequence
  derived and/or modified sequence opt5 from anti-HIV_cap256-048-128476_VR-Chain
gaggugcagguccuggaaagcggcgggggacucguucaacccggcgggucccugagacuugccugcgcugccucuggauucagcuuuuccucuuacggcaugcacugggugcggcaggcgccugggaagggacuggagugggugagcuucauccgcuaugacggcgcuaacaaauaccaugccgauuccgucaagggcagauuuauuaucucucgggacgauagcaaaaauaccgugucccuccagaugaacagccugcgcccggaagacacagccguuuauuacugugcuaaggaucuuggggccaauaaagacgaugagugggcuacggacuauuacgaucugucuauugccuaucccgugccugaccccagagcggucgugggagccuucgauaucuggggccaggggaccaugguuacaguguccagc

SEQ ID NO: 40329 - RNA, 432 nt, Artificial Sequence
  derived and/or modified sequence opt5 from anti-HIV_cap256-048-128270_VR-Chain
caggugcaacuggucgagagcggcgggggaguugugcagcccggcagaucccuccggcugucuugcaccgccagcggguucacauuucgcuccuacgcuaugcacugggugagacaggccccuggaaagggccuugaaugggucgcgcugaucucuuaugacgggagcaacaaauacuaugcugauuccgugaagggacgguucacgauuucucgcgacaauagcaaaaacacccucuaccugcagaugaacucccuuacaagcgaggauaccgccguuuauuacugugccaaggaccugggcggcucuaaaacagaugaaugggggaccgacuauuacgaguuuuggaaugcuuacccggugcaagaucccagagucgugguuggagccuucgacaucuggggccaugggacaauggugaccgucuccagc

SEQ ID NO: 40330 - RNA, 432 nt, Artificial Sequence
  derived and/or modified sequence opt5 from anti-HIV_cap256-048-126220_VR-Chain
caggugcaacuggucgagagcggcgggggaguugugcagcccggcagaucccuccggcugucuugcgccgcuagcggguucaucuuuuccccuuacgggauucacugggugcgccaggccccgggcaaggggcuugaaugggucgcgcugaucucucaugacggaagcaaaaaguauuacgcugauuccgugaaaggcagauucaccauuucucgggacaacuuuaaggauacacucuaucugcagaugaauagccuucgcggcguugacacggccguguacuauugugccaaagaucugggaggaggcgaggucgaagagugggcuaccgacuacuaugauugguccacagccuaccccguggaacacccuagagcuguugugggggucuucgacaucuggggacaaggcaccaaggugacagugagcucu

SEQ ID NO: 40331 - RNA, 432 nt, Artificial Sequence
  derived and/or modified sequence opt5 from anti-HIV_cap256-048-125713_VR-Chain
gaggugcagcuggucgaaagcggcgggggacucguucaacccggcgggucccugagacuuucuugcgaggccagcggauucuccuuuucuaccuacgaacugaacugggugcggcaggcuccuggcaaggggcucgaguggguggccgucaucagcuaugacggauccaauuacuauuacgcggauucugugaaaggccgcuucacaauuagcagagacaacuccaagaauacgcuguaucuucagaugaacagccugcgggcugaagauaccgccguuuacuauugugccaaagacgugggcgcuaauaaggaugacgagugggccacagauuacuacgaccucucuaucgcuuauccgguccccgauccucgcgccgugguuggggcguuugacauuuggggacagggcaccauggugacagucuccagc

SEQ ID NO: 40332 - RNA, 432 nt, Artificial Sequence
  derived and/or modified sequence opt5 from anti-HIV_cap256-048-123934_VR-Chain
caggugcaacuggucgagagcggcgggggaguugugcagcccggcagaucccuccggcugucuugcgccgcuagcggguucaccuuuuccucuuacggaauggccugggugcgccaggcgccuggcaaggggcuugaaugggucacagcuaucagcuucgccggaacgaacaaauauuacgccgacuccgugaagggcagauuuaccauuucucgggauaauagcaaagacacacuguaucuccagauggauggccugcgcccggaggacaccgcucuuuacuauugugccaaggaucugggggaaagagagugcgaagagugggcuuccgacuacuaugauuucggacgggacuuucccggccaagaucagcgcgccguugcggggguguucgacauguggggacagggcacaauggucaccgugagcucu

SEQ ID NO: 40333 - RNA, 432 nt, Artificial Sequence
  derived and/or modified sequence opt5 from anti-HIV_cap256-048-122673_VR-Chain
gaggugcaggucguugaaagcggcgggggacuggugaagcccggcgggucccucagacugucuugcgccgcuagcggauucaccuuuuccucucacgugaugaacuggguccggcaagccccuggcaaagggcuugagugggugagcuccaucucuggaggcagcuccagcaaggacuacgcggauucuguuaaaggccgcuucacaauuuccagagacaauagcaagaacacgcugucucuccagaugaacucccugcggccggaagauaccgcuguguauuacugugccaaagacgucggggccaauaaggaugacgagugggcuacagauuauuacgaccuuagcaucgccuaucccgugccugauccccgcgcuguugugggagccuuugacauuuggggccaggggaccauggucacagugucuucc

SEQ ID NO: 40334 - RNA, 432 nt, Artificial Sequence
  derived and/or modified sequence opt5 from anti-HIV_cap256-048-122208_VR-Chain
agagugcaggucguugagagcggcgggggaguggugaagcccggcgggucccugcggcucucuugcggagccagcggcuucaccuuuuccaacgcuuggcugucuuggguccgccaagccccugggaaaggacuugaauggguggcgguuaucagcuccgacggcucuagcaagaauuacgcugauuccgugaaaggcagauucacaauuagccgggacaacucuaagaauacggucucccugcagaugaacagccuccgcccggaggauaccgccguguauuacugugccaaagacguuggggcuaauaaggaugacgaaugggccacagauuauuacgaccugucuaucgcuuaucccgugccugaucccagagccgucgugggagcguuugacauuuggggccaggggaccauggugacagucuccagc

SEQ ID NO: 40335 - RNA, 432 nt, Artificial Sequence
  derived and/or modified sequence opt5 from anti-HIV_cap256-048-121552_VR-Chain
caggugcaacuggucgagagcggcgggggaguugugcagcccggcgggucccuccggcugucuugcgccgcuagcggauucaccuuuuccucuuacgccaugcacugggugcggcaggcgccuggcaaggggcuuaaaugggucgcugacaucagcuaugaugccuccucuaaguacuaugccgacagcgugaaaggacgcuucacaauuuccagagauaacagcaagaauacgcuguaccucgaaaugaacucucugcggccggaggacaccgcuguuuauuacugugccaaagaucuuggcgaacgcgagugcgaagagugggcuuccgacuauuacgauuuuggcagagacuuccccugucaggauccuagagggguggucggaacauuugacaucuggggccaagggaccauggugacaguuagcucu

SEQ ID NO: 40336 - RNA, 432 nt, Artificial Sequence
  derived and/or modified sequence opt5 from anti-HIV_cap256-048-120643_VR-Chain
caggugcaacuggucgagagcggcgggggaguugugcagcccggcagaucccuccggcugucuugcgccgcuagcggguucacccuuuccgccuacacaaugcacugggugcgccaggcgccuggaaagggccuggaaugggucucugugaucagcuuugcugggaacaauaaauauuacgccgacuccguuaagggaagauucacgauuucucgggagaacagcaaaaauaugcucuaucugcagaugaacucccuucgcggcgaagauaccgccguguacuauugugcuaaggaccugagagaguuugaaugcgaggagugggccagcgauuacuaugacuucggccgggauuacccgugucaagacccccgcggggucgugggaacauuugauguuuggggccaugggucucucgugaccgucuccagc

SEQ ID NO: 40337 - RNA, 432 nt, Artificial Sequence
  derived and/or modified sequence opt5 from anti-HIV_cap256-048-118458_VR-Chain
caggugcaacuggucgagagcggcgggggaguugugcagcccggcagaucccuccggcugucuugcgccgcuagcggguucaccuuuuccacaucuggaaugcacugggugcgccaggccccuggcaaggggcuugaaugggucgcguucaucagcuccgacagaucuaacaaauuuuacgcugauagcgugaagggacgguucuccauuagccgcgacaauucuaaauauacgcuguaccuccagaugaacucccugagagccgaugacaccgccguuuauuuuugugcuaaggaucuuggcgugaauaaaaacgacgagugggccacagauuacuaugaccugagcgucgcuuacccggugcaagauccccggggcguugccgggaucuucgacauuuggggacagggcaccauggugacagucucuucc

SEQ ID NO: 40338 - RNA, 432 nt, Artificial Sequence
  derived and/or modified sequence opt5 from anti-HIV_cap256-048-118112_VR-Chain
caggagcaacugguggaaagcggcgggggagucguucagcccggcagaucccuccggcugucuugcgccgcuagccaguucaccuuuuccaacuacgggaugcacugggugcgccaggccccuggaaagggccuugugugggucgcggggaucucuuucgcuggaacaaauaaauauuacgccgccagcgugaagggcagauuuacgauuucccgggacaacucuaaaaauacccuguaucuccaaaugaacagccugcgcgcugaggauacagcccuuuacuauugugcuaaggacaugagagaauacgagugcgaagagugggccuccgauuauuacgacuucggccgggauuacccgugucaggacccccgcgggguugugggaaccuuugauaucuggggccaggggacaauggucaccgugagcucu

SEQ ID NO: 40339 - RNA, 432 nt, Artificial Sequence
  derived and/or modified sequence opt5 from anti-HIV_cap256-048-116469_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcuaucauuagcuaugacggguccaauaaauacuaugccgauucugugaagggaagauucacaaucagccgggacaauccgaaaaacacgcuguaccuccagaugaacucccugcgcgccgaggauaccggccuuuauuacugugcuaaggacaugggcgaaagcgagaaagaagagugggccucugauuauuacgacuuugggagagauuaccccggacaagagccucgggcuaugguuggcacauucgacauuugggggcagggaaccauggugacagucuccagc

SEQ ID NO: 40340 - RNA, 432 nt, Artificial Sequence
  derived and/or modified sequence opt5 from anti-HIV_cap256-048-113917_VR-Chain
gaggugcagcuggucgaaagcggcgggggacucguucaacccggcgggucccugagacuuucuugcgccgcuagcggacugaccguguccgacacauacaugaacuggcuccggcaggccccuggcaaggggcuggaguggguggcggucgugucuagcgauggauccaauaaaaacuaugcugacucuguuaagggccgcuucacgaucagcagagauaauuccaaaaacaccguguaccuucagaugaauagccugcgggccgaagacacagccgucuauuacugugcuaaggaucucggcgccaacaaagacgaugagugggcuaccgacuauuacgaucugucuguggccuauccgguucccgacccucgcgcgguggucggggccuuugauguguggggacagggcacaauggugaccgucuccagc

SEQ ID NO: 40341 - RNA, 432 nt, Artificial Sequence
  derived and/or modified sequence opt5 from anti-HIV_cap256-048-112368_VR-Chain
caggugcaacuggucgagagcggcgggggaguugugcagcccggcagaucccuccggcugucuugcgccgcuagcggguucaccuuuucccgcaacgccaugcacugggugagacaggcgccuggaaagggccuugaaugggucgcugugaucucuuacgacgggagcaauaaauauuacgccgauuccguuaagggacgguucacaauuucucgcgacaacagcaaaaauacgcuguaucuccagaugaacucccugagagccgaggauaccgcuguguacuauugugccaaggaccuuggcggcggggaagucgaggaaugggcuacagauuacuaugacuggagcaccgccuacccgguggagcauccccgggcgguugugggagucuuugauaucuggggccaagggacaaaagugaccgugucuucc

SEQ ID NO: 40342 - RNA, 432 nt, Artificial Sequence
  derived and/or modified sequence opt5 from anti-HIV_cap256-048-112047_VR-Chain
gaggugcagcuggucgaaagcggcgggggacucguucaacccggcgggucccugagacuuucuugcgccgcuagcggacugaccguguccggcuacuauaugucuugggugcggcaggccccugggaagggacucgaguggcuggcguucauccacuuugacggcagcaaaauucauuacgcuggcuccgucaaggggcgcaucacagugucuagagauaacagcaaaaauacgcuugaccugcagaugaacucccuccgggccgaagauaccgccguuuauuacugugcuaaggacgugggagauagcaaaucugacgagugggccacagauuauuacgaccuguccgucgcuuauccggugcccgauccucgcgccguugugggcgcguucgacauuugggggcagggaaccauggucacagugagcucu

SEQ ID NO: 40343 - RNA, 432 nt, Artificial Sequence
  derived and/or modified sequence opt5 from anti-HIV_cap256-048-112029_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggggaucagcuucgcuggaauuaaaaaguauuacgccgacuccgugaaaggcagauuuacaaucucucgggauaacagcaagaauacgcuguaucuccaaaugaacucccugcgcggcgaggacaccgcccuuuacuauugugcuaaagaucugagagaauacgagugcgaagagugggccagcgacuauuacgauuucgggcgggacuacccgugucaggauccccgcggaguugugggcauuuuugacaucugggggcagggaacaauggucaccgugucuucc

SEQ ID NO: 40344 - RNA, 432 nt, Artificial Sequence
  derived and/or modified sequence opt5 from anti-HIV_cap256-048-110957_VR-Chain
caggugagacuggucgagagcggcgggggaguugugcgguccggccgcucucucagacugagcugcgccgcuuccggguucaccuuuucuaacuucgcccuucacugggugcggcaagcgcccggaaagggccuggaaugggucgcugugaucagcuacgacggaaauuccaaauuuuaugccgauucuguuaaggggcgcuucacaauuagcacggacaacuccaaaaauacccucuaccugcagaugaacagccuuacagccgaggauaccgcuguguauuacugugccaaggaccugggcggcaauaaagaugacgaaugggggacagauuauuacgacuuuucugucgcuuauccugugcaggauccgagagccguuuccggaaucuucgacguguggggccaugggaccauggucacagugagcucu

SEQ ID NO: 40345 - RNA, 432 nt, Artificial Sequence
  derived and/or modified sequence opt5 from anti-HIV_cap256-048-110526_VR-Chain
caggugcaacuggucgagagcggcgggggaguugugcagcccggcagaucccuccggcugucuugcgccgcuagcggguucaccuuuuccaacuucggauuucacugggugcgccaggccccuggcaaggggcuugaaugggucgcggcuaucucuuucgccggaaauaacaaauacuaugccgacagcgugaagggcagauuuacaauuucccgggaaaauucuaaaaacauccuguaccuccagaugaauagccugcgcggcgaggauacggcuguuuauuacugugccaaggaccuuagagaguucgaaugcgaggagugggcuuccgauuauuacgacuggagcaccgccuauccgguggaacauccccgggcggucguggggguuuuugauauuuggggacaaggcacaaaagugaccgucucuucc

SEQ ID NO: 40346 - RNA, 432 nt, Artificial Sequence
  derived and/or modified sequence opt5 from anti-HIV_cap256-048-109336_VR-Chain
gaggugcagcuggucgaaagcggcgggggacucguucaacccggcgggucccagagacugucuugcgccgcuagcggacuuaccgugaacuccaauuacaugacaugggugcggcaggccccuggcaaggggcuggagugggucgcgaucauuucuagcgacggauccggccaguauuacgcugauucugugaaaggccgcuucacgaucagcagagacaacuccaagaauacccucagccugcaaaugaacucucuucggccggaagauacagccguuuauuacugugccaaagaccugggggcuuccaaggaugacgagugggccaccgauuauuacgacuuuagcauugcuuaucccgugcaggauccucgcgccgucgugggagcguucgacaucuggggccaggggacaaugguuaccgugucuucc

SEQ ID NO: 40347 - RNA, 432 nt, Artificial Sequence
  derived and/or modified sequence opt5 from anti-HIV_cap256-048-108152_VR-Chain
caggcccaacugguggagagcggcgggggagucguucagcccggcagaucccucgugcugucuagcguggcuuccggguucucuuuuagcaccuacgccaugcacuggguccggcaggcgccuggaaagggccuugaauggguggcuguuaucuccuaugacgggggaaacaaauacuaugccgauucugugaagggccgcuucagcauuuccagagacaauagcaaaaacacagucuaccugcagaucaauucucuccgggccgaggauacggcuguguauuacugcgccaaggaccugggcgcuaacaaagaugacgaaugggccaccgauuauuacgaccuuuccguugcguacccggugcccgauccucgcgccgucgugggggcuuuugacguguggggacaaggcacaauggucaccguuagcucu

SEQ ID NO: 40348 - RNA, 432 nt, Artificial Sequence
  derived and/or modified sequence opt5 from anti-HIV_cap256-048-107799_VR-Chain
gaggugcaggucguugaaagcggcgggggaguggugcaacccggcagaucccugcggcucucuugcgccgcuagcggguucaccuuuuccaacuacgccauggacuggguccgccaggcgccuggaaagggccuggaguggguggcuuucguuucuagcgauggguccaauaaaaacuaugccgacucugugaagggaagauuuacaaucagccgggauaauuccaaaaacacgcuuagccugcagaugaacucucuccgcgccgaagacaccgcugucuacuauugugccaaggaggugggcgaaaauaaagaugacgagugggcuuccgauuacuaugaccugagcauugccuacccgauccacgaucccagagcgguugugggcggguucgacauuuggggacagggcacaauggucaccgugucuucc

SEQ ID NO: 40349 - RNA, 432 nt, Artificial Sequence
  derived and/or modified sequence opt5 from anti-HIV_cap256-048-107384_VR-Chain
gaggugagacuggucgaaagcggcggggcccucguuaagcccggaaccucccugcggcuuucuugcgcugccagcggcuucacauuuacgcacuacgcgauggacugggugcgccaggcuccugggaaaggacuggaguggguggccaucauuuccucugauggcagcaccaagaacuaugccgacuccgucaaagggagauucacaaucucucgggauaauagcaagaacacccucucccugcaaaugaauagccuucgcccggaagacacagcuguguacuauugugccaaagauguuggagcuaacaaggacgaugagugggccaccgacuacuaugaucugucuauugcguaccccgugccugaccccagagccgucgugggcgcuuuugauaucuggggccaggggacaaugguuaccguguccagc

SEQ ID NO: 40350 - RNA, 432 nt, Artificial Sequence
  derived and/or modified sequence opt5 from anti-HIV_cap256-048-106530_VR-Chain
gaggugcagcugcucgaaagcggcgggggacugguccaacccggcgggucccuuagacugucuugcgccgcuagcggauucaccuuuuccucuuacgccauggacuggguucggcaggcgccuggcaaggggcucgaguggguggcugugaucagcuccgauggaucuaacaaaaauuaugccgacagcgucaagggccgcuucacaauuuccagagauaacagcaaaaauacgcuguaccuucagaugucuucccugcggccggaagacaccgccguguauuacugugcuaaggauguuggcgacagcaaaucugaugagugggccacagacuauuacgauuuuuccaucgcuuaucccauucaggacccucgcgccguggucggggcguucgauaucuggggacaaggcaccauggugacaguuagcucu

SEQ ID NO: 40351 - RNA, 432 nt, Artificial Sequence
  derived and/or modified sequence opt5 from anti-HIV_cap256-048-106464_VR-Chain
gaggugcagaugguccaaagcggcgggggacugguucagcccggcgggucccucagacugucuugcgccgcuuucggauuuaccuucacaaaccacgccauggacugggugcgccaggugccuggcaaggggcuugaaugggucgcguuuaucagcuccgauggaucuaauaaaaacuacgcugacagcgugaagggccgguucacgauuuccagagauaauucuaaaaacaccguuuaucugcagaugagcucccuccggccggaggacacagccguguacuauugugccaaggaugucggcgacagcaaaucugaugaaugggcuaccgacuacuaugaucuguccguggccuaccccguuccugacccccgcgcuguggucggggccuuugauaucuggggacaaggcacaauggugaccgugagcucu

SEQ ID NO: 40352 - RNA, 432 nt, Artificial Sequence
  derived and/or modified sequence opt5 from anti-HIV_cap256-048-106411_VR-Chain
caggugcaacuggucgagagcggcgggggaguugugcagcccggcagaucccuccggcugucuugcgccgcuagcggguucaccuuuuccuacucuggaaugcacugggugcgccaggccccuggcaaggggauggaaugggucgcggugaucagcuaugacggauccaacaaauacuaugcugauucuguuaagggcagauucacaauuagccgggacaauuccaaaaacacgcuuuaccugcagaugaauagccuccgcguggaggauaccgccgucuaucauugugccaaggaccugggcgggacaaaaucugaugaaugggcuaccgacuacuaugaucuuuccaucgccuacccgauucaagaccccggagcugugguuggcguguuugauaucugggggcagggaacaauggucaccgugagcucu

SEQ ID NO: 40353 - RNA, 432 nt, Artificial Sequence
  derived and/or modified sequence opt5 from anti-HIV_cap256-048-106306_VR-Chain
gaggugcagcuggucgaaagcggcgggggacucguucaacccggcgggucccugagacuuucuugcgaggccagcggauucaccuuuaacaauuacggcauggugugggugcggcaggcuccugggaagggacuggaaugggucgccaucauuuccuaugacggcacagagaaauacuauguggauucuguuaagggccgcuucacgaucagcagagacaacuccaaaaauacccucucucugcagaugaacagccuucgggcggaagauacagcuguguacuauugugccaaggaggucggggagaauaaagacgaugaaugggccuccgacuacuaugaucugagcauugcuuacccgauccacgacccccgcgccgugguuggaggcuuugauauuugggggcagggaaccauggugacagucucuucc

SEQ ID NO: 40354 - RNA, 432 nt, Artificial Sequence
  derived and/or modified sequence opt5 from anti-HIV_cap256-048-104496_VR-Chain
caggugcaacuggucgagagcggcgggggacucguuaagcccggcgggucccugagacuuucuugcgccgcuagcggauucaccuuuuccucuuacggcaugcacugggugcggcaggccccugggaaaggacuggaauggguggcguucgucagcuccgacggcaacaauaagaacuaugcugauucugugaaaggccgcuuuacaaucagcagagacaauuccaagaacacgguuuaccuccagaugaauagccugcggguggaggauaccgccgucuauuacugugccaaagaccuuggggcuaacaaggaugacgaaugggccacagauuauuacgaccugucuguggcuuauccgguucccgauccucgcgccguggucggagcguucgacguguggggccaggggaccauggugacagucuccagc

SEQ ID NO: 40355 - RNA, 432 nt, Artificial Sequence
  derived and/or modified sequence opt5 from anti-HIV_cap256-048-103074_VR-Chain
caggugcaccuggucgagagcggcgccgggguugugcaacccggaggcucccucagacugucuugcgcugugagcggguucaccuuuaacuccuacggaaugcauuggguccggcaggccccuggcaaggggcuugaauggguggcgguuaucucuuaugacggaagcgauaaauacuaugcugacuccgugaagggccgcuucacaauuucuagagauagcuccaaaaauacgcuguaccuccagaugaacagccugcgggucgaggacaccgccguguauuacugugccaaggaucuuggcgcuaauaaagacgaugaaugggccacagacuauuacgaucugucuguugcuuacccggugcccgacccucgcgccgucgugggggcguuugauguguggggacagggcaccauggucacaguuuccagc

SEQ ID NO: 40356 - RNA, 432 nt, Artificial Sequence
  derived and/or modified sequence opt5 from anti-HIV_cap256-048-100832_VR-Chain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugguuagcuccgacggaacaaacaaaaauuauggcgauucugugaagggcagauucacgaucagccgggacaacucccgcaauaccgucuaccugcagaugagcucucucagaccggaggauacagcuguguauuacugugccaaagacguuggggauaccaaguccgacgaaugggccacagauuauuacgacuuuagcauugcuuaucccgugcaagauccucgggccgucgugggagcuuucgacaucuggggccaggggaccauggugacagucucuucc

SEQ ID NO: 40357 - RNA, 432 nt, Artificial Sequence
  derived and/or modified sequence opt5 from anti-HIV_cap256-048-100188_VR-Chain
caggugcaccuggucgagagcggcgggggaguugugcaacccggcagaucccuccggaucuacugcgccgugucugaguucaccuuucgcaacuaugcuaugcauugggucagacuggccccugggaagggacuucaguggguggcgguuauuagcuacaauggcgggaaaaaguauuacgcugacuccgugaaaggacgguucacaaucucucgcgauaacagcaagaaugcccuguaucuccagaugaacucccugagagccgaagacacgggccuuuacuauugugcuaaagaucugcgggaauuugagugcgaagagugggccucugacuacuacgauuucggccgcgaguauccgugucaggaccccagaggggucgugggaaccuuugauauuuggggccaagggacaaugguuaccgugagcucc

SEQ ID NO: 40358 - RNA, 432 nt, Artificial Sequence
  derived and/or modified sequence opt5 from anti-HIV_cap256-048-099645_VR-Chain
caggugcaacuggucgagagcggcgggggaguugugcagcccggcagaucccuccggcugucuugcgccgcuagcggguucaccuuuucccgcuacgcccuucacugggugagacaggcgccuggaaagggccuggaaugggucgcugugaucucuuaugacgggagcuccaaauacuaugccgauucuguuaagggacgguucagcauuucccgcgacaacagcaaauacacacucuaucugcagaugaacucucuuagagccgaugacacggcuguguacuuuugugccaaggaucugggcgucaauaaaaaugacgagugggcuaccgauuauuacgaccucuccguggccuacccgguucaagauccccggggcguggcggggaucuucgacauuuggggacagggcacaauggucaccgugagcucu

SEQ ID NO: 40359 - RNA, 432 nt, Artificial Sequence
  derived and/or modified sequence opt5 from anti-HIV_cap256-048-098137_VR-Chain
caggugcaacuggucgagagcggcgggggaguugugcagcccggcagaucccuccggcugucuugcgccgcuagcggguucacccuucgcaacuacgccaugcacugggugagacaggcgccuggaaagggccuggaaugggucgcugugaucuccucugacgggaauaacaaauauuacgccgauagcguuaagggacgguuuacagugucccgcgacaauucuaaagauacgcucuaucugcagaugaacagccuuagaccggaggacaccgcccuguacuauugugcuaaggaucucggcgaacgggagugcgaagagugggccuccaauuacuaugacuucggccgcgauuaccccugucaagacccuagaggggucgugggaacauuugauauuuggggccaggggaccaugguuacagugagcucu

SEQ ID NO: 40360 - RNA, 432 nt, Artificial Sequence
  derived and/or modified sequence opt5 from anti-HIV_cap256-048-097878_VR-Chain
caggugcaacugcucgagagcggcgggggagucguucagcccggcaagucccugagacuuucuugcgccgcuagcggguucaccuuuaauacauacggaaugcacugggugcggcaggccccuggcaaagggcugcaguggguggcggucaucuccuaugacggaacgauucaaaaguacgcugauucugugaaaggccgcuucaccaucagcagagaaaauuccaagaacaugcucuaucugcagaugaacucucuucggggcgaggacacagccguuuacuauugugccaaagaucugcgcgaauuugagugcgaagagugggcuagcgacuacuaugauuucgggagagacuacccgugucaggauccccggggaguggucggcaccuuugacgugugggggcauggaucccucguuacagugagcucu

SEQ ID NO: 40361 - RNA, 432 nt, Artificial Sequence
  derived and/or modified sequence opt5 from anti-HIV_cap256-048-097510_VR-Chain
caggugcaacuggucgagagcggcgggggaguugugcagcccggcagaucccucuggcugucuugcgccgcuagcgaguucacccuucgguccuacgggaugcacugggugcgccaggccccuggaaagggccuggaaugggucgcguuuguggcuuucgacgaaucugauaaauauuacgccgacagcguuaaggggagauuuacaaucucccgggauaacucuaaaaauacgcucagccugcagaugaacucccuucgcgccgaggacaccgcuguguauuacugugccaaggaagucggagauaauaaagacgaugagugggcuagcgacuauuacgaucugucuauugccuauccggugcaugaccccagagcgguugugggcggcuucgauaucugggggcaaggaacaauggucaccguguccagc

SEQ ID NO: 40362 - RNA, 432 nt, Artificial Sequence
  derived and/or modified sequence opt5 from anti-HIV_cap256-048-097313_VR-Chain
caggugcaacuggucgagagcggcgggggacucguucagcccggcggggcccugagacuuuccugccuggugucuggauucaccuuugacgauuacgcucuccacugggugcggcaggccccuggcaaggggccggaaugggucgcggugcugagcuccgacggaucuuauaaauacuauacagagagcguucagggccgcuucacgaucuccagagauaacucuaagaauaccguguaccuucaaaugaacagccugcggggcgucgacacagcuguguauuacugugccaaagaucucgggggaggcgaaguugaggaaugggccaccgacuauuacgauugguccauugcuuaccccguggagcauccucgcgccgucguggggguguuugacaucuggggacagggcacaaaggucaccguuagcucu

SEQ ID NO: 40363 - RNA, 432 nt, Artificial Sequence
  derived and/or modified sequence opt5 from anti-HIV_cap256-048-096626_VR-Chain
gaggugcagcuggucgaaagcggcgggggacucguucaacccggcgagucccugagacuuucuugcgccgggagcggauucaccuuuuccucuuacuggaugagcugggugcggcaggcuccuggcaaggggcuggaauggauggcccucaucuccuaugacggaucuaacaaauacuauguggauagcgucaagggccgcuucacaauuuccagagacaauagcaaaaacacgcuguaccuucagaugaacucucugcgggcggaggauaccgcuguguauuacugugccaaggaccucggcgggaauaaagaugacgaaugggccacagauuauuacgaccuguccaucgcuuacccgguucaggauccccgcguggucgugggaauuuuugacaucuggggccaagggaccaugguuacagugagcucu

SEQ ID NO: 40364 - RNA, 432 nt, Artificial Sequence
  derived and/or modified sequence opt5 from anti-HIV_cap256-048-096483_VR-Chain
gaggugcagcuggucgaaagcggcgggggacucguucaacccggcagaucccugcggcuuucuugcgccgcuagcggguucuccuuugaggacuacgccaugcacugggugcgccaggcgccuggaaagggccuggaauggguggcugggaucucuuucgccggaaccaaaaaguauuacgccgauagcgucaaaggcagauuuacaauuucccgggacaacucuaagaaugcucucuaucugcagaugaacagccuucgcgccgaggauacggcucuguacuauugugccaaagaccucagagaauacgagugcgaggaaugggcguccgauuauuacgacuucggccgggauuacccgugucaggacccccgcggggugguuggaaccuuugauaucuggggccaagggacaauggugaccgucagcucu

SEQ ID NO: 40365 - RNA, 432 nt, Artificial Sequence
  derived and/or modified sequence opt5 from anti-HIV_cap256-048-095691_VR-Chain
caggugcaacuggucgagagcggcgggggaguugugcagcccggcagaucccuccggcugucuugcgccgcuagcggguucaccuuuuccucuuacggaauggccugggugcgccaggcgccuggcaaggggcuugaaugggucacagcuaucagcuucgccggaacgaacaaauauuacgccgacuccgugaagggcagauuuaccauuucucgggauaauagcaaagacacacuguaucuccagauggauggccugcgcccggaggacaccgcucuuuacuauugugccaaggaucugggggaaagagagugcgaagagugggcuuccaacuacuaugacuucggacgggauuaccccugucaagacccucgcggcguuguggggacauuugauaucuggggacagggcaccauggucacagugagcucu

SEQ ID NO: 40366 - RNA, 432 nt, Artificial Sequence
  derived and/or modified sequence opt5 from anti-HIV_cap256-048-095525_VR-Chain
caggugcaacugguccagagcggcggguccguugugcagcccggaaagucucucagacugagcugcgccgcuuccggcuucaccuuuucuagcuucgggaugcacugggugcggcagacaccuggaaaaggccuugagugggucgccgugaucuccuacgacgggucugaaaagagcuaugcggauuccguuaaaggacgcuuuacgauuagcagagacaacucuaagaauacccuguaccuccaaaugaacucccugcgggcugaggauacagccguguauuacugugccaaagaccuuggcggcaccaaggaugacgaaugggcuacagauuauuacgacaucagcauugccuauccgguccaggauccccgcgcuguggccggggcguucgacaucuggggacagggcaccaugguuacagugucuucc

SEQ ID NO: 40367 - RNA, 432 nt, Artificial Sequence
  derived and/or modified sequence opt5 from anti-HIV_cap256-048-094783_VR-Chain
gaggugcagcuggucgaaagcggcgggggacugguuaagcccggcgggucccugagacuuucuugcgccgcuagcggaaucaccuucuccacauacgagaugaacugggugcggcaagccccuggcaaagggauggaauggguggcggucauuucuuaugacggaagcaauaaguacuaugcugauuccgugaaaggccgcuuuacgaucucuagagacaacagcaagaauaccguuuaccugcagaugaacucccuccggggcguggauacagccgucuauuacugugccaaagaccucgggggaggcgagguggaagagugggcuaccgauuauuacgacuggagcauugccuacccgguugagcacccccgcgcuguggucgggguguucgauaucuggggacagggcacaaaggugaccgucucuucc

SEQ ID NO: 40368 - RNA, 432 nt, Artificial Sequence
  derived and/or modified sequence opt5 from anti-HIV_cap256-048-094356_VR-Chain
caggugcaacuggucgagagcggcgggggaguugugcagcccggcagaucccuccggcugucuugcgccgcuagcggguucaucuuuacccacuacgccauggacugggugcgccaggcgccuggaaagggccuugaaugggucgcugugauuuccucugaugggagcuccaaaaacuaugccgacucuguuaagggaagauucacaaucagccgggauaauuccaaaaacacggugagccugcagaugaacucucuccgcccggaggacaccgccgucuacuauugugcuaaggaugugggcgacaauaaauccgaugaaugggccacagacuacuaugauuuuagcauugcuuaccccguuccugaccccagagccguggucggcgcguucgaucugugggggcaaggaaccauggugacagugucuucc

SEQ ID NO: 40369 - RNA, 432 nt, Artificial Sequence
  derived and/or modified sequence opt5 from anti-HIV_cap256-048-090756_VR-Chain
caggugcaacuggucgagagcggcgggggaguugugagacccggccggucccuccgccugucuugcgccgugagcggguucaccuuuuccaauuacgcuauccacugggucagacaggccccuggaaagggccuugaauggguggcgguuauuucuuaugacgggagcgauaaauacuaugcugacuccgugaagggacgguucacaaucucucgcgagaauagcaaaaacaugcuguaccuccagaugaacucccugagaggcgaagauacggccgucuauuacugugccaaggaccuucgggaguuugaaugcgaggagugggcuagcgauuauuacgacuucggccgcgauuacccgugucaggaccccagaggggugguuggaaccuuugauguguggggccaugggucucuggucacaguguccagc

SEQ ID NO: 40370 - RNA, 432 nt, Artificial Sequence
  derived and/or modified sequence opt5 from anti-HIV_cap256-048-089065_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgggacgaacaaauacuauguggauagcguuaagggaagauucaccauuucccgggacaauucuaaaaacacacucuaccugcagaugaauagccuuaccgccgaggauacagccguguauuacugugcuaaggaccugggcggcaacaaagaugacgaaugggggaccgauuauuacgacuuuuccgucgccuacccggugcaagauccccgcgcuguuagcggaaucuucgacguguggggccaugggacaauggucaccgugucuucc

SEQ ID NO: 40371 - RNA, 432 nt, Artificial Sequence
  derived and/or modified sequence opt5 from anti-HIV_cap256-048-084986_VR-Chain
caggugcaacuggucgagagcggcgggggaguugugcagcccggcagaucccuccggcugucuugcgccgcuagcggguucaccuuuuccgacuacgccaugcacugggugcgccaggcgccuggaaagggccuugaaugggucgcucugaucucuuaugaugggagcaacaaauacuaugccgacuccgugaagggaagauucacaauuucucgggauaauagcaaaaacacgcucuaccugcagauguccagccuuaccgccgaggacacagcuguuuauuacugugccaaggaucugggcggcaauaaaaacgacgaaugggcuaccgauuauuacgaccucucuaucgccuacccgauucaugauccccgcgcggugcugggggccuuugacgucuggggacaaggcacaaugcugaccguguccagc

SEQ ID NO: 40372 - RNA, 432 nt, Artificial Sequence
  derived and/or modified sequence opt5 from anti-HIV_cap256-048-083355_VR-Chain
caggugcaacuggucgagagcggcgggggaguugugcagcccggcagaucccuccggcugucuugcgccgugagcggguucaucuuuuccucuuacgcuaugcgcugggucagacaggccccuggaaagggccuugaauggguggcgguuauuagcuaugacggguccaaaaccaacuacgcugauucugugaagggacgguucacaaucagccgcgacaauuccaaaaacacgcuguaucuccagaugaauagccugaccucugaggauacagccgucuacuauugugccaaggaccuuggcggcuccaaaaccgaugaaugggggacagacuacuaugaguuuuggaacgcuuacccggugcaagaucccagaguuguggucggagccuucgacauuuggggccacgggaccauggugacagugagcucu

SEQ ID NO: 40373 - RNA, 432 nt, Artificial Sequence
  derived and/or modified sequence opt5 from anti-HIV_cap256-048-082462_VR-Chain
caggugcaccuggucgagagcggcgggggaguugugcaacccggcaagucccucagacugucuugcaccgccagccgguucaucuuucgcaacuacgcuauggacugggugagacaggccccugggaaaggacuugaaugggucgcggugauuuccuaugauggcguuaaggagcauuacgcugaaucugugaaagggcgguucacaaucagccgcgacaauuccaagaacacggucuaucugcagaugaacucucucagaguggaggauaccgccguuuacuauugugccaaagaccugggagcuaauaaggaugacgaaugggccacagauuacuaugaccuuagcguggcuuacccgguccccgauccucgggccguggugggcgcguuugacgucuggggccaggggaccaugguuacaguguccagc

SEQ ID NO: 40374 - RNA, 432 nt, Artificial Sequence
  derived and/or modified sequence opt5 from anti-HIV_cap256-048-082246_VR-Chain
caggugcaccuggucgagagcggcgggggaguugugcaacccggcagaucccuccggaucucuugcgccgcuagcggguucaccuuuuccaagaaugccaugcauugggugcgccaggcgccuggaaaaggccuggaaugggucgcuuucguggccuuugacgagucugauaaguacuaugccgacagcguuaaagggagauucacaauuucccgggauaauucuaagaacauccuuagccugcagaugaacucccuccgcgcugaagacacggccguguacuauugugcuaaagaggucgaugaauacaaggacgaugagugggccagcgacuauuacgaucugucuauugcguauccggugagagacccccgggccguugugggaggcuuugauaucuggggccaggggaccauggucacaguguccgcu

SEQ ID NO: 40375 - RNA, 432 nt, Artificial Sequence
  derived and/or modified sequence opt5 from anti-HIV_cap256-048-080752_VR-Chain
caggugcaacuggucgagagcggcgggggaguugugcagcccggcgggucccucagacugucuugcgccgcuagcggauucaccuuuuccaauuacggcaugcacugggugcggcaggccccugggaagggacuugaaugggucgcguucauccgcuaugacggcgauauuacauacuauguggacucuguuaaaggcagauuuacgaucagccgggauaauuccaagaacgcucuguaccuccagaugaacucucugcgcgccgaggacaccgcccuuuauuacugugcuaaagaucugagagaauaugagugcgaagagugggccagcgacuacuacgauuucgggcgggaguauccgugucaagacccccgcggaguggucggcacauuugauauuugggggcagggaaccauggugacaguuuccagc

SEQ ID NO: 40376 - RNA, 435 nt, Artificial Sequence
  derived and/or modified sequence opt5 from anti-HIV_cap256-048-078409_VR-Chain
caggugcaacuggucgagagcggcgggggaguugugcagcccggcagaucccuccggcugucuugcgccgcuagcggguucaccuuuaacaauuacgccauggacugggugcgccaggcgccuggaaagggccuugaaugggucgcucugaucuccuaugaugggucuaacaaauacuaugccgagagcgugaagggaagauucacaauuucccgggacaauucuaaaaacacgcucuaccugcagaugaauagccuucgcgccgaagauaccgcuguuuauuacugugccaaggacgugggcgagaaacaauccaugaugagaugggcuacagauuauuacgaccugagcaucgccuacccgguccccgauccucgggcggugguuggcgccuuugaccucugggggcgcggaaccauggugacagucucuucc

SEQ ID NO: 40377 - RNA, 432 nt, Artificial Sequence
  derived and/or modified sequence opt5 from anti-HIV_cap256-048-078273_VR-Chain
gaggugcagcuggucgaaagcggcgggggacucguucaacccggcgggucccugagacuuucuugcgccgcuagcggauucaccguguccucuaacuacaugagcugggugcggcaggccccuggcaaggggcuggagugggucgcggugaucuccucugacggaagcaauaaaaacuaugcugauuccguuaagggccgcuuuacaauuagcagagacaauucuaaaaacacccucuuccugcagaugaacucccuucggccggaagauacggccguguacuuuugugccaaggaccugggcgcuaauaaagaugacgagugggccacagauuauuacgaccucagcaucgcuuaucccguccacgauccucgcgccgugguugggauuuucgaccuguggggacagggcaccauggugacagucucuucc

SEQ ID NO: 40378 - RNA, 432 nt, Artificial Sequence
  derived and/or modified sequence opt5 from anti-HIV_cap256-048-078062_VR-Chain
gacguguaccuggucgagagcggcgggggacucguucagcccggcgggucccugagacuuucuugcaccgccagcggaaucacauucuccacguaugaaaugaauugggugcggcaagcuccuggcaaggggcuggaguggguggccuuugucgcguucgauggaucugacaaauacuaugcugauagcgugaagggccgcuuuguuauuuccagagacaauucuaaaaacacccucagccugcagaugaacucccuucgggccgaagauacagccguguacuauugugcuaaggaggucggcgaagacaaagaugacgagugggccagcgauuacuaugaccugucuaucgcuuacccggugcacgauccccgcgccguugucgggggauucgacauuuggggccaggggaccauggugacaguguccagc

SEQ ID NO: 40379 - RNA, 432 nt, Artificial Sequence
  derived and/or modified sequence opt5 from anti-HIV_cap256-048-077798_VR-Chain
caggugcaacuggucgagagcggcgggggaguugugcagcccggcagaucccuccggcugucuugcgccgcuagcggguucaccuuuuccaacuacggaaugcacugggugcgccagacaccuggcaaggggcuugaaugggucgccgugaucucuuaugacggaagcaauaaauucuacgcggauuccguuaagggcagauuuacgauuucucgggacaacagcaaaaauacccuguaucuccagaugaacucccugcgcguggaggauacagcugucuaccauugugccaaggaccuuggcgggagcaaaucugaugaaugggccaccgacuauuacgauugguccaucgcuuauccggugcacgaccccagagccguugugggagucuucgauauuuggggccaagggacacuggugaccgugagcucu

SEQ ID NO: 40380 - RNA, 432 nt, Artificial Sequence
  derived and/or modified sequence opt5 from anti-HIV_cap256-048-073853_VR-Chain
gaggugcagcuggucgaaagcggcgggggacucguuaagcccggcgggucccugagacuuucuugcgccgcuagcggauucaccuuuuccgacgccuggaugaacugggugcggcaagcgccuggcaaagggcuggaguggguggcuggaaucucuuucgccggcacaaauaaguacuaugccgauagcgucaaaggccgcuuuacgauuuccagagacaacucuaagaauacccucuaccugcagaugaacagccuucgggcugaagauacagcccuguauuacugugcuaaagacaugcgcgaguaugaaugcgaggagugggccuccgauuacuaugacuucgggagagauuacccgugucaggacccccggggagugguuggcaccuuugauaucugggggcagggaacaauggugaccgucagcucu

SEQ ID NO: 40381 - RNA, 435 nt, Artificial Sequence
  derived and/or modified sequence opt5 from anti-HIV_cap256-048-071661_VR-Chain
caggugcaacuggucgagagcggcgggggaguugugcagcccggcagaucccucgggcugucuugcgaagugagcggauucaccuuuuccgacuacuucaugucuuggauccggcaggccccuggcaaggggcuugagugggucgcugugauuagccacgauggaaacaauaaauauuacccggacuccguucagggccgcuuuacaaucucuagagaaaacagcaagaauacgcuguaucuccaaaugaacucccugaaacccgaggauaccgccguguacuucugugcgaaggaccuuggcggggaaagcgaggucgaggaaugggcuucugauuauuacgacuuuggacgggauauuccuggccccgacccucgcggggugguuggaacacuggauaucuggggccaugggaccauggugacagucuccagc

SEQ ID NO: 40382 - RNA, 432 nt, Artificial Sequence
  derived and/or modified sequence opt5 from anti-HIV_cap256-048-071360_VR-Chain
caggugcaacuggucgagagcggcgggggaguugugcagcccggcagaucccuccggcugucuugcgccgcuagcggguucacccuuacaaacuacgccauggacugggugcgccaggcgccuggaaagggccuggaaugggucgcugugaucuccucugaugggagcaauaaaaacuaugaggacuccguuaagggaagauuuacgauuucucgggauaauagcaaaaacacccucuaccugcagauguccagccuucgcccggaagacacagccguguauuacugugccaaggaugucggcgacaauaaaucugaugagugggcuaccgacuauuacgauuucuccaucgccuaucccgugccugaccccagagcuguugugggcgccuuugaucugugggggcaaggaacaauggucaccgugagcucu

SEQ ID NO: 40383 - RNA, 432 nt, Artificial Sequence
  derived and/or modified sequence opt5 from anti-HIV_cap256-048-070955_VR-Chain
gaggugcagcuggucgaaagcggcgggggacucguucaacccggcggguccgugagacugucuugcgccgugagcggauucaccuuuuccucuuacuggaugagcuggguccggcaggcuccuggcaaggggcuugaguggguggccguuaucuccgacucuggaagcaauaaauauuacgcggauuccgugaagggccgcuucacaauuagcagagacaauucuaaaaacacgcuguaucuccagaugaacucccugcgggcugaagauaccgccgucuacuuuugugccaaggaccuuggcgggcgcgagacagaagagugggcuagcgauuauuacgacuucggaagagauuuuccgggccaggaccaacgggccguggcugggguuuucgauauguggggacagggcaccauggugacagucucuucc

SEQ ID NO: 40384 - RNA, 432 nt, Artificial Sequence
  derived and/or modified sequence opt5 from anti-HIV_cap256-048-070061_VR-Chain
gaggugcagcugcucgaaagcggcgggggacugguccaacccggcgggucccuuagacugucuugcgccgcuagcggauucaccuuuuccucuuacgccaugcacuggguucggcaggcgccuggcaaggggcucgaguggguggcugugacaagcuaugacggauccaacaaauacuaugccgauucugucaagggccgcuucacgaucagcagagacaauuccaaaaacacccuguacaugcagaugaauagccuucgggccgaagauacagcuguguauuacugugccaaggaccagggcgagucugaaaaagaggagugggcuuccgauuauuacgacuuugggcgcgauuacccgggaagagacccccggcgcguuguggccaccuucgcgauuuggggccaagggacaauggucaccgugagcucu

SEQ ID NO: 40385 - RNA, 432 nt, Artificial Sequence
  derived and/or modified sequence opt5 from anti-HIV_cap256-048-069669_VR-Chain
caggugcaacuggucgagagcggcgggggaguugugcagcccggcagaucccuccggcugucuugcgccgugagcggguucaccuuuuccaaguucccuaugcacuggguccgccaggcuccgggaaaaggccuugaauggguggccguuaucucuuacgacgggaacaagaaauauuacguggauagcgcgaagggaagauuuacaauuucccgggacaauucucgcaaaacgcuguaucuccagaugaccggccugagacccgaggauacagcugucuacuauugugccaaggaccuuggcgggggagaaugcgagaccugggccagcgauuacuaugacuucggcaaggauuacccuugucuggacccccgggaugugguugggacauuugacaucuggggacaaggcacccucgugacagucuccagc

SEQ ID NO: 40386 - RNA, 432 nt, Artificial Sequence
  derived and/or modified sequence opt5 from anti-HIV_cap256-048-069205_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgugguuaucagcaaugacgggaauaacaaauauuacgcugauuccgugaagggaagauucacaauuucucgggacaauagcaaaaacacggucuaucugcagaugaacucccuccgcgccgaggauaccgccguguacuauugugcuaaggacguuggcgauaccaaaaaggacgaaugggccacagauuacuaugaccugagcaucgcuuacccggugcaagauccccaggccgucgugggcgcguuugacauuugggggcagggaacaauggugaccgucucuucc

SEQ ID NO: 40387 - RNA, 432 nt, Artificial Sequence
  derived and/or modified sequence opt5 from anti-HIV_cap256-048-068882_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgggacggauaaauacuaugccgacagcgugaagggaagauucaccauuucccgggauaacucuaaaaauacaguuuaccuccagaugaacagccugcgcggcguggacaccgccgucuauuacugugcuaaggaucuuggcgggggagagguggaagagugggccacagacuauuacgauugguccaccgcuuacccgguugaacaucccagagccguggucggcguguuugacaucugggggcaaggaacaaaagugaccgucagcucu

SEQ ID NO: 40388 - RNA, 432 nt, Artificial Sequence
  derived and/or modified sequence opt5 from anti-HIV_cap256-048-067764_VR-Chain
gaggugcagcugguccaaagcggcgggggacucguuaagcccggcgggucccugagacuuucuugcgccgcuagcggauucaccuuuuccacauacucuaugaacugggugcggcaggccccuggcaaagggcuggaauggguggcggucaucagcuccgacggaucuagcaagaauuaugcugauuccgugaaaggccgcuucacgauuagcagagacaacucuaagaauaccguuucccuccagaugaacagccugcggccggaggauacagccguguacuauugugccaaagacgucggcgcuaauaaggaugacgaaugggccaccgauuacuaugaccuuucuaucgcuuaccccgugccugauccccgcgccguugugggggcguuugacauuuggggacagggcacaauggucaccguguccagc

SEQ ID NO: 40389 - RNA, 432 nt, Artificial Sequence
  derived and/or modified sequence opt5 from anti-HIV_cap256-048-066845_VR-Chain
caggugcugcucgucgagagcggcgggggaguugugcaacccggcgggucccugacccuuucuugcgccgcuagcggauucacauuuuccaacuacggcaugcacugggugcggcaggccccugggaagggacuggaaugggucgcguucauccgguaugacggcaauaacaaauacuaugcugauucugugaagggccgcuuuacgauuagcagagacaauuccaaagauacccucuaccugcagauggacgggcuucggccggaggauacagcccuguauuacugugccaaggaccucggagaacgcgagugcgaagagugggcuucuaacuauuacgauuucggcagagacuaccccugucaggauccuagagggguugugggaaccuuugacaucuggggccaagggacaauggucaccgugagcucc

SEQ ID NO: 40390 - RNA, 432 nt, Artificial Sequence
  derived and/or modified sequence opt5 from anti-HIV_cap256-048-065226_VR-Chain
gaggugcagcuggucgaaagcggcgggggacucguuaagcccggcgggucccugagacuuucuugcguggccagcggauucaccuuuuccaacuacggcaugcacugggugcggcaagcuccugggaaaggacuggucuggguggccggcaucucuuucgcgggcacaaauaaguauuacgcugccagcguuaaagggcgcuuuacgauuuccagagacaacucuaagaauacccucuaucugcagaugaacagccuucgggccgaggauacagcucuguacuauugugccaaagacaugcgcgaauacgagugcgaagagugggcuuccgauuauuacgacuucggaagagauuacccgugucaggacccccggggcguggucgggaccuuugauaucuggggacagggcacaauggugaccguuagcucu

SEQ ID NO: 40391 - RNA, 432 nt, Artificial Sequence
  derived and/or modified sequence opt5 from anti-HIV_cap256-048-063717_VR-Chain
caggugcaacuggucgagagcggcgggggaguugugcagcccggcagaucccuccggcugucuugcgccgcuagcggguucuccuuuucuaaccacgccauggacugggugcgccaggcgccuggaaagggccuugaaugggucgcugugaucagcuccgaugggucugacaaaauuuacgccgagagcguuaagggaagauucaccaucucccgggauaauagcaaaaacacacuguaucuccagaugaacucucugcgcguggaagacacggccgucuacuuuugugcuaaggaucuuggcgccaauaaagacgaugagugggcuaccgacuauuacgaucuguccauugccuauccggugcccgacccuagagcgguugugggcgccuucgauaucugggggcaaggaacaauggucagcgugucuucc

SEQ ID NO: 40392 - RNA, 432 nt, Artificial Sequence
  derived and/or modified sequence opt5 from anti-HIV_cap256-048-063150_VR-Chain
gaggugcagcuggucgaaagcggcgggggaguugugcaacccggcagaucccuccggcugucuugcgccgcuagcggguucaccuuuuccucuuacgccaugcacugggugcgccaggcgccuggaaagggccuugagugggucgcucauaucagauaugacgggagcaacaaauacuauauugauuccgugcagggacgguucacaaucucucgcgacaauccgaagaacacgcuguaccuccagaugaauagccugagaaccgaagauacagccguuuauuacugugccaaagaccuuggcggcggggagguggaagagugggcuaccgauuauuacgacugguccauugccuaccccgucgagcacccucgggcugugguuggaguguuugauaucuggggccaagggacaaaggucaccgugagcucu

SEQ ID NO: 40393 - RNA, 432 nt, Artificial Sequence
  derived and/or modified sequence opt5 from anti-HIV_cap256-048-062431_VR-Chain
caggugcaacuggucgagagcggcgggggaguugugcagcccggcagaucccuccggcugucuugcgccgcuagcggguucaccuuuuccaacuucgccauggacugggugcgccaggcgccuggaaagggccuugaaugggucgcugugaucucuagcgauggguccaaaaagaauuacggagacucuguuaaaggcagauuuacaauuagccgggauaacuccaagaauacgcuguuccuccagaugaacagccugcgcccggaggacaccgcccuuuauuacugugccaaagaucugggcggguauaagucugacgaaugggcuacagauuacuaugaccucuccaucgccuaccccgugcaagauccuagacccuggcuggagcugcucuauauuuggggacagggcgcuauggucaccgugagcucu

SEQ ID NO: 40394 - RNA, 432 nt, Artificial Sequence
  derived and/or modified sequence opt5 from anti-HIV_cap256-048-060745_VR-Chain
caggugcaacuggucgagagcggcggguccguugugcagcccggaagaucucuccggcugaccugcacagccagcggcuucacguuuucccacuacgcuauggacugggugcgccaggccccugggaagggacuugaaugggucgcggugaucucuagcgaugcuaccaacaaaaauuaugccgacuccguuaagggcagauucacaauuucucgggauaacagcaaaaauaccguguaccugcagauggacucccuccgcgccgaggauacagcugucuauuacugugccaaggacgugggggauuauaaagacgaugaaugggcuaccgacuacuaugauuuuagcaucgccuacccgguucccgacccuagagcgguggucggagccuucgauuuuuggggccaaggcacaauggugaccgugucuucc

SEQ ID NO: 40395 - RNA, 432 nt, Artificial Sequence
  derived and/or modified sequence opt5 from anti-HIV_cap256-048-060420_VR-Chain
caggugcaacuggucgagagcggcgggggaguugugcagcccggcagaucccuccggcugucuugcgccgcuagcggguucaccuuuuccucuuacggaauggccugggugcgccaggcgccuggcaaggggcuugaaugggucacagugaucagcuucgcuggaguuaaaaaguauuacgccgacuccgugaaaggcagauuuacgauuucucgggauaauagcaagggcacccuguaucuccagaugaacucccugcgcgccgaggacacagcugucuacuauugugccaaagaugugggggacaccaagaaggaugaaugggcuacagacuacuaugaucuuagcaucgccuacccgguucaagacccccaggcgguggucggagccuucgauauuuggggccaggggaccauggugacagugucuucc

SEQ ID NO: 40396 - RNA, 435 nt, Artificial Sequence
  derived and/or modified sequence opt5 from anti-HIV_cap256-048-060014_VR-Chain
caggugcaacuggucgagagcggcgggggaguugugcagcccggcagaucccuccggcugucuugcgccgcuagcggguucaccuuuuccaauuacggaaugcacugggugcgccaggccccuggcaaggggcuugaaugggucgcgcugaucucucaugacggaagcaauaaaaacuucgcugauuccgugaagggcagauuuacaauuucucgggacaauagcaaaaacacgcucuaucugcagaugaacucccuucgcaccgaggauacagccaucuacuauugugccaaggaccugggcggggaaagcgagauugaagaguggccgucugauuacuaugacuucggaagagauuaccccguuccugacccccggggcguggucgggaccuuugauuucuggggacaaggcacaauggugaccguuuccagc

SEQ ID NO: 40397 - RNA, 432 nt, Artificial Sequence
  derived and/or modified sequence opt5 from anti-HIV_cap256-048-059747_VR-Chain
caggugcaacuggucgagagcggcgggggaguugugcagcccggcagaucccuccggcugucuugcgccgcuagcggguucaccuuuacacacuacgccauggacugggugcgccaggcgccuggaaagggccuugaaugggucgcugugaucuccucugaugggagcuccaaagacuaugccgauucuguuaagggaagauucacgauuagccgggacaacuccaaaaauacccugagccuccagaugaacucucugcgcccggaggauacagccguguacuauugugcuaaggaccuuggcgccuccaaagaugacgaaugggcuaccgauuacuaugaccugagcaucgccuaccccguccaugauccuagagcggugguuggcggguuugacauuuggggacaaggcacaauggugaccgucucuucc

SEQ ID NO: 40398 - RNA, 432 nt, Artificial Sequence
  derived and/or modified sequence opt5 from anti-HIV_cap256-048-058393_VR-Chain
caggugcaacuggucgagagcggcgggggaguugugcagcccggcgggucccucagacugucuugcgccgcuagcggauucaccuuuaacacauacggcaugcacugggugcggcaggccccugggaagggacuugaaugggucacguucauccgcuaugacggcuccaaugaguacuaugcggauucugugaaaggcagauuuaccauuagccgggacaacuccaagaauacacuguaccuccagaugaacucucugagcguugaagauaccgcuguguauuacugugccaaagaccuugggaagaauaaagaugacgagugggccacagauuauuacgacaucuccauugcuuacccgguccccgauccucgcgccgugguuggaguguucgacaucuggggccaagggaccgucgugacagugagcucu

SEQ ID NO: 40399 - RNA, 432 nt, Artificial Sequence
  derived and/or modified sequence opt5 from anti-HIV_cap256-048-058159_VR-Chain
caggugcaacuggucgagagcggcgggggaguugugcagcccggcagaucccuccggcugucuugcgccgcuagcggguucaccuuuuccucuuacccuaugcacugggugcgccaggccccgggaaagggccuugaaugggucgcggugaucagcuucgcugggacaaauaaauauuacgcccauuccguuaagggaagauuuacgauuucucgggacaauagcaaaaacacccuguaucuccagaugaacucccugcgcgccgaggauacagcucuuuacuauugugccagagaccugcgggaaagcgagugcgaagagugggcuucugauuacuaugacuucggccgcgaguaccccugucaagauccuagaggcguggucgggaccuuugacaucuggggacggggcacaauggugaccguuuccagc

SEQ ID NO: 40400 - RNA, 432 nt, Artificial Sequence
  derived and/or modified sequence opt5 from anti-HIV_cap256-048-057127_VR-Chain
gacguguaccuggucgagagcggcgggggacucguucagcccggcgggucccugagacuuucuugcguggccagcggaaucaccuucuccucuuauggcaugcacugggugcggcaagcuccugggaagggacuggaaugggccgcguuuauucgcuacgauggcagaaacaaauauuacgcugacagcgucaagggccgguucacaaucucccgcgauaauucuaaaaacacgcucagccugcagaugaauaaccuuagagccgaggacaccgccguguauuacugugcuaaggaaguuggggauaauaaagacgaugagugggccuccgacuauuacgaucugagcauugcuuacccggugcaggacccccgggccgucgugggaggcuaugauaucugggggcagggaacaaugguuaccgugucuucc

SEQ ID NO: 40401 - RNA, 432 nt, Artificial Sequence
  derived and/or modified sequence opt5 from anti-HIV_cap256-048-056251_VR-Chain
gaggugcagcuggucgaaagcggcgggggacucguucaacccggcagaucccugcggcuuucuugcgccgggagcggauucaccuuuuccaacuucggcuuucacugggugcgccaggcuccugggaagggacuggaguggguggccgcgaucucuuucgcuggcuacaauaaauauuacgccgacagcgucaagggcagauuuacaauuucccgggaaaacucuaauaacaugcucuaucugcagaugagcucccuucgcgccgaggauacggcuguguacuauugugccaaagaccugagagaaagcgagugcgaggaaugggcuucugauuacuaugacuucgggaaggauuacccgugucaggacccccggggaguugugggcaccuuugaugucugggggcauggaucccucgugacaguuagcucu

SEQ ID NO: 40402 - RNA, 432 nt, Artificial Sequence
  derived and/or modified sequence opt5 from anti-HIV_cap256-048-055421_VR-Chain
caggugcaacuggucgagagcggcgggggaguugugcagcccgccagaucccuccggcugucuugcgcugccagcggcuucaucuuuuccaccuacgggaugcacugggugcgccaggcgccuggaaagggccuugaaugggucgcugugauuucuagcgacggguccucuaaagauuaugccgacagcguuaagggaagauucacaaucucccgggauaacagcaaaaauacgcugucucuccagaugaacucccugcgcccggaggacaccgccguguacuauugugcuaaggaucuuggcgccagcaaagacgaugaaugggcuacagacuacuaugauuuuucuauugccuaccccguccaagacccuagagcggugguuggcgccuucgauaucugggggcagggaaccauggugacagucuccagc

SEQ ID NO: 40403 - RNA, 432 nt, Artificial Sequence
  derived and/or modified sequence opt5 from anti-HIV_cap256-048-054989_VR-Chain
caggugcaacuggucgagagcggcgggggaguugugcagcccggcgggucccucagacugucuugcgccgcuagcggauucaccuuuuccacaaacggcaugcacugggugcggcaggccccugggaagggacuugaaugggucgcguucauccgcuacgacggcucuaauaaauauuacgcugauagcgugaagggcagauuuacgauuucccgggacaacucuaaaaauaccguuuaucugcagaugaacagccuccgcgggguggauacagccgucuacuauugugccaaggaccugggaggcggggagguggaagagugggcuaccgauuacuaugacugguccaucgccuacccgguugaacaucccagagcuguggucggaguguucgauauuuggggccaagggacaaaagugaccgucagcucu

SEQ ID NO: 40404 - RNA, 435 nt, Artificial Sequence
  derived and/or modified sequence opt5 from anti-HIV_cap256-048-054759_VR-Chain
caggugcaacuggucgagagcggcgggggaguugugcagcccggcagaucccuccggcugucuugcgccgcuagcggguucuccuuuucuaagaacggaaugcacugggugcgccaggccccuggcaaagggcuugaaugggucgcguucguggcuuuugacgagagcgauaaguacuaugccgacuccguuaaaggaagauucaccaucucucgggauaauagcaagaacacacugucccuccagaugaauagccugcgcguggaagacacggccgucuacuauugugcuaaagaggugggcgaaaacaaggaugacgagugggccgcuccggauuacuaugacuuuucuauugccuaccccguucaagauccuagagcgguggucggcggguucgacaucuggggacagggcaccauggugacaguguccagc

SEQ ID NO: 40405 - RNA, 432 nt, Artificial Sequence
  derived and/or modified sequence opt5 from anti-HIV_cap256-048-052573_VR-Chain
caggugaagcuggucgagagcggcgggggaguugugcaacccggcagaucccuccggcugucuugcgccgcuagcggguucuccuuuucuaacuacgccauggacugggugcgccaggcgccuggaaaaggccuugaaugggucgcugugguuagcuccgaugggucuaauaagaacuaugccgacagcgugaaaggaagauucaccaucucccgggauaauagcaagaacacagucuaccugcagaugaacucucuccgcgccgaggacacggcuguguauuacugugccaaagaucugggcgcuaauaaggacgaugaaugggccaccgacuauuacgauugguccauugcguauccgguucacgaccccagagccguggucggcguguuugauaucugggggcagggaacacuugugaccgucagcucu

SEQ ID NO: 40406 - RNA, 432 nt, Artificial Sequence
  derived and/or modified sequence opt5 from anti-HIV_cap256-048-051477_VR-Chain
caggagcaacugguggaaagcggcgggggagucguucagcccggcagaucccuccggcugucuugcgccgcuagcggguucaccuuuuccaauuacgccaugcacugggugcgccaggcgccuggaaagggccuugaguggguggcugccaugucucaugacgggagcgauaaauauuacgccgacuccgucaagggaagauucacaaucucucgggauaauagcaaaaacacgcuguauaugcagaugaacucccuccgcgcugaagacaccgccguguacuauugugcuaaggaucaaggcgagagcgaaaaagaggagugggccucugacuacuaugaucuguccauugcguacccgauccaggaccccagagccaugguuggcgcuuuugauauuugggggcagggaacaauggugaccgucagcucu

SEQ ID NO: 40407 - RNA, 432 nt, Artificial Sequence
  derived and/or modified sequence opt5 from anti-HIV_cap256-048-051299_VR-Chain
caggugcaacuggucgagagcggcgggggaguugugcagcccggcagaucccuccggcugucuugcgccgcuagcggguucaccuuuuccacauucggaaugcacugggugcgccaggccccuggcaaggggcuugaaugggucgcgcugaucucucaugacggaaacaauaaauacuaugcugauagccucaagggcagauuuacgauuucccgggagaacucuaaaaauacccuguuccuucagaugaacagccugcgcgccgaagacacauccguguacuauugugccaaggaucucggcgacagcgagugcgaagagugggcuucugauuacuaugacuuugggaaagauuacccgugucugcaccccagaggaguugugggcaccuucgacuuuugggggcauggaacaauggucaccguguccagc

SEQ ID NO: 40408 - RNA, 432 nt, Artificial Sequence
  derived and/or modified sequence opt5 from anti-HIV_cap256-048-050815_VR-Chain
caggugcaacuggucgagagcggcgggggaguugugcagcccggcgggucccucagacugucuugcguggucagcggauucaccuuuuccucuuacggcaugcacugggugcggcaggccccugggaagggacuugaauggguuagcuucauccgcuuugacggcaacuaugaguacuauguggauuccgucaaaggcagauucacaauuucucgggacaauagcaagaacacgguguaccugcagauggauucccuccgcgcugaagacaccgccguuuauuacugugcgaaagaugugggggacuauaaggaugacgagugggcuacagauuacuacgacuuuagcaucgccuauccgguccccgauccuagagccguggugggagcuuucgacuuuuggggccaagggaccauggucacaguuucuucc

SEQ ID NO: 40409 - RNA, 432 nt, Artificial Sequence
  derived and/or modified sequence opt5 from anti-HIV_cap256-048-049884_VR-Chain
caggugcaacuggucgagagcggcgggggaguugugcagcccggcagaucccuccggcugucuugcgccgcuagcggguucuccuuuaacaccuacgccaugcacugggugcgccaggcgccuggaaagggccuugaauggauggcucugaucucuuaugacgggagcaauaaauacuaugucgauuccgugaagggaagauucacaauuucucgggacaacagcaaaaauacgcucuaccugcagaugaacucccuucgcgccgaggauaccgccguuuauuacugugcuaaggaccugggcggcaauaaagaugacgaaugggccacagauuauuacgaccucagcaucgcuuacccggugcaagaucccagagucgugguugggauuuuugacaucuggggacagggcaccauggugacagucucuucc

SEQ ID NO: 40410 - RNA, 432 nt, Artificial Sequence
  derived and/or modified sequence opt5 from anti-HIV_cap256-048-049170_VR-Chain
caggugcaacuggucgagagcggcgggggaguugugcagcccggcagaucccuccggcugucuugcgccgcuagcggguucaucuuuuccucuuacggaaugcacugggugcgccaggccccuggcaaggggcuugaaugggucgcggugauuagcggagacggcaccaaaaaggauuucgcugacuccguuaaaggcagauuuacaaucucuaaggauaacagcaaaaauauggugucccugcagaugaacagccuccgggccgaggacgccgcugucuauuacugugccaaggaucugggggaaucugacaaugaggaauggccguccgauuauuacgacuucggacgcgauuuuacgggccaaaaccccagagcugugguugggaccuucgaccuuuggggacagggcacaauggugaccgucagcucu

SEQ ID NO: 40411 - RNA, 435 nt, Artificial Sequence
  derived and/or modified sequence opt5 from anti-HIV_cap256-048-048531_VR-Chain
caggugcaacuggucgagagcggcgggggaguugugcagcccggcagaucccuccggcugucuugcgccgcuagcggguucaccuuuuccucuuacggacuucacugggugcgccaggccccuggcaaggggcuggaaugggucgcguucaucagcuaugacggaaacaauaaacauuacguggauuccguuaagggcagauuuacaauuucucgggacaacagcaaaaauacgcucuaucugcagaugaacucccuucgcgcugaggauaccgccguguacuauugugccaaggaccugggcggggaaagcgagaucgaagagugggcuacagauuacuaugacuucucuauugccuacccggucaaagaguccagaggagugguuggcaucuuugauaugugggggcaaggaaccauggugacagucagcucu

SEQ ID NO: 40412 - RNA, 432 nt, Artificial Sequence
  derived and/or modified sequence opt5 from anti-HIV_cap256-048-048259_VR-Chain
caggugcaacuggucgagagcggcgggggaguugugcagcccggcagaucccuccggcugucuugcgccgcuagcggguucaccuuuuccacaugugccaugcacugggugcgccaggcgccuggaaagggccuugaaugggucgcugugaucucuuacgacgggagcaacaaauauuacguugauuccgugaagggaagauucacgauuucucgggacaauagcaaaaacacccuguaucuccagaugaacucccugcgcgccgaggauacagccgucuacuauugcgcuaaggaaguggacaucaauaaagaggaugaaugggccagcgacuacuaugauuuuucuauugcuuacccgguucaagaccccagagccguggucggcggcuucgauaucugggggcagggaaccauggugacaguguccagc

SEQ ID NO: 40413 - RNA, 432 nt, Artificial Sequence
  derived and/or modified sequence opt5 from anti-HIV_cap256-048-047313_VR-Chain
caggugcaacuggucgagagcggcgggggaguugugcagcccggcagaucccuccggcugucuugcgccgcuagcggguucaccuuuuccacauucggaaugcacugggugcgccaggccccuggcaaggggcuugaaugggucgcggugaucucucaugacggaaacaauaaauacuaugcugauagcguuaagggcagauuuacgauuucccgggacaacucuaaaaauaccguguaccugcagaugaacagccuccgcgccgaggauacagccgucuauuacugugcuaaggaccugggcgccaauaaagaugacgaaugggcuaccgauuauuacgaccuuuccguggccuauccgguucccgauccuagagcgguggucggggccuucgacguguggggacaaggcacaauggugaccgucagcucu

SEQ ID NO: 40414 - RNA, 432 nt, Artificial Sequence
  derived and/or modified sequence opt5 from anti-HIV_cap256-048-046596_VR-Chain
caggugcaacuggucgagagcggcgggggaguugugcagcccggcgggucccucagacugucuugcgccgcuagcggauucaccuuuuccucuuacggcaugcacugggugcggcaggccccugggaagggacuugaaugggucgcguucaugcgcuuugacggcagcaauagauauuacggcgauuccgugaaagggcgguucacaaucucucgcgacaauagcaagaacacgcuguaucuccagaugaacucccugagaaccgaggaugcugcccuuuacuauugugccaaagacaugcgggaauuugagugcgaagagugggcuagcgauuacuaugacuucggacgcgauuacccgugucaagaccccagaggcguuguggggauuuuugauaucuggggacagggcacaauggucaccgugucuucc

SEQ ID NO: 40415 - RNA, 432 nt, Artificial Sequence
  derived and/or modified sequence opt5 from anti-HIV_cap256-048-044781_VR-Chain
caggugcaacuggucgagagcggcgggggaguugugcagcccggcagaucccuccggcugucuugcgccgcuagcggguucaccuuuacauccuacgccauccacugggugcgccaggcgccuggaaagggccuugaaugggucgcugugauuucuuaugacgggagcaaaaagaauuacgccgauuccguuaaaggaagauucacgaucucucgggacaauagcaagaacacccuguaugugcagaugaacucccuccgcgccgaggauacagcugucuacuauugugccaaagaagugggcgaggacaaggaugacgaaugggcuagcgauuacuaugaccugucuauugccuacccgguucaugaucccagagcgguggucggcggguuugacaucuggggacaaggcaccauggugacaguguccagc

SEQ ID NO: 40416 - RNA, 432 nt, Artificial Sequence
  derived and/or modified sequence opt5 from anti-HIV_cap256-048-042599_VR-Chain
caggugcaacuggucgagagcggcgggggaguugugcagcccggcagaucccuccggcugucuugcgccgcuagcggguucaccuuuuccaacuacggaaugcacugggugcgccagacaccuggcaaggggcuugaaugggucgccgugaucucuuaugacggaagcaauaaauucuacgcggauuccguuaagggcagauuuacgauuucucgggacaacagcaaaaauacccuguaucuccagauguccagccugcgcgcugaugacacagccguguacuauugugccaaggaggucggcgaagauaaagacgaugagugggcuucugacuacuaugaucuuuccaucgccuacccggugcaugaccccagagcuguugucgggggauucgauauuuggggccaagggaccauggugacagugagcucu

SEQ ID NO: 40417 - RNA, 432 nt, Artificial Sequence
  derived and/or modified sequence opt5 from anti-HIV_cap256-048-041276_VR-Chain
caggugcaacuggucgagagcggcgggggaguugugcagcccggcagaucccuccggcugucuugcgccgcuagccgcuucaccuuuuccucuuacgccaugcacugggugagacaggcgccugggaagggacuugaaugggucgcuaucauuagcuaugacggcuccaacaaauacuaugccgauucugugaaggggcgguucacaaucagccgcgacaauuccaaaaacacgcuguuucuccagaugaauagccugagagccgaggauaccgcucuuuacuauugugccaaggaccugggaggcuacaaaucugaugaaugggcuacagacuauuacgaucucuccauugccuacccgauccaagacccccgggcgguugugggcgccuucgauauuugggggcagggaaccauggucacagugagcucu

SEQ ID NO: 40418 - RNA, 432 nt, Artificial Sequence
  derived and/or modified sequence opt5 from anti-HIV_cap256-048-040200_VR-Chain
caggugcaacuggucgagagcggcgggggaguugugcagcccggccggucccuccggcugucuugcguggccagcggguucaccuuuuccucuuucggaaugcacuggguccgccaggcuccuggcaaggggcuugaauggguggccguuaucagccaugacggacacaauaaauacuaugcggauucccugaagggcagauuuacagugucucgggagaauagcaaaaacacccucuuccugcagaugaacucccuucgcgcugaagacacgagcgucuacuauugugccaaggaucugggcgggggagagugcgaagagugggccucugacuacuaugauuuuggcagagacuacccgugucucacacccagaggggugguuggaaccuucgauauuuggggccaugggacaaccgugacagucuccagc

SEQ ID NO: 40419 - RNA, 432 nt, Artificial Sequence
  derived and/or modified sequence opt5 from anti-HIV_cap256-048-039061_VR-Chain
gaggugcagcugcugggcagcgggggaggccugguccaacccgggggaucccuuagacugaccugcgccguuucuggcuucacauuuagcuccuucgcuaugucuugggugcggcaggccccugggaagggacucgaauggguggcgcugaucagcuacgacggcacggauaaauauuacgcugacuccgucaagggccgcuuuaccauuucuagagauaacagcaaaaauacacuuuaucugcagaugaacucccuccggguggaggacaccgccaucuaccacugugccaaggaucucgggggaacaaaaagcgacgaaugggcuaccgauuauuacgaccugucuauugccuauccgauccaggaucccggcgcuguugugggggucuucgacauuuggggacaaggcacaauggugaccguuuccagc

SEQ ID NO: 40420 - RNA, 432 nt, Artificial Sequence
  derived and/or modified sequence opt5 from anti-HIV_cap256-048-038515_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgugguuaucucuuaugacgggagcaauaaauacuaugcugauuccgugaagggaagauucacgauuucucgggacaauagcaaaaacacccuguuucuccagaugaacucccugcgcgccgaggauacagcccuuuacuauugugcuaaggacgucggcgaauacaaaagcgaugagugggccaccgacuauuacgaucugucuaucgcuuacccgauucaagaccccagagccauggugggcgcguucgauaucugggggcagggaacaaugguuaccguguccagc

SEQ ID NO: 40421 - RNA, 432 nt, Artificial Sequence
  derived and/or modified sequence opt5 from anti-HIV_cap256-048-038255_VR-Chain
caggugcaacuggucgagagcggcgggggaguugugcagcccggcagaucccuccggcugucuugcgccgcuagcggguucacccuuuccucuuacgccaugcacugggugcgccaggcgccuggaaagggccuggaaugggucgcugugaucagcuaugacggguccaacaaauacuaugccgauucuguuaagggaagauuuacaauuagccgggacaauuccaaaaacgcccucuaccugcagaugaauagccuucgcgcugaggauacggcccuguauuacugugcuaaggaccucagagaauaugagugcgaagagugggccucugauuacuacgacuucggccgggauuauccgugucaagacccccgcggcguggucgggaccuuugauaucuggggacagggcacaauggugaccguuuccagc

SEQ ID NO: 40422 - RNA, 432 nt, Artificial Sequence
  derived and/or modified sequence opt5 from anti-HIV_cap256-048-038177_VR-Chain
caggugcaacuggucgagagcggcgggggaguugugcagcccggcagaucccuccggcugucuugcgccgcuagcggguucaccuuuaauacauacggaauccacugggugcgccaggccccuggcaaggggcuugaaugggucgcgcugauuuccuaugacggaacggauaaauacuaugcugacucugugaagggcagauucaccaucagccgggauaauuccaaaaacacacucuaccugcagaugaacucucuucgcguugaggacaccgccauuuaucauugugccaaggaucugggcgggacaaaaagcgacgaaugggcuaccgauuacuaugaccucuccaucgccuacccgauucaagaucccggagcuguggucggcguguuugacaucugggggcagggaacaaugguuaccgugagcucu

SEQ ID NO: 40423 - RNA, 432 nt, Artificial Sequence
  derived and/or modified sequence opt5 from anti-HIV_cap256-048-035513_VR-Chain
caggugcaacuggucgagagcggcgggggaguugugcagcccggcagaucccuccggcugucuugcgccgcuagcggguucaccuuuuccucuuacggaauggccugggugcgccaggcgccuggcaaggggcuugaaugggucacagugaucagcuucgcuggaguuaaaaaguauuacgccgacuccgugaaaggcagauuuacgauuucucgggauaacagcaagggcacccuguaucuccagauggacgggcugcgcccggaggauacagcccuuuacuauugugcuaaagaccugggagaaagagagugcgaagagugggccuccgauuacuaugacuucggccgggauuuucccugucaagacccucgcggggucgugggaaccuucgauaucuggggccaggggacaaugguuaccgugagcucu

SEQ ID NO: 40424 - RNA, 432 nt, Artificial Sequence
  derived and/or modified sequence opt5 from anti-HIV_cap256-048-034112_VR-Chain
cagaugcaacugguggagagcggcgggggagucguucagcccggcagaucccuccggcugucuugcgccgcuagcggguucaccuuuaacuccuacgccaugcacugggugcgccaggcgccuggaaagggccuugaauggguggcugucaucucuuaugacgggagcaauaaauacuaugccgauuccgugaagggaagauucacaauuucucgggacaacagcaaaaauacgguuuaccugcagaugaacucccuccgcggcguggauaccgccgucuauuacugugcuaaggaccugggcgggggagagguggaagagugggccacagauuauuacgacuggagcaucgcuuacccgguugaacaucccagagccguggucggcguguuugauauuugggggcaaggaaccaaagugacagucucuucc

SEQ ID NO: 40425 - RNA, 432 nt, Artificial Sequence
  derived and/or modified sequence opt5 from anti-HIV_cap256-048-033983_VR-Chain
caggugcaacuggucgagagcggcgggggaguugugcagcccggcgaaucccucagacugucuugcgccgcuagcggguucacccuuuccucucacggaauccauugggugcggcaggccccuggcaaggggcuggagugggucgcguuuauuagcuccgacggaucuaacaaaaauuacggcgauagcgugaagggccgcuucacaaucuccagagacaacagcaaaaauacgcucuuucugcagaugaacucucuucgggcugaagauaccgcccuguauuacugugccaaggacguuggggaguauaaauccgaugaaugggcuacagacuacuaugaucucagcauugccuacccgauccaagacccccgcgcuauggugggagccuucgauauuuggggccaggggaccauggucacagugucuucc

SEQ ID NO: 40426 - RNA, 432 nt, Artificial Sequence
  derived and/or modified sequence opt5 from anti-HIV_cap256-048-032688_VR-Chain
caggugcaacuggucgagagcggcgggggaguugugcagcccggcagaucccuccggcugucuugcgccgcuagcggguucaucuuuaacuccuacggaaugcacugggugcgccaggccccuggcaaggggcuugaaugggucgcggugguucauggagacggcggcaauaaauauuacgcugauucugugaaggggagauucaccauuagccgggacaacuccaaaaauacacuguaucucgagaugaacucucugcgcgccgaagauacggccgaguacuauugugcuaaggaccuuggagaaagcgauaaagaggaguggccguccgacuacuaugauuuuggcagagacuucaccgggcaggucccccgggccgugguuggagcuuuugauaucuggggccaagggacaauggugaccgucagcucu

SEQ ID NO: 40427 - RNA, 432 nt, Artificial Sequence
  derived and/or modified sequence opt5 from anti-HIV_cap256-048-031092_VR-Chain
caggugcaacuggucgagagcggcgggggaguugugcagcccggcagaucccuccggcugucuugcgccgcuagcggguucuccuuuuacaauuucgccauggacugggugcgccaggcgccuggaaagggccuugaaugggucgcugugaucucuagcgaugggggaaauaaaaacuauguugacuccgugaagggcagauuuaccauuucucgggauaauagcaaaaacacacuguaccuccagaugaacucccugcgcgccgaggacacggccgucuauuacugugcuaaggaucuuggcgggaccaaagacgaugaaugggccacagacuauuacgauaucagcauugcuuauccggugcaagaccccagagccguugcgggagccuucgauaucuggggccaggggaccauggugacagucucuucc

SEQ ID NO: 40428 - RNA, 435 nt, Artificial Sequence
  derived and/or modified sequence opt5 from anti-HIV_cap256-048-030464_VR-Chain
caggugcaacuggucgagagcggcgggggacucguuaagcccggcgggucccugagacuuucuugcgaagccagcggauucuccuuuaccaacuacuauaugucuuggauccggcaggcuccuggcaaagggcuggaguggguggccgugauuagcuucaauggacgcaacaaguacuaugcggacuuugucaaaggcagauucacaaucucccgggauaauucuaagaacacgcucagccugcagaugaacucccuucgcguggaagacaccgcuguuuacuauugugccaaagaggugggcgaaaauaaggaugacgagugggccgcuccggauuacuaugacuuuagcauugccuaccccguccaggauccuagagcugugguugggggauucgacaucuggggccaagggacaauggugaccgucucuucc

SEQ ID NO: 40429 - RNA, 432 nt, Artificial Sequence
  derived and/or modified sequence opt5 from anti-HIV_cap256-048-030289_VR-Chain
caggugcaacuggucgagagcggcgggggaguugugcagcccggcgggucccucagacugucuugcgccgcuagcggauucaccuuuuccucuuacggcaugcacugggugcggcaggccccugggaagggacuugaaugggucgcguucauccgcuaugacggcagcaacaaauacuaugcugauuccgugaagggcagauuuacaauuucucgggacaauagcaaaaacacgguuuaccugcagaugaacucccuccgcguggaggauaccgccgucuauuacugugccaaggaccugggggcuaauaaagaugacgaaugggccacagauuauuacgaccuuagcguggcuuacccgguucccgauccuagagccguggucggagcguucgacguguggggccaagggaccauggugacagucucuucc

SEQ ID NO: 40430 - RNA, 432 nt, Artificial Sequence
  derived and/or modified sequence opt5 from anti-HIV_cap256-048-030261_VR-Chain
caggugcaacuggucgagagcggcgggggaguugugcagcccggcgggucccucagacugucuugcgccgcuagcggauucaccuuuuccacauucggcaugcacugggugcggcaggccccugggaagggacuugaaugggucgcggugaucucucaugacggcagcaauaaauacuaugcugauucccugaagggccgcuuuacgauuucuagagagaauagcaaaaacacccucuaccugcagaugaacucccuucggcuggaagacacagccguuuaucacugugccaaggaucucgggggaagcaaaucugacgagugggcuaccgauuacuaugaccuguccguggccuacccgguccaagauccccgcgcugugguuggcguguucgacaucugggggcagggaacaauggucaccgugagcucu

SEQ ID NO: 40431 - RNA, 432 nt, Artificial Sequence
  derived and/or modified sequence opt5 from anti-HIV_cap256-048-029362_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggggaucagcuucgcuggaacaaauaaauauuacgccgacuccgugaagggcagauuuacgauuucucgggauaauagcaaaaacacccuguaucuccaaaugaacucccugcgcacagaggacgccgcucuuuacuauugugccaaggauaugagagaguucgaaugcgaagagugggcuagcgacuacuaugauuuuggccgggacuacccgugucaggauccccgcgggguugugggaaucuucgacauuuggggccaggggaccauggucacagugucuucc

SEQ ID NO: 40432 - RNA, 432 nt, Artificial Sequence
  derived and/or modified sequence opt5 from anti-HIV_cap256-048-027638_VR-Chain
caggugcaacuggucgagagcggcgggggaguugugcagcccggcagaucccuccggcugucuugcguggccagcggguucaucuuuuccucuuacggcauucacuggguccgccaggcuccuggaaaggggcuugaauggguggccguuaucagcggagacggcaccaauaaauauugugcggauuccgugaagggcagauucacaauuucucgggacaauagcaaaaacacggucuuucugcagaugaacucccuccgcgcugaggauaccgccguguucuacugcgccaaggaccugggggaaagcgauaaagaggaauggccgucugacuauuacgauuuuggaagagacuucacaggccaaguuccccgggcuguggucggggccuuugauaucuggggacagggcaccauggugacaguguccagc

SEQ ID NO: 40433 - RNA, 432 nt, Artificial Sequence
  derived and/or modified sequence opt5 from anti-HIV_cap256-048-027613_VR-Chain
gugcagcaacuggucgagagcggcggggacguugugcagcccggaaccucccugagacugucuugcgaagccagcggccuuauccuguccggguacggacuccacugggugcggcaggcuccuggcaaggggauggagugggucgccgugauuucuuaugauggaagcaauaaauacuaugcggacuccguuaagggccgcuucacaaucucuagagauaauagcaaaaacacgguguaccugcagaugaacucccuucggggcgucgacaccgcuguguauuacugugccaaggaucucgggggaggcgaaguugaggaaugggccacagacuauuacgauuggagcaccgcuuacccgguggagcauccccgcgccgucguggggguguuugacauuuggggacaaggcacaaaagucaccguuucuucc

SEQ ID NO: 40434 - RNA, 432 nt, Artificial Sequence
  derived and/or modified sequence opt5 from anti-HIV_cap256-048-026627_VR-Chain
caggugcaacugcucggcagcgggggaggcuccguccagcccgggggaucucugagacuuaccugcgccguuagcggcuucacauuuuccucuuucgcuaugagcugggugcggcaggccccugggaagggacuggaguggguggcguuuaucuccucugacggcacgaacaaaaauuacggcgauagcgucaaggggcgcuucaccauuuccagagacaacagcaaaaauacacucuuucugcagaugaacucucuucgggcugaagauaccgcccuguauuacugugccaaggaccucggaggcuauaaauccgaugagugggcuacagacuacuaugaucugagcaucgccuacccgauucaagacccccgcgcugugguuggggccuucgauaucuggggacagggcaccauggugacagucucuucc

SEQ ID NO: 40435 - RNA, 432 nt, Artificial Sequence
  derived and/or modified sequence opt5 from anti-HIV_cap256-048-026239_VR-Chain
cagaugcaacugguggagagcggcgggggagucguucagcccggcagaucccuccggcugucuugcgccgcuagcggguucaccuuuaacuccuacgccaugcacugggugcgccaggcgccuggaaagggccuugaauggguggcugucaucucuuaugacgggagcaauaaauacuaugccgauuccgugaagggaagauucacaauuucucgggacaacagcaaaaauacgcuguaccuccagaugaacucccugcgcaccgaggaugccgcucuuuauuacugugccaaggacaugagagaauuugagugcgaagagugggcuagcgauuauuacgacuucggccgggauuacccgugucaagacccccgcggcguuguggggaucuuugauauuuggggacagggcacaauggucaccgugucuucc

SEQ ID NO: 40436 - RNA, 432 nt, Artificial Sequence
  derived and/or modified sequence opt5 from anti-HIV_cap256-048-025518_VR-Chain
caggugcaacuggucgagagcggcgggggaguugugcagcccggcagaucccuccggcugucuugcgccgugagcggguucaccuuuucccagcacgcuaugcauuggguccgccaggccccuggaaagggccuugaaugggugacacugaucucuaacgacgggacggagaaauucuacgcggauagcguuaagggaagauuuaccauuucccgggacaauucuaaaaacacacucuaucugcaaaugaauagccuuuccguggaagauaccgcugucuacuauugugccaaggaccugggcaaaaacaaggaugacgagugggccacagauuacuaugacaucagcauugcuuacccggugcccgauccucgcgccguugugggcgucuucgacaucugggggcagggaaccguggugacagucucuucc

SEQ ID NO: 40437 - RNA, 432 nt, Artificial Sequence
  derived and/or modified sequence opt5 from anti-HIV_cap256-048-024854_VR-Chain
caggugcaacuggucgagagcggcgggggaguugugcagcccggcagaucccucacccugucuugcgccgcuagcggguucacauuuaauaauuacgacaugcacugggugcggcaggccccuggaaagggccuugaaugggucgcguucacgcgcuaugauggguccaaccaguacuaugcugacucugugaccggaagauuuacaaucagccgggauaauuccaaaaacaccguuuaccugcaaaugaacucucuccgcggcguggacacagccgucuauuacugugccaaggaucugggcgggggagagguggaagagugggcuaccgacuauuacgauuggagcauugccuacccgguugaacaucccagagcuguggucggcguguucgacaucugggggcagggaacaaaagugaccgucuccagc

SEQ ID NO: 40438 - RNA, 432 nt, Artificial Sequence
  derived and/or modified sequence opt5 from anti-HIV_cap256-048-024537_VR-Chain
caggugcaacuggucgagagcggcggggccguugugcagcccggaagaucccuccggcugucuugcguggcuagcggcuucaccuuuuccucuuacgccaugcacuggguccgccaggcgccugggaagggacuugacuggguggcucugaucagcuaugauggcuccaacaaauacuucgccgacucuguuaaggggagauuugccauuagccgggauaauuccaaaaacacacucuaucugcagaugaauagccuucgcccggaagacacggcuguguacuauugugccaaggaucugggaggcggcgagugcgaaaccugggcuucugacuacuaugauuucgggaaagacuaccccugucucgauccuagagacgucgugggaacauuugauaucuggguucaaggcacccuggugacagucuccagc

SEQ ID NO: 40439 - RNA, 432 nt, Artificial Sequence
  derived and/or modified sequence opt5 from anti-HIV_cap256-048-021781_VR-Chain
caggugcaccuggucgagagcggcgggggacucguuaagcccggcgggucccugagacuuucuugcgaagccagcggauucuccuuuucuaacuacgcuauggacugggugcggcaagccccuggcaaagggcuggaguggguggcguucgucagcuccgauggaucuaauaagaacuaugcugacagcgugaaaggccgcuuuaccaucuccagagauaauagcaagaacacaguuuaccuccagaugaacucucugcggguggaagacacggccgucuauuacugugccaaagaucuuggcgcuaauaaggacgaugagugggccaccgacuauuacgaucuguccguggcuuauccgguucccgacccucgcgccguggucggggcguucgauguguggggacagggcacaauggugaccgucagcucu

SEQ ID NO: 40440 - RNA, 432 nt, Artificial Sequence
  derived and/or modified sequence opt5 from anti-HIV_cap256-048-021758_VR-Chain
caggugcaacuggucgagagcggcgggggaguugugcagcccggcagaucccuccggcugucuugcgccgcuagcggguucaccuuuucccgcuacggaaugcacugggugagacaggccccuggcaaggggcuugaaugggucgcggugaucucuuaugacggaagcaaagaguacuaugcugauuccguuaagggccgguucacaauuucucgcgacaacagcaaagauacgcuguaccuccagauguccagccugagaguggaagacaccgccgucuauuacugugccaaggaugugggcgcuaauaaagacgaugagugggccacagacuauuacgaucuuucuaucgcuuacccgguucccgacccucgggccguggucggggcguuugauauuuggggacaaggcaccauggugacaguguccagc

SEQ ID NO: 40441 - RNA, 432 nt, Artificial Sequence
  derived and/or modified sequence opt5 from anti-HIV_cap256-048-020988_VR-Chain
caggugcaacuggucgaaagcggcgggggaguugugcagcccggcagaucccuccggcugucuugcgaagccagcgcuuucaccuuuuccucuuacgggaugcacugggugcgccaggccccuggaaagggccuugagugggucacauucaucagcuauuccgggaacaauaaauacuaugcggacucugugaagggaagauuuacgguuagccgggauaacuccaaaaauacccuguaccuccagaugaacagccugacaucugaagacaccgcuguguauuacugugccaaggaucuuggcggcuccaaaacagacgagugggggaccgauuauuacgaguucuggaaugccuacccgguccaagacccccgcgugguugugggagcuuuugauauuuggggccaugggacaauggucaccgugagcucu

SEQ ID NO: 40442 - RNA, 435 nt, Artificial Sequence
  derived and/or modified sequence opt5 from anti-HIV_cap256-048-020663_VR-Chain
caggugcaacuggucgagagcggcgggggaguugugcagcccggcaugucccucagacugucuugcgccgcuagcggguucaccuuuuccaacuucggaaugcacugggugcggcaggccccuggcaaggggcuugaaugggucgcggugaucucucaugacggaaauaacaaauacuauccggauagcguucagggccgcuuuacaauuuccagagaaaauucuaagaacacgcuguaccuccaaaugaauagccugaaacccgaggacaccgcuguguauuucugugccaaggaucuuggcggggaguccgaagucgaggagugggccagcgacuacuaugauuuuggacgggacaucccuggccccgauccucgcggggugguuggaacacuggacauuuggggccacgggaccauggugacagucucuucc

SEQ ID NO: 40443 - RNA, 432 nt, Artificial Sequence
  derived and/or modified sequence opt5 from anti-HIV_cap256-048-020590_VR-Chain
caggugcaacuggucgagagcggcgggggaguugugcagcccggcggggugccuagacucgccugcgcugccuccggauucaccuuuucuagcuacgcgaugcacuggguccggcaggcuccgggcaaggggcuggaaugggugacaguuaucuccuaugacggaucuaacaaauacuaugccgauagcgugaagggccgcuucacgauuuccagagacaauucuaaaaacacccuuuaccugcagaugaauagccuccgggccgaggauacagcugucuauuacugugccaaggaccugggcgggaccaaagaugacgaaugggcuacagauuauuacgacaucuccauugccuaccccgugcaagauccucgcgcgguugccggagcuuuugacaucuggggccaggggaccauggugacagucagcucu

SEQ ID NO: 40444 - RNA, 432 nt, Artificial Sequence
  derived and/or modified sequence opt5 from anti-HIV_cap256-048-019765_VR-Chain
caggugcaacuggucgagagcggcgggggaguugugcagcccggcagaucccuccggcugucuugcgccgcuagcggguucaucuuuaccaacuacgccauggacugggugcgccaggcgccuggaaagggccuugaaugggucgcugugauuuccucugaugggagcaauaaaaacuaugccgacuccguuaagggaagauucacaaucucucgggauaauagcaaaaacacggugucccugcagaugaauagccuccgcgccgaggacaccgcugucuacuauugugccaaggaucugggcgacucuaaaaaggaugaaugggcuacagacuacuaugaucuuuccauugccuacccggugcccgacccuagagcgguugugggcgccuuugauaucugggggcaaggaaccauggucacagugagcucu

SEQ ID NO: 40445 - RNA, 432 nt, Artificial Sequence
  derived and/or modified sequence opt5 from anti-HIV_cap256-048-019254_VR-Chain
caggugcaacuggucgagagcggcgggggaguugugcagcccggcagaucccuccggcugucuugcgccgcuagcggguucaccuccucuacauacgccaugcacugggugcgccaggcgccuggaaagggccuugaaugggucgcucugaucagcuaugacgggacggauaaauacuaugccgacuccgugaagggaagauuuaccauuucucgggauaacagcaaaaauacacucuaccugcagaugaacucccuucgcguugaggacaccgccguguaucauugugcuaaggaucugggcggcaauaaaccggacgaaugggccacagauuacuaugaccucagcaucgcuuaccccguccaagauccuagagccgugguugggguguucgacauuuggggacagggcaccaucauuacagucucuucc

SEQ ID NO: 40446 - RNA, 432 nt, Artificial Sequence
  derived and/or modified sequence opt5 from anti-HIV_cap256-048-018073_VR-Chain
caggugcaacuggucgagagcggcgggggaguugugcagcccggcagaucccuccggcugucuugcgccgcuagcggguucucccuuucuagcuacgccauggacugggugcgccaggcgccuggaaagggccuggaaugggucgcugugaucuccucugaugggaccaacaaauauuacgccgacagcguuaagggaagauuuacaauuacgcgggauaauuccaaaaacacccucuaucugcagaugaauagccuucgcguggaggacacagcccuguacuauugugcuaaggauaugggcgaaucugagaaagaagagugggccuccgacuacuaugauuucggcagagacaucccggggcaagauccccggggagaggucggcagcuuugacauuugggggcagggaaccauggugacaguuucuucc

SEQ ID NO: 40447 - RNA, 432 nt, Artificial Sequence
  derived and/or modified sequence opt5 from anti-HIV_cap256-048-016775_VR-Chain
gaggugcagcuggucgaguucggcgggggacucguucaacccggcagaagccugcggcuuuccugcgccgcuucugccuuuaccuucagccacuacgggauccauugggugcgccaggcgccuggaaagggccuggaauggguggcugucauuucccacgacgggucuacaaaagauuaugccgacagcgugaagggaagauuuacgaucucccgggauaacucuaaaaauaccauguaccuccagaugaacagccugcgcgccgaagacacagcuguuuauuacugugccagagaucuuggcgaguccgaaaccgaggagugggcuacagacuauuacgauuucagcauugccuauccggugcagaauccccggggcgucaucggggugcuggacauuuggggacucggcaccaugguuacagugucuucc

SEQ ID NO: 40448 - RNA, 432 nt, Artificial Sequence
  derived and/or modified sequence opt5 from anti-HIV_cap256-048-016069_VR-Chain
caggugcaacuggucgagagcggcgggggaguugugcagcccggcagaucccuccggcugucuugcgccgcuagcggguucaccuuuuccaaguacgccaugcacugggugcgccaggcgccuggaaaaggccuugaaugggucgcuuucguggccuuugacgagucugccaaguucuaugcugauagcguuaaagggagauuuacaaucucccgggacaacucuaagaauacgcugagccuccagaugaacucccugcgcgccgaagauaccgcuguguacuauugugccaaagaggucggagaaaauaaggacgaugagugggcgagcgacuacuaugaucuuucuauugccuacccggugcaugaccccagagcuguugugggcggcuucgaugucugggggcaaggaacaauggugaccguguccagc

SEQ ID NO: 40449 - RNA, 432 nt, Artificial Sequence
  derived and/or modified sequence opt5 from anti-HIV_cap256-048-015867_VR-Chain
caggugcaacuggucgagagcggcgggggaguugugcagcccggcagaucccuccggcugucuugcagcgccuccggguucucuuuuaccaacuacgcuauggacugggugcgccaggccccuggaaagggccuugaaugggucgcggugaucagcuccgaugggucuaauaaaaacuaugcugacagcguuaagggaagauucacaauuucccgggauaauagcaaaaacacgcuguuucuccagaugaacucucugcgcccggaggacaccgccguguacuucugugccaaggaucuuggcgcuaauaaagacgaugaaugggccacagacuauuacgaucuguccaucgcuuaucccguccacgacccuagagccgugguuggcauuuuugaucucugggggcaaggaaccauggugacagucagcucu

SEQ ID NO: 40450 - RNA, 432 nt, Artificial Sequence
  derived and/or modified sequence opt5 from anti-HIV_cap256-048-015673_VR-Chain
caggugcaccuggucgagagcggcgggggaguugugcaacccggcagaucccuccggcugucuugcgccgcuagcggguucaccuuuuccaauuucgccaugggaugggugcgccaggcgccuggcaaggggcuugaaugggucgcuuuuaucucuagcgacggaacaaauaaaaacuacggcgauuccgugaagggcagauucacgauuucucgggacaauagcaaaaacacccuguuucuccagaugaacucccugcgcgccgaggauacagcccuuuauuacugugcuaaggaccucgggggauauaaaagcgaugaaugggccaccgacuacuaugaucugucuaucgcuuacccgauucaggaccccagagccguugugggcgcguucgauaucugggggcaaggaacaauggucaccguguccagc

SEQ ID NO: 40451 - RNA, 432 nt, Artificial Sequence
  derived and/or modified sequence opt5 from anti-HIV_cap256-048-015156_VR-Chain
caggugcaacuggucgagagcggcgggggaguugugcagcccggcagaucccuccggcugucuugcgccgcuagcggguucaccuuuuccguguacgcccuucacuggguccgccagacaccuggaaagggccuggaauggguggcgcucaucucuuaugacgggacgaacaaauacuauguugauagcgugaagggaagauucaccauuucccgggacaauucuaaaaacacacuguaccuucagaugaauagccugaccgcugaggauacagccgucuauuacugugccaaggaccucggcggcuccaaaaacgaugaaugggcuaccgacuauuacgaucugagcaucgccuacccgauucaagacccccgcgcuguggccgggaucuuugauguuuggggaagaggcacaauggugaccgucucuucc

SEQ ID NO: 40452 - RNA, 432 nt, Artificial Sequence
  derived and/or modified sequence opt5 from anti-HIV_cap256-048-014521_VR-Chain
gaggugcagcuggucgaaagcggcgggggacucguucaacccggcagaucccugcggcuuucuugcgccgcuagcggguucaucuuuuccucuuacggcauucacugggugcgccagggaccugggaagggacuggaguggguggcccucaucagcggcgacggcaacaauaaauauuacgcggauuccguccaggggagauucucuauuagccgggacaacuccaagaauacccuguaucuucagaugaacagccugcgcgcugaagauacagccguguacuauugugccaaagaccucggagagucugauaaggaagaguggccguccgacuacuaugauuuuggcagagacuucacggggcaagauccccgggcuguugugggagucuuugacaucuggggccaggggaccacagugauuguuagcucu

SEQ ID NO: 40453 - RNA, 432 nt, Artificial Sequence
  derived and/or modified sequence opt5 from anti-HIV_cap256-048-014475_VR-Chain
caggugcaacuggucgagagcggcgggggaguugugcagcccggcagaucccuccggcugucuugcgccgcuagcggguucaccuuuaauacauucggaaugcacugggugcgccaggccccuggcaaggggcuugaaugggucgcggugaucucccaugacggaaauaacaaauacuaugcugauucucugaagggcagauuuacgauuagccgggaaaauuccaaaaacacccucuuccugcagaugaacucucuucgcgccgaggacacaagcguuuacuauugugccaaggaucugggccacggggagugcgaagagugggcuuccgacuacuaugauuuuggaaaagacuacccgugucucacccccagaggcguggccgggacauucgauaucuggggacauggcaccacagucaccgugagcucu

SEQ ID NO: 40454 - RNA, 432 nt, Artificial Sequence
  derived and/or modified sequence opt5 from anti-HIV_cap256-048-013798_VR-Chain
caggugcaacuggucgagagcggcgggggaguugugcagcccggcagaucccuccggcugucuugcgccgcuagcggguucaccuuuaauaauuacggaacacacugggugcgccaggccccuggcaaggggcuugaaugggucgcggugaucuccgacucuggaagcaacaaauauuacgcugauuccguuaagggcagauucacgauuucucgggacaauagcaaaaacacccuguaucuccagaugaacucccugcgcgccgaggauacagccguguacuuuugugcuaaggaccuuggcgggagagaaaccgaggaaugggccagcgauuauuacgacuucggacgggauuuuccgggccaagaccagcgcgcugucgccgggguguucgauauguggggacagggcacaaugguuaccgugucuucc

SEQ ID NO: 40455 - RNA, 432 nt, Artificial Sequence
  derived and/or modified sequence opt5 from anti-HIV_cap256-048-013271_VR-Chain
gaggugcagcuggucgaaagcggcgggggaguugugagacccggcgggucccuccggcugucuugcgccgcuagcggauucaucuuuuccucuuacggcauucacugggugcgccaagccccugggaagggacuugagugggucgcggugaucagcggcgacggcaccaacaaauauugugcugauuccguuaaggggagauucacaauuucucgggacaauagcaaaaacacgcuguaccuccagaucaauucccugcgcguggaagauaccgccgucuauuacugcgccaaggaccuuggcaaaaacaaggaugacgagugggcuacagauuauuacgaccugagcauugccuauccggugcccgauccuagagcuguugugggagucuuugacaucugggggcagggaaccguggugacagucucuucc

SEQ ID NO: 40456 - RNA, 432 nt, Artificial Sequence
  derived and/or modified sequence opt5 from anti-HIV_cap256-048-013180_VR-Chain
caggugcaacuggucgagagcggcgggggaguugugcagcccggcagaucccuccggcugucuugcgccgcuagcggguucaccuuuuccaagaauggaaugcacugggugcgccaggccccuggcaaagggcuugaaugggucgcguucguggcuuuugacggaucugauaaguacuaugccgacagcguuaaaggcagauucgugaucucccgggauaauucuaagaacacacugagccuccagaugaacucccugcgcgccgaggacacggcugucuacuauugugccaaagaagugggcgaggauaaggacgaugaaugggcuagcgacuacuaugaucuuucuauugccuacccgguucaugaccccagagcgguggucgggggauuugauaucuggggccaagggaccauggugacaguguccagc

SEQ ID NO: 40457 - RNA, 432 nt, Artificial Sequence
  derived and/or modified sequence opt5 from anti-HIV_cap256-048-012148_VR-Chain
caggugcaacuggucgagagcggcgggggaguugugcagcccggcagaucccuccggcugucuugcgccgcuagcggguucaccuuuacacacuacgccauggacugggugcgccaggcgccuggaaagggccuugaaugggucgcugugaucuccucugaugggagcuccaaaaacuaugccgacucuguuagaggacgguucacgauuagccgcgauaauuccaagaacacccugagccuccugaugaauggccuuagaccggaggacacagccguguacuauugugcuaaagaugucggcgacgugaagaacgaugaaugggccaccgacuacuaugaucugucuaucgcuuaccccguucaggacccucgggccguggucggggcguuugauuucuggggacaaggcacaauggugaccguguccgcc

SEQ ID NO: 40458 - RNA, 432 nt, Artificial Sequence
  derived and/or modified sequence opt5 from anti-HIV_cap256-048-011870_VR-Chain
caggugcaacuggucgagagcggcgggggaguugugcagcccggcagaucccuccggcugucuugcgccgugagcggguucaccuuuuccuucuacggaaugcacuggguccgccaggcuccuggcaaggggcuugaauggguggccguuaucucuuaugacggaaacaauaaauacuauguggauagcgucaagggcagauuuauuaucucccgggacaacucuaaaaauacacuguaccuccagaugaacagccugcgcguggaggauacggcgguuuauuacugugcuagagaccuuggcgaacgggagaaugaagagugggccaccgauuauuacgacuucuccauugccuacccgaucgaggggccccgcggaguggucggcguguuugauauuugggggagaggaacaauggugaccgucagcucu

SEQ ID NO: 40459 - RNA, 432 nt, Artificial Sequence
  derived and/or modified sequence opt5 from anti-HIV_cap256-048-011530_VR-Chain
caggugcaccuggucgagagcggcgggggaguugugcaacccggcagaucccuccggcugucuugcgccgcuagcggguucuccuuucgcaacuacgccauggacugggugagacaggcgccuggaaagggccuugaaugggucgcugugaucucuagcgauggguccgacaaacauuaugccgauucuguucggggacgcuucaccauuagcagagacaauuccaagaacacacuguaccuccagaugaauagccugcggguggaggauacggccgucuauuacugugcuaaagaccuuggcgccaacaagaaugaugaaugggcuaccgacuauuacgauuuuucuaucgccuauccggugcccgacccucgcgcgguugugggcgccuucgauauuugggggcagggaacaauggucaccguguccagc

SEQ ID NO: 40460 - RNA, 432 nt, Artificial Sequence
  derived and/or modified sequence opt5 from anti-HIV_cap256-048-010968_VR-Chain
caggugcaacuggucgagagcggcgggggaguugugcagcccggcagaucccuccggcugucuugcgccgcuagcggguucaucuuuuccucuuacggaaugcacugggugcgccaggccccuggcaaggggcuugaaugggucgcgcugauuagcggagacggcuccaacaaauauuacgcugauucugugaagggcagauucaccaucagccgggacaauuccaaaaacacacucuaucugcagaugaauagccuucgcgccgaggauucugcccuguacuuuugugcuaaggaccucggggaauccgauaaagaggaauggccgagcgacuauuacgauuucggaagagacuuuacgggccaaguuccccgggccguggucgggauuuucgauauguggggacagggcaccauggugacaguuucuucc

SEQ ID NO: 40461 - RNA, 426 nt, Artificial Sequence
  derived and/or modified sequence opt5 from anti-HIV_cap256-048-010224_VR-Chain
gaggugcaccuggucgaaagcggcggggaccucguucagcccggaggcucccugagacuuucuugcguggugagcgaguucaccuuuuccucuuacgggaugcauuggguccggcaagccccuggaaagggccuggaauggguggcuuucauccgcuaugaugggagcaacaaauacuaugccgacuccguuaagggaagauuuacaauuucucgggauaauagcaaaguguaccucgagaugaacucccugcgcgcggaagacacggcugucuauuacugugccaaggaggugggcgagaauaaagaugacgaaugggccagcgauuauuacgaccuuucuaucgcuuacccgauucacgaucccagagccguugugggcggguucgacaucuggggacagggcaccauggucacaguguccagc

SEQ ID NO: 40462 - RNA, 432 nt, Artificial Sequence
  derived and/or modified sequence opt5 from anti-HIV_cap256-048-009749_VR-Chain
caggugcaacuggucgagagcggcgggggaguugugcagcccggcagaucccuccggcugucuugcggggccagcggauucaccuuuuccucuuacgcuaugcacugggugcgccaggccccuggcagagggcuugaaugggucgcguucacaagcuccgacggaucuaacaagaauuauggcgauagcgugaaaggccgguuuacgaucucccgcgacaacagcaagaauacccuguuccuccagaugaacucucugagagcugaggauacagcccuuuacuauugugccaaagacguuggggaauacaaguccgaugagugggcuaccgacuauuacgaucugagcauugccuauccgauccaagacccccgggcuauggugggagccuuugauauuuggggccaggggacaauggucaccgugucuucc

SEQ ID NO: 40463 - RNA, 432 nt, Artificial Sequence
  derived and/or modified sequence opt5 from anti-HIV_cap256-048-009623_VR-Chain
caggugcaacuggucgagagcggcgggggaguugugcagcccggcagaucccuccggcugucuugcgccgcuagcggguucuccuuuucuaaguacggaaugcacugggugcgccaggccccuggcaaagggcuugaaugggucgcguucguggcuuuugacgagggagauaaguauuacguugacagcgugaaaggcagauucaccaucucccgggauaacucuaagaauacacugagccuccagaugaacucccugcgcgccgaagacacggccgucuauuacugugcuaaagaggugggcgaaaauaaggaugacgagugggccagcgauuauuacgaccuuucuauugcuuauccgauccaugaucccagagccguugucgggggauuugacauuuggggccaagggaccauggugacaguguccagc

SEQ ID NO: 40464 - RNA, 432 nt, Artificial Sequence
  derived and/or modified sequence opt5 from anti-HIV_cap256-048-008234_VR-Chain
caggugcaacuggucgagagcggcgggggaguugugcagcccggcagaucccuccggcugucuugcgccgcuagcggguucaccuuuacaaacuacgccauggacugggugcgccaggcgccuggaaagggccuugaaugggucgcugugaucuccucugaugggagcaauaaaaacuaugccgacuccguuaagggaagauucacgauuucucgggauaauagcaaaaacaccguguaccugcagauguccagccuccgcccggaggacacagccgucuauuacugugcuaaggaugugggcgacaccaaaucugaugaaugggccacagacuauuacgaucuguccaucgcuuaucccguucaagacccuagagccguggucggcgcguuugauauuugggggcagggaaccauggugacagugagcucu

SEQ ID NO: 40465 - RNA, 432 nt, Artificial Sequence
  derived and/or modified sequence opt5 from anti-HIV_cap256-048-008149_VR-Chain
caggugcaacuggucgagagcggcgggggaguugugcagcccggcagaucccuccggcugucuugcgccgcuagcggguucaccuuuuccguguacacaaugcacuggguccgccaggccccuggaaagggccuugaauggguggcgguuaucucuuaugacgggagaaacaaauacuaugcugauagcgugaagggacgguucacgauuucccgcgacaauucuaaaaacaccgucuaccugcagaugaauagccucagaguggaggauacagccguuuauuacugugccaaggaccugggcgcuaacaaagaugacgaaugggccaccgauuauuacgaccuuuccguggcuuacccgguccccgauccucgggccguggugggcgcguuugacgucugggggcaaggaacaaugguuaccgugagcucu

SEQ ID NO: 40466 - RNA, 432 nt, Artificial Sequence
  derived and/or modified sequence opt5 from anti-HIV_cap256-048-007301_VR-Chain
caggugcaacuggucgagagcggcgggggaguugugcagcccggcagaucccuccggcugucuugcgccgcuagcggguucuccuuuaacuacuaugccauggacugggugcgccaggcgccuggaaagggccuugaaugggucgcugugaucucuagcgaugggagaaauaaaaacuacgccgacuccguuaagggacgguucaccauuucucgcgauaauagcaaaaacacacuguaucuccagaugaacucccugagcguggaggacacggccgucuacuauugugcuaaggaucuuggcaaaaauaaggacgaugaaugggccaccgacuacuaugauaucucuauugcuuacccggugcccgacccuagagccguugugggcgucuuugauaucugggggcaaggaacaguggugaccgucuccagc

SEQ ID NO: 40467 - RNA, 432 nt, Artificial Sequence
  derived and/or modified sequence opt5 from anti-HIV_cap256-048-007174_VR-Chain
caggugcaacuggucgagagcggcgggggaguugugcagcccggcagaucccuccggcugucuugcgccgcuagcggguucaccuuuaacuccuacggaauggccugggugcgccaggcgccuggcaaggggcuugaaugggucgcucugaucucuuaugacggaagcaauaaauacuaugccgauuccgugagaggccgguucacaauuucucgcgacaacagcaaggauacgcucuaccugcagauggacggccuuagaccggaggauaccgcccuguauuacugugcuaaagaccucggggaauccgagugcgaagagugggccagcgauuauuacgacuuuggacgggauuaccccugucuggcuccucgcggcguucccgggacauucgacaucuggggacaaggcaccauggugacagucucuucc

SEQ ID NO: 40468 - RNA, 432 nt, Artificial Sequence
  derived and/or modified sequence opt5 from anti-HIV_cap256-048-007079_VR-Chain
caggugcaacuggccgagagcggcgggggagucguucagcccggcagaucccuccggcugucuugcgcugccagcggguucaccuuuuccaucuacggaaugcacugggugcgccaggcgccuggcaaggggcuugaauggguggcuuucauucugucugacggaacagauaaauauagcgccgacuccgucaagggcagauuuacgaucucucgggauaacagcaaaaauacccucuaccugcagaugaacucccuucgcgccgaggacacagcuguguauuacugugccaaggaucugggcaaagcuaaggacgaugaaugggccaccgacuauuacgauuucagcauugcguauccgguucaugaccccagagggguggccggaaucuuugauauuuggggccaagggacaauggucaccgugucuucc

SEQ ID NO: 40469 - RNA, 432 nt, Artificial Sequence
  derived and/or modified sequence opt5 from anti-HIV_cap256-048-007033_VR-Chain
caggugcaacuggucgagagcggcgggggaguugugcagcccggcagaucccuccggcugucuugcgccgcuagcggguucaccuuuuccaacuucggauuucacugggugcgccaggccccuggcaaggggcuugaaugggucgcggcuaucucuuucgccggaaauaacaaauacuaugccgacagcgugaagggcagauuuacaauuucccgggaaaauucuaaaaacauccuguaccuccagaugaauagccugcgcggcgaggauacggcuguuuauuacugugccaaggaccuuagagaguucgaaugcgaggagugggcuuccgauuauuacgacuuugggcgggauuauccgugucaagacccccgcggaguggucggcaccuucgaugugugggggcauggaagccugguuacagugucuucc

SEQ ID NO: 40470 - RNA, 432 nt, Artificial Sequence
  derived and/or modified sequence opt5 from anti-HIV_cap256-048-006128_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgggacggauaaauacuaugccgacagcgugaagggaagauucaccauuucccgggauaacucuaaaaauacacucuaccugcagaugaacagccuucgcguugaggacaccgccguguaucauugugcuaaggaucugggcggcuccaaaagcgacgaaugggccacagauuacuaugacuggucuaucgcuuacccgguccacgaucccagagccgugguugggguguuugacauuuggggacaaggcacccucgucacaguguccagc

SEQ ID NO: 40471 - RNA, 432 nt, Artificial Sequence
  derived and/or modified sequence opt5 from anti-HIV_cap256-048-005999_VR-Chain
caggugcaacuggucgagagcggcgggggaguugugcagcccggcagaucccuccggcugucuugcgccgcuagcggguucaccuuuacacacuucgccauggacugggugcgccaggcgccuggaaagggccuugaaugggucgcugugaucuccucugaugggagcuccaaaaacuacgccgacucuguuaagggaagauuuacgauuagccgggauaauuccaaaaacaccgugagccugcagaugaacucucuccgcccggaggacacagccgucuauuacugugcuaaggaucugggcgccaauaaagacgaugaaugggcuaccgacuauuacgaucuuuccaucgccuaucccgugccugaccccagagcgguugugggcgccuucgauauuugggggcaaggaacaauggucaccgugagcucu

SEQ ID NO: 40472 - RNA, 432 nt, Artificial Sequence
  derived and/or modified sequence opt5 from anti-HIV_cap256-048-005394_VR-Chain
caggugcaacuggucgagagcggcgggggaguugugcagcccggcagaucccuccggcugucuugcgccgcuagccaguucaccuuuuccucuuacgggaugcacugggugcgccaggccccuggaaagggccuugaaugggucgcggcuaucagcuucgccgggacaaauaaauauuacgccgacuccgugaagggaagauuuacgauuucucgggauaauagcaaaaacgcucuguaucuccaaaugaacucccugcgcgccgaggacaccgcucuuuacuauugugccaaggaucugagagaguucgaaugcgaagagugggcgagcgacuacuaugauuuuggccgggacuacccgugucaggauccccgcggcguuguggggacauucgacaucuggggacagggcaccauggucacagugucuucc

SEQ ID NO: 40473 - RNA, 432 nt, Artificial Sequence
  derived and/or modified sequence opt5 from anti-HIV_cap256-048-004226_VR-Chain
caggugcaacuggucgagagcggcgggggaguugugcagcccggcagaucccuccggcugucuugcgccgcuagcggguucaccuuuaacaagcacggaaugcauugggugcgccaggccccuggcaaagggcuugaaugggucgcguucguggcuuuugacggauccgauaaguacuaugccgacucuguuaaaggcagauucacaaucagccgggauaauuccaagaacacgcugucucuccagaugaauaaccugcgcgccgaggacaccgcuguguacuauugugccaaagaagucggcgauaauaaggacgaugagugggcuagcgacuacuaugaucuuuccauugccuacccggugcaagaccccagagcgguugucgggggauaugauaucuggggccaggggacaauggugaccgugagcucu

SEQ ID NO: 40474 - RNA, 432 nt, Artificial Sequence
  derived and/or modified sequence opt5 from anti-HIV_cap256-048-004097_VR-Chain
caggugcaacuggucgagagcggcgggggaguugugcagcccggcagaucccuccggcugucuugcgccgcuagcggguucaccuuuuccgccuacacagugcacuggguccgccaggcgccuggaagaggccuugaaugggugucuguuaucagcuaugacgaucggaacaaguacuaugcucauuccgugaaagggcgcuucacgauuucuagagacaauagcaagaacacccuguaccuccagaugaacucccugcggcgcgaggauacagccgucuauuacugugccaaagaccuuggagcuaauaaggaugacgaaugggccaccgauuauuacgaccugagcaucgcuuacccggugcccgauccuagagccguugugggcgcguuugacauuuggggccaagggacaauggucaccgugucuucc

SEQ ID NO: 40475 - RNA, 432 nt, Artificial Sequence
  derived and/or modified sequence opt5 from anti-HIV_cap256-048-003289_VR-Chain
caggugcaacuggucgagagcggcgggggaguugugcagcccggcagaucccuccggcugucuugcgccgcuagcggguucaccuuuuccaaguacggaaugcacugggugcgccaggccccuggcaaagggcuugaaugggucgcguucguggcuuuugacggaucuagcaagaacuaugccgauuccguuaaaggcagauucacaaucucucgggacaauagcaagaacacggugucccugcagaugaauagccuccgcccggaggauaccgccgucuacuauugugcuaaagaccugggcgccaacaaggaugacgaaugggcuacagauuacuaugaccuuucuauugccuaccccgugccugaucccagagcgguugugggggccuuugacaucuggggacaaggcaccauggucacaguguccagc

SEQ ID NO: 40476 - RNA, 432 nt, Artificial Sequence
  derived and/or modified sequence opt5 from anti-HIV_cap256-048-002601_VR-Chain
caggugcaacuggucgagagcggcgggggaguugugcagcccggcagaucccuccggcugucuugcgccgcuagcggguucuccuuuaacaauuacgccauggacugggugcgccaggcgccuggaaagggccuugaaugggucgcugugaucucuagcgaugggagaaacaaaaauuaugccgaguccguuaagggacgguucaccauuucucgcgacaacagcaaaaauacaguguaccugcagaugaacucccucagagccgaagauacggcugucuauuacugugccaaggacgugggcgauaccaaaaaggacgagugggcuacagauuauuacgaccugagcaucgccuauccgguucaagauccccaggcgguggucggcgccuuugacauuugggggcagggaaccauggugacagugucuucc

SEQ ID NO: 40477 - RNA, 432 nt, Artificial Sequence
  derived and/or modified sequence opt5 from anti-HIV_cap256-048-002129_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcucugaucucuuaugacgggacggauaaauacuaugccgacagcgugaagggaagauucauuaucucccgggauaauucucgcagcacccucuaccugcagaugaacucccuuagacuggaggacacagccguuuaucauugugcuaaagaucucggcggcagcaagucugacgaaugggccaccgauuacuaugaccuguccguggcuuacccgguccaagauccccgggccgugguugggguguuugacauuuggggacagggcacaauggucaccgugagcucu

SEQ ID NO: 40478 - RNA, 432 nt, Artificial Sequence
  derived and/or modified sequence opt5 from anti-HIV_cap256-048-001875_VR-Chain
caggugcaacuggucgagagcggcgggggaguugugcagcccggcgggucccucagacugucuugcgccaccagcggacuuacauucuccaacuacggcaugcacugggugcggcaggcuccugggcgcggacuggaaugggucgccuuuacgagauaugacggcaccuacaauuauuacgcggauucugugaagggccgguucacaaucagccgcgacaacuccaaagggacccucuaucugcagauggauggacuuagaccggaggacacagcucuguacuauugugccaaggaucucggcgaacgggagugcgaagagugggccucugacuacuacgauuuugggcgcgacuuccccugucaagauccuagaggaguugugggcaccuuugacauuugggggcagggaacaauggucaccgugagcucc

SEQ ID NO: 40479 - RNA, 432 nt, Artificial Sequence
  derived and/or modified sequence opt5 from anti-HIV_cap256-048-001302_VR-Chain
caggugcaacuggucgagagcggcgggggaguugugcagcccggcagaucccuccggcugucuugcgccgcuagcggguucaccuuuuccuacucuggaaugcacugggugcgccaggccccuggcaaggggauggaaugggucgcggugaucagcuaugacggauccaacaaauacuaugcugauucuguuaagggcagauucacaauuagccgggacaauuccaaaaacacgguguaccuucagaugaauagccugcgcggcgucgauaccgccguguauuacugugccaaggaccucgggggaggcgagguugaagagugggcuacagauuauuacgacuggucuaucgccuacccgguggaacaucccagagcugucguggggguguuugauauuuggggacaaggcaccaaagucacaguuuccagc

SEQ ID NO: 40480 - RNA, 432 nt, Artificial Sequence
  derived and/or modified sequence opt5 from anti-HIV_cap256-048-001203_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcuaucauuagcuaugacgggacaaucaaauacuaugccgauuccgugaagggaagauucacgauuucucgggacaacagcaaaaauaccguuucccugcagaugaacagccuccgcccggaggauacagccguguacuauugugcuaaggacgucggcgccaauaaagaugacgaaugggcuaccgauuacuaugaccugucuaucgccuaccccgugccugaucccagagcgguugugggcgccuuugacauuugggggcaaggaacaauggucaccguguccagc

SEQ ID NO: 40481 - RNA, 432 nt, Artificial Sequence
  derived and/or modified sequence opt5 from anti-HIV_cap256-048-000383_VR-Chain
caggugcaacuggucgagagcggcgggggaguugugcagcccggcagaucccuccggcugucuugcaccgccagcggguucacauuuaaucacuacgcuauggacugggugcgccaggccccuggaaagggccuugaaugggucgcggugaucuccucugaugggagcgacaaaacguaugcugauuccguuaagggaagauucaccauuucucgggacaauagcaaaaacacaguguaccugcagaugaacucccuccgcgccgaggauaccgccgucuauuacugugcuaaggacgugggcggcagcaaagaugacgaaugggccacagauuauuacgaccugucuaucgcuuauccgguucccgauccuagagccguggucggggcguuugacuucuggggacccggcaccauggugacaguguccagc

SEQ ID NO: 40482 - RNA, 432 nt, Artificial Sequence
  derived and/or modified sequence opt5 from anti-HIV_cap256-038-261791_VR-Chain
caggugcaacuggucgaguucggcgggggaguugugcagcccggcgggagccucagacuguccugcgccgcuuuuggauucaccaucucuagcuacggcaugcacugggugcggcaggccccugggaagggacuucagugggucgcguuuauucgcuaugacgaauccucuaaauucuacgcugauagcgugaagggcagauuuacaaucucccgggacaacucugagaauacgcuguaucuccaaaugaacagccugcgcgccgaagauaccgccguuuacuauugugcuaaagaccuuggcgaguccgaaaaugaggagugggccacagauuacuaugacuucagcauugcuuacccggggcaggaucccagaggaguggucggcaucuuugacauuugggggcagggaaccauggugacaguuucuucc

SEQ ID NO: 40483 - RNA, 432 nt, Artificial Sequence
  derived and/or modified sequence opt5 from anti-HIV_cap256-038-241540_VR-Chain
caggugcaacuggucgagagcggcgggggaguugugcagcccggcagaucccuccggcugucuugcgccgcuagcggguucaccuuuuccaacucugccaugcacugggugcgccaggcgccuggaaagggccuugaaugggucgcucugaucagcuacguugggggaaauauuuauuacgccgacuccgugaaaggcagauucacagugucucgggauaacagcaagaaaacgcucuaucugcagaugaacucccuucgcgucgaggacaccgccguguacuauuguguuaaggaugugggcgaaagcgagaaugaagagugggcuucugacuacuaugauuuugggagagacuacccgggacaagauacacgggccgucgugggcgcuuucgacaucugggggcagggaaccauggugacagucuccagc

SEQ ID NO: 40484 - RNA, 432 nt, Artificial Sequence
  derived and/or modified sequence opt5 from anti-HIV_cap256-038-235677_VR-Chain
cuggugcagcucgucgagagcggcgggggaguugugcaacccggcgggucccugagacuuucuugcgccgcuagcggauuccgguuuuccucuuacggcaugcacugggugcgccaggccccugggaagggacuggaaugggucgcguucaucagauaugacggcagcuuuaaagauuacgcugacuccgugcggggccgcuucaccauuucuagagagaacagcaagaauacacucuaucugcagaugaacucccuucggacggaugacaccgccguuuacuauugugccaaagaucugggggaaagcgagacagaagaguggccgucugacuacuaugauuuuggacgcgacuaccccggccaggauccuagagggguggucggaaccuucgacaucuggggccaugggacaauggugaccguuuccagc

SEQ ID NO: 40485 - RNA, 435 nt, Artificial Sequence
  derived and/or modified sequence opt5 from anti-HIV_cap256-038-234314_VR-Chain
gaggugcagcugcucgaaagcggcgggggacugguccaacccggcgggucccuuagacugucuugcgccgcuagcggauucaccuuuucccgguacgccaugucuuggguucgccaggcgccuggcaaggggcucgaguggguggcugugaucagcuaugacggauccaacaaauacuaugccgauucugucaagggcagauucacaauuagccgggacaauuccaaaaacacgcuguaccuucagaugaauagccugcgcgccguggauaccgcuguuuauuacugugccaaggaccucggcgaaggggagaacgaagagugggcuacagauuauuacgacuuuucuuacuggcugccgugccccaaauaucacggagccuggcuggagcuccuguacaucuggggccaggggaccauggugacagucuccagc

SEQ ID NO: 40486 - RNA, 432 nt, Artificial Sequence
  derived and/or modified sequence opt5 from anti-HIV_cap256-038-234273_VR-Chain
gaggugcagcuggucgaaagcggcgggggacucauccaacccggcgggucccugagacuuucuugcgccgcuagcggauucaccguuuccacaaauuuuaugucuugggugcggcaggccccuggcaaggggcuggaguggguggcggucauuagcuacgacggaaauaacaaauauuacgcugauuccgugaagggccgcuucacgaucucuagagaaaauagcaaaaacacccucuaucugcagaugaacucccuucggacagacgauaccgccguuuacuauugugccaaggaccugggcgagagcgaaacagaggaguggccgucugauuacuaugacuuugggcgcgauuaccccggacaggacccuagaggcguggucgggaccuucgauauuuggggacacggcacaauggugaccguuuccagc

SEQ ID NO: 40487 - RNA, 432 nt, Artificial Sequence
  derived and/or modified sequence opt5 from anti-HIV_cap256-038-223164_VR-Chain
gaggugcagcuggucgaaagcggcgggggacucguucggcccggcgggucccugcggcuuucuugcgccgcuagcggauucucccugggcucuuacuggaugaccugggugcgccaagccccugggaagggacucgaguggguggcggucaucagcuaugacggcuccaacaaauacuaugcugauucugugaagggcagauuuacaauuagccgggacaauuccaaaaacacgcuguaccuucagaugaauagccugcgcgccgaagauaccgcccucuauuacugugcuaaggaccugggggagucugaaaacgaggagugggccuccgauuauuacgacuucggaagagauuacccgggccaggaccccagagggguugugggaacauuugauaucuggggccaggggaccauggucacagugagcucu

SEQ ID NO: 40488 - RNA, 432 nt, Artificial Sequence
  derived and/or modified sequence opt5 from anti-HIV_cap256-038-220289_VR-Chain
gaggugcagcuggucgaaagcggcgggggacucguucaacccggcgggucccugagacuuucuugcaccgccagcggauucacauuuuccucuuacgagaugaauugggugcggcaggcuccuggcaaggggccggaauggguggccgucaucagcuaugacggaaauaacaaauacuaugcggauuccgugaagggccgcuucacgauuucuagagagaauagcaaaaacacccuguaccuccagaugaacucccugcggacagacgauaccgcuguuuauuacugugccaaggaccuuggcgaaagcgagacagaggaauggcccucugauuauuacgacuuugggcgcgauuacccuggacaggaccccagaggcguggucgggaccuucgauaucuggggacacggcacaauggugaccguuuccagc

SEQ ID NO: 40489 - RNA, 432 nt, Artificial Sequence
  derived and/or modified sequence opt5 from anti-HIV_cap256-038-220020_VR-Chain
caggugcaacuggucgagagcggcgggggaguugugcagcccggcagaucccuccggcugucuugcgccgcuagcggguucaccuuuucccgcaacgccaugcacugggugagacaggcgccuggaaagggccuugaaugggucgcucugaucucuuacgacgggagcaauaaauauuacguggauuccguuaagggacgguucacaauuucucgcgacaacagcaaaaauacgcucuaucugcagaugaacucccuuagagccgaugacaccgccguguacuauugugcuaaggaucugggcgagagcgaaacagaggaauggggcaccgacuacuaugauuuuucuacaggguacccgguccaagacccccggggagugguuggcgccuucgauaucugggggcagggaaccaugguguccgucagcucu

SEQ ID NO: 40490 - RNA, 432 nt, Artificial Sequence
  derived and/or modified sequence opt5 from anti-HIV_cap256-038-216853_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacaaauacuaugccgauucuguuaagggaagauucacaauuagccgggacaauuccaaaaacacgcuguacgugcagaugaauagccuccgcgccgaggauaccgcugucuauuacugugccagagaccugggcgaaucugagacagaagaguggccguccgauuauuacgacuuuggccgggauuaccccgggcaagacccucgcggagugguuggcaccuucgauaucugggggcauggaacaauggugaccgucagcucu

SEQ ID NO: 40491 - RNA, 432 nt, Artificial Sequence
  derived and/or modified sequence opt5 from anti-HIV_cap256-038-213466_VR-Chain
gaggugcagcuggucgaaagcggcgggggacucguucaacccggcagaucccugcgggugucuugcgccgcuagcggguucaccuuugaggacuacgccaugcacugggugcgccaggcgccuggaaagggccuugaaugggucgcugugaucuccgaugacgggaacaauaaauauuacgccgauucuguuaagggaagauucacaauuagccgggacaacuccaaaaauacgcuguaucuccagaugaacucucugcgcguggaggauaccgccgucuacuauugugugaaggacguuggcgaaagcgagaaugaggaaugggcuuccgauuacuaugacuuuggcagagauuacccggggcaggacacacgggccguggucggagcuuucgauaucuggggccaagggaccauggugacagugagcucu

SEQ ID NO: 40492 - RNA, 432 nt, Artificial Sequence
  derived and/or modified sequence opt5 from anti-HIV_cap256-038-213212_VR-Chain
caggugcaacuggucgagagcggcgggggaguugugcagcccggcgggucccucagacugucuugcgccgcuagcggauucaucuuuuccgacuacggcaugcacugggugcggcaggccccugggaagggacuugaaugggucgcgucuauuuggcaugauggcagcaaaaaguauuacgcugacuccgugaaaggccgcuucaccaucucuagagagaacagcaagaauacacuguaucuccagaugaacucccugcgggccgaagauacggccguuuaccacugugcuaaagaccuuggggagagcgaaauugaggaguggaccucugauuauuacgacuuuggacgcgauuauccgggccaagaccccagagggguguucggaacauuugauaucuggggccaugggaccauggucacaguguccagc

SEQ ID NO: 40493 - RNA, 432 nt, Artificial Sequence
  derived and/or modified sequence opt5 from anti-HIV_cap256-038-213120_VR-Chain
caggugcaccuggucgagagcggcgggggacucguuaagcccggcgggucccugagacuuucuugcgccgcuagcggauucaccuuuuccgacuacuauaugaucuggauucggcaagccccuggcaaagggcuggaauggguggcggugaucucuagcgauggauccaacaagaauuacgcugacucugucaaaggccgcuucacaauuagcagagauaacuccaagaauacgcucuaucugcagaugaacagccuucgggccgaggacaccgccguguacuauugugcuaaagaucugggcgaaucugagaaugaagagugggccacagacuacuaugauuuugcuaccggguacccgguucaggacccccgcgccguggucggagcguucgauaucuggggccaggggacaauggugaccguuuccccu

SEQ ID NO: 40494 - RNA, 432 nt, Artificial Sequence
  derived and/or modified sequence opt5 from anti-HIV_cap256-038-212592_VR-Chain
cuggugcagcucgucgagagcggcgggggaguugugcaacccggcaagucccugagacuuucuugcgccgcuagcggguucaccuuuuccucuuacgccaugcacuggauccggcaggcgccuggaaaaggccuggaauggguggcugucauuagcgacgauggguccaucaagaacuaugccgacucugugaaaggacgcuucacaauuagcagagauacguccaagaaacucauguaccugcagaugaauagccuuucugccaacgacaccgcuguuuauuacugugccaaggaucugggcgagcgggaaaaugaggaaugggcuuccgacuauuacgauuuuggccgcgacuauccggggcaggaucccagaggaguggucggcagcaucgacacaugggggcauggaaccauggugacaguuucuucc

SEQ ID NO: 40495 - RNA, 432 nt, Artificial Sequence
  derived and/or modified sequence opt5 from anti-HIV_cap256-038-211790_VR-Chain
gagcugcagcucguggaaagcggcgggggacugguccaacccggcgggucccuuagacugucuugcguugugagcggauucaccguguccacaaacuacaucucuuggguccggcaggccccuggcaaggggcucgaguggguggcuguuauuagcuaugacggauccaauaaauacuaugccgauucugugaagggccgcuuuacgaucagcagagacaacuccaaaaauacccuguaccuucagaugaacagccugcgggcggaagauacagcucucuauuacugugccaaggaccugggcgagucugaaaaugaggagugggccuccgauuauuacgacuucgggcgcgauuacccgggacaggaccccagaggcgucguggggaccuuugauauuuggggacaaggcacaaugguuaccgugagcucu

SEQ ID NO: 40496 - RNA, 432 nt, Artificial Sequence
  derived and/or modified sequence opt5 from anti-HIV_cap256-038-209916_VR-Chain
caggugcaacuggucgagagcggcgggggaguugugcagcccggcgggucccucagacugucuugcgccgcuagcggauucaccuuuuccucuuucggcaugcacugggugcggcaggccccugggaagggacuugaaugggucagcuuuauccgcaacgacggcggcauuagauacuccgcggauucugugcgggggcgcuucacaaucagcagagacaauuccaaaaacacgcuguaucuccagaugaauagccugcggaccgaugacacagcuguuuacuauugugccaaggaucuuggagagucugaaaccgaggaauggccguccgacuacuaugauuuuggccgcgacuaccccgggcaagauccuagaggaguggucggcacauucgacauuugggggcauggaaccauggugacaguuagcucu

SEQ ID NO: 40497 - RNA, 432 nt, Artificial Sequence
  derived and/or modified sequence opt5 from anti-HIV_cap256-038-207938_VR-Chain
caggugcaacuggucgagagcggcgggggaguugugcaccccggcagaucccuccggcugucuugcgccgcuagcggguucaccuuuuccucuuacggaaugcauugggugcgccaggccccuggcaaggggcuugaaugggucgcggugaucagccacgacggauccaacaaauauuacgcugauucuguuaagggcagauucacaauuagccgggacaauuccaaaaacacgcuguaucuccagaugaauagccugcgcgccgaggauaccgccguguacuauugugcuaaggaccuuggcgaaucugagaacgaagagugggccuccgauuacuaugacuuugggagagauuacccgggacaggacccccggggcgucguggggguuuucgauaucuggggacaaggcacaauggugaccgucagcucu

SEQ ID NO: 40498 - RNA, 432 nt, Artificial Sequence
  derived and/or modified sequence opt5 from anti-HIV_cap256-038-202245_VR-Chain
caggugcaccuggucgagagcggcgggggaguugugcaacccggcagaucccuccggcugucuugcaccgugagcggguucacauuuggauccuacgcccuucauuggguccgccaggcuccuggcaaggggcuggaauggcucucugugaucagcuaugacggaaacaauaaauacuaugccgauuccguuaagggcagauucacgauuucucgggagaacagcaaaaauacccuguaccuucagaugaacucccugcgcgcggaagacacagcuguguaucacugugccaaggaucucggcgagagcgaaaaagaggagugggccucugacuacuaugauuuugggagagacuacccgggacaggauccccggggcgucguggggaccuucgacaucuggggacauggcacaaugguuaccguguccagc

SEQ ID NO: 40499 - RNA, 432 nt, Artificial Sequence
  derived and/or modified sequence opt5 from anti-HIV_cap256-038-197721_VR-Chain
caggugcaacuggucgagagcggcgggggaguugugcagcccggcaagucccucagacugucuugcgccgggagcggauucaucuuuuccaacuacccuaugcacugggugcggcaggcuccgggcaaagggcuugaauggauggccgacgucucuuaugauggaagcaauaaggacuacgcggauuccgugaaaggccgcuucaccauuucuagagacaacagcaagaauacacuguaucuccagaugaacucccugcgggcugaggauacggccguuuacuauugugugaaagacgucggcgaaagcgagaaugaagagugggccucugauuacuaugacuuugggcgcgauuaccccggacaagacaccagagcugugguuggcgccuucgauaucugggggcagggaacaauggugaccgucuccagc

SEQ ID NO: 40500 - RNA, 432 nt, Artificial Sequence
  derived and/or modified sequence opt5 from anti-HIV_cap256-038-196679_VR-Chain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguggcugugaucuccuaugacggaggcaacaaauacuaugccgauucugucaagggccgcuucacaauuagcagagacaauuccaaaaacacgcuguaccuucagaugaauagccugcgggccgaagauaccgcucucuauuacugugccaaggaccugggggagucugaaaacgaggagugggcuuccgauuauuacgacuuuggacgcgauuacccgggccaggacagcagaggggugguuggaacauucgauguguggggccaagggaccauggucacagugucuucc

SEQ ID NO: 40501 - RNA, 438 nt, Artificial Sequence
  derived and/or modified sequence opt5 from anti-HIV_cap256-038-196118_VR-Chain
caggugcaacuggucgagagcggcgggggaguugugcagcccggcgggucccuccggcugucuugcgccgcuagcggauucaccuuuuccacauacggcaugcacugggugcggcaggccccugggaagggacuugaaugggucacguucauccgcaacgacggcaccaauaaauauuacgcggauucugugaagggcagauuuacaauuagccgggacaacaccaaaaauacacuguaucuccagauguacucccugcgcgcugaggauaccgccguuuauuacugugccaaggaccuuggggaaucugagaacgaagaugaggagugggcuagcgacuauuacgauuucggaagagacuacccgggccaagauuccagagggguggucggaacauuugacauguggggccaggggaccauggugacgguuagcucu

SEQ ID NO: 40502 - RNA, 429 nt, Artificial Sequence
  derived and/or modified sequence opt5 from anti-HIV_cap256-038-195382_VR-Chain
caggugcaccuggucgagagcggcgggggaguugugcaacccggcagaucccuccggcugucuugcgccgcuagcggguucaccuuuuccaacuacccugugcauuggguccgccaggccccgggaaagggccuugaauggguggcgguuaucucuuucgacgggauuaauaacuaugcuggaagcgugaaaggcagauuuaucauuucccgggauaauucuaagaacacacuguaccuccagaugaauagccugcgcgccgaggacacggccgucuauuacugugugaaagaucuuggcgaauccgagaaggaagaguggcccagcgacuauuacgauuucgggagagacuauccuggacaggauucucggggcguugugggggucuuugacaucuggggacaaggcaccauggugacaguguccagc

SEQ ID NO: 40503 - RNA, 432 nt, Artificial Sequence
  derived and/or modified sequence opt5 from anti-HIV_cap256-038-180001_VR-Chain
gaggugcagcuggucgaaagcggcgggggacucguucaacccggcagaucccugcggcuuucuugcaccgccagcggguucacauuuggagacuacgcuauguccugguuccgccaggccccuggcaaggggcuggaguggguggcggauaucucuuaugacggaagcaauaaauacuaugcugauuccgugaagggcagacucacgauuucucgggacaauagcaaaaacacccuguaccuucagaugaacucccugcgcgccgaagauacagccgucuauuacugugugaaggaccucggcgagagcgaaaaagaggaguggccgucugauuauuacgacuuugggagagauuaccccggacaggacucccggggcguugugggggucuucgauaucuggggacaaggcaccauggugacaguuagcucu

SEQ ID NO: 40504 - RNA, 432 nt, Artificial Sequence
  derived and/or modified sequence opt5 from anti-HIV_cap256-038-178021_VR-Chain
caggugaagcuggucgagagcggcgggggaguugugcaacccggcgggucccucagacugucuugcgccgcugccggauucaucuuuagcaacuccggcaugcacugggugcggcaggcgccugacaaagggcuugaaugggucgcuuucgugccguacgauggaucuaauaaguauuacgccgacagcguuaaaggccgcuuuaccauuuccagagauaacucuaagaauacacugagccuccagaugaacucccugcggacggaggacaccgccguguauuacugugcuaaagaucuuggcgaaagcgagacagaagaguggcccucugacuauuacgauuucgggcgcgacuauccuggacaggaucccagaggcgucguggggaccuuugacaucuggggacauggcacaaugguuaccguguccagc

SEQ ID NO: 40505 - RNA, 432 nt, Artificial Sequence
  derived and/or modified sequence opt5 from anti-HIV_cap256-038-177104_VR-Chain
gaggugcagcugcucgaaagcggcgggggacugguccaacccggcgggucccuuagacugucuugcgccgcuagcggauucaccuuuuccucuuacgccaugaacuggguucggcaggcgccuggcaaggggcucgaguggguggcugugaucagcuaugacggaggcgauaaauacuaugccgacuccgucaagggccgcuucacaauuucuagagauaauagcaaaaacacgcuguaccuucagaugaacucccugcggguggaagacaccgccguuuauuacugugugaaggaugucggggagagcgaaaaugaggagugggcuucugacuauuacgauuuuggacgcgacuacccgggccaggauacaagagccgugguuggggcuuucgacaucuggggacaaggcaccauggugacagucuccagc

SEQ ID NO: 40506 - RNA, 432 nt, Artificial Sequence
  derived and/or modified sequence opt5 from anti-HIV_cap256-038-171261_VR-Chain
caggugcaacuggucgagagcggcgggggaguugugcagcccggcagaucccuccggcugucuugcgccgcuagcggguucaccuuuuccucuuacgccauguauugggugcgccaggcgccuggaaagggccuugaaugggucgcugugaucagcuccgacgggucugauaaaaacuacgccgacagcguuaagggaagauucacaauuucccgggauaauagcaacaauacgcuguaucuccagaugaacucucugcgcgccgaggacaccgcuguguacuauugugccagagaucuuggcgaauccgagaaugaagaguggccgagcgacuacuaugauuuuggccgggacuaccccgggcaagauccucgcggagucaucggcacauucgacgugugggggcagggaaccaugguuacagugucuucc

SEQ ID NO: 40507 - RNA, 432 nt, Artificial Sequence
  derived and/or modified sequence opt5 from anti-HIV_cap256-038-169090_VR-Chain
caggugcaacuggucgagagcggcgggggaguugugcagcccggcagaucccuccggcugucuugcgccgcuagccgcuucaccuuuaagacauacacgaugcacugggugagacaggccccugggaaaggacuugaaugggucgcgcugaucuccuaugacggcucuaacaaguacuaugcugauagcgugaaagggcggcucaccauuucccgcgacaauucuaagaacacacuguaccuucagaugaauagccugagagccgaggauaccgccguuuauuacugugugaaagaccucggagaauccgagaaggaagaguggccgagcgauuauuacgacuucggccgggauuaccccggccaagacucucgcggggucgugggaguuuuugauaucuggggccaggggacaauggugaccgucuccagc

SEQ ID NO: 40508 - RNA, 432 nt, Artificial Sequence
  derived and/or modified sequence opt5 from anti-HIV_cap256-038-168705_VR-Chain
gaggugcagcuggucgaaagcggcgggggacucguuaagcccggcgggucccugagacuuucuugcgccgcuagcggauucaccuuuuccucuuacagcaugaacugggugcggcgcgccccuggcaaagggcuggaguggguggcgcucaucuccuaugacgaaaauaagaaauacuaugcugauucugucaagggaagauucacaauuagccgggagaacuccaaaaauacgcuguaccuucaaaugaacagccugcgcgccgaagacaccgccguguauuacugugcuaaggaucucggcgagagagagaaugaagagugggccucugacuauuacgauuuuggccgggacuacccggggcaggauccccgcggaguugugggcuccaucgacacaugggggcacggaaccauggucacagugagcucu

SEQ ID NO: 40509 - RNA, 432 nt, Artificial Sequence
  derived and/or modified sequence opt5 from anti-HIV_cap256-038-167685_VR-Chain
caggugcaacuggucgagagcggcgggggaguugugcagcccggcagaucccuccggcugucuugcgccgcuagcgggaucaccuucuccucuuacgccauucacugggugcgccaggcgccuggaaagggccuugaaugggucgcugugaucagcuaugacggguccaacaaauacuaugccgauucuguuaagggaagauuuacaauuagccgggacaauuccaaaaacacgcuguaccuccagaugaauagccugcgcgccgaggauaccgcuguguauuacugugccaaggaccuuggcgaaucugagaacgaagagugggcuacagauuauuacgacuucuccaucggcuacccggggcaagaucccagaggagucgugggcgccuuugacauuugggggcagggaaccaugguuacagugagccug

SEQ ID NO: 40510 - RNA, 432 nt, Artificial Sequence
  derived and/or modified sequence opt5 from anti-HIV_cap256-038-158775_VR-Chain
caggugcaacuggucgagagcggcgggggaguugugcagcccggcgggucccuccggcugucuugcgccgcuagcggauucaccuuuuccacauacggcaugcacugggugcggcaggccccugggaagggacuugaaugggucgcguucauccgcgacaacggcucuaauaaauauuacgcugauagcgugaagggcagauuuacgauuucccgggacaacucuaaaaauacccuguaucuccagaugaacagccugcgcgccgaggauacagcccuuuacuauugugcuaaggaccugggggaauccgagaaugaagagugggccagcgauuacuaugacuucggaagagauuacccgggccaagacucuagagggguugugggaaccuuugaugucuggggccaggggacaauggugaccguuuccagc

SEQ ID NO: 40511 - RNA, 432 nt, Artificial Sequence
  derived and/or modified sequence opt5 from anti-HIV_cap256-038-157318_VR-Chain
cacgugcagcuggucgagagcggcgggggaguugugcaacccggcagaucccuccggcugucuugcgccgcuagcgggaucaccuucuccacauacgacaugcauugggugcgccaggccccuggaaagggccuugaaugggucgcggugauuucuaacgaugggagcaauaaauauuacgcugacuccguuaagggaagauuuacgaucucucgggauaacagcaaaaauacccuguaucuccagaugaacucccugcgcgccgaggacacagcccuuuacuauugugcuaaggaucugggcgaaagcgagaaagaagagugggccucugacuacuaugauuucggcagagacuacccggggcaggauccccggggaguggucgcuaccuuugacauuuggggccaagggacaauggugaccguuuccagc

SEQ ID NO: 40512 - RNA, 432 nt, Artificial Sequence
  derived and/or modified sequence opt5 from anti-HIV_cap256-038-153058_VR-Chain
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcugugaucucuuaugacgggagccauuccuacuaugccggaucuguuaaaggcagauucacgaccagccgggauaacuccaagaauacacugaaccuccagaugaauagccugcgcccggaggacaccgcccuuuacuauugugcuaaagaucugggcgaaucugagaacgaagagugggccuccgacuacuaugauuuugggagagacuaccccggacaagauagccggggcguggucgggacauucgacguguggggacagggcaccaugguuacagugucuucc

SEQ ID NO: 40513 - RNA, 432 nt, Artificial Sequence
  derived and/or modified sequence opt5 from anti-HIV_cap256-038-150027_VR-Chain
cuggugcagcucgucgagagcggcgggggaguugugcaacccggcgggucccugagacuuucuugcgccgcuagcggauuccgguuuuccucuuacggcaugcacugggugcgccaggccccugggaagggacuggaaugggucgcguucaucagauaugacggcagcuuuaaagauuacgcugacuccgugcggggccgcuucaccauuucuagagauaacagcaagaauacaguuuaugugcagaugaacucccuccgggccgaggacacggccgucuacuauugugcuaaagaucugggggaaagcgagaaugaagagugggccaccgacuacuaugauuuugcuacaggauacccggugcaggacccccgcgccguugugggcgcguucgauaucugggggcaaggaaccauggucacagugucuccu

SEQ ID NO: 40514 - RNA, 432 nt, Artificial Sequence
  derived and/or modified sequence opt5 from anti-HIV_cap256-038-146372_VR-Chain
caggugcaacuggucgagagcggcgggggaguugugcagcccggcagaucccuccggcugucuugcgccgcuagcggguucaccuuuuccucuuucggaaugcacugggugcgccagagcccuggcaaggggcuugaaugggucgccgugaucuccuacgacggaaacaauaaauauuacgcggauucuguuaagggcagauuuacaauuagccgggagaacuccaaaaauacgcuguaucuccagaugaacagccugcgcaccgacgauacagcuguguacuauugugccaaggaccuuggcgaaucugagaccgaagagugggccacagauuacuaugacuucgcuaccggguacccgguccaagaucccagagccgugguuggagcuuuugacaucuggggccaggggacaauggugaccgucuccccu

SEQ ID NO: 40515 - RNA, 432 nt, Artificial Sequence
  derived and/or modified sequence opt5 from anti-HIV_cap256-038-141868_VR-Chain
gagcugagacucguggaaagcggcgggaaccugguccagcccggaggcucccuuacccugucuugcguugccagcggguucacauuugacuccuacggaaugucuugggugcggcaagcuccuggcaaggggcucgaguggguggcccugaucagcuaugaugaaaauaaaaaguacuaugcggacuccgucaaaggacgcuucacgauuucuagagagaacagcaagaauacccuuuaccugcagaugaacucccuccgggcugaagauacagccguguauuacugugccaaagaccugggcgagcgcgagaaugaagagugggcuagcgauuauuacgacuuuggcagagauuacccggggcaggacccccggggaguugugggcucuaucgauaccugggggcacggaacaauggucaccguguccagc

SEQ ID NO: 40516 - RNA, 432 nt, Artificial Sequence
  derived and/or modified sequence opt5 from anti-HIV_cap256-038-141616_VR-Chain
gaggugcagcugcucgaaagcggcgggggacugguccaacccggcgggucccuuagacugucuugcgccgcuagcggauucaccuuuuccucuuacgccaugagcuggguucggcaggcgccuggcaaggggcucgaguggguggcugugaucuccaaagacggaucugauaacagcuaugucgacuccgugaagggccgcuucacaauuagcagagauaauucuaaaaacacgcuguaccuucagaugaacucccugcgggccgaagacaccgccguuuauuacugugcucgcgaucucggcgagagcgaaaaugaggaguggccgucugacuauuacgauuuugggagagacuaucccggacaggauccucggggcgugaucgggacauucgacgucuggggacaaggcaccauggugacaguuuccagc

SEQ ID NO: 40517 - RNA, 432 nt, Artificial Sequence
  derived and/or modified sequence opt5 from anti-HIV_cap256-038-127989_VR-Chain
caggcccaacugguggagagcggcgggggagucguucagcccggcagaucccuccggcugucuugcgcugccagcggguucaccuuuuccaacuucgcgaugcacugggugcgccaggcuccuggaaagggccuugaauggguggccgucaugucugacgaugggagcaauaaauacuaugccgacuccgugaagggaagauuuacaaucucucgggauaacagcgagaauacgcuguaccuccagaugaacucccugcgcgcugaagacaccgccguuuauuacugugcuaaagaucuuggcgagagcgaaacagaggagugggccaccgacuauuacgauuucggcacaggguauccgggacaagaccccagagcgaugauuggcaccuuugauaucugggggcggggaacaauggugaccgucucuucc

SEQ ID NO: 40518 - RNA, 432 nt, Artificial Sequence
  derived and/or modified sequence opt5 from anti-HIV_cap256-038-118109_VR-Chain
caggugcaacuggucgagagcggcgggggaguugugcagcccggcgggucccucagacugucuugcaccgccagcggauucacauuuuccgcuuacgacaugcacuggauccggcaggccccuggcaaggggcuuggauggguggcguucauuacgaacgaaggcucuagcaaaaauuaugucgauuccgugaagggccgcuuuaccaucucuagagacaacagcaaaaauacacuguaccuccagaugaacucccugcgggcugaggauaccgccguuuauuacugugccaaggaccuuggggaaagcgagaaugaagagugggcuacagauuauuacgacuucucuauugccuauccgggacaagauccccgcggcguggucgggaucuuugacauuuggggacagggcaccauggugacaguuuccagc

SEQ ID NO: 40519 - RNA, 432 nt, Artificial Sequence
  derived and/or modified sequence opt5 from anti-HIV_cap256-038-112226_VR-Chain
gaggugcagcuggucgaaagcggcgggggacucguucaacccggcgggucccugagacuuucuugcgccgcuagcggauucaccuuuuccucuuacuggaugacaugggugcggcaggccccuggcaaggggcuggaguggguggcggucaucagcgacgauggaaacaauaaauauuacgcugacuccgugaagggccgcuucacgauuucuagagauaacagcaaaaauacccucuaucugcagaugaacucccuucggguugaagacacagccguguacuauugugucaaggaugugggcgagagcgaaaaugaggagugggccucugacuacuaugauuuugggcgcgacuacccgggacaggauaccagagcuguugugggcgccuucgacaucugggggcaaggaacaauggucaccguguccagc

SEQ ID NO: 40520 - RNA, 432 nt, Artificial Sequence
  derived and/or modified sequence opt5 from anti-HIV_cap256-038-105918_VR-Chain
gaggugcagcugcucgaaagcggcgggggacugguccaacccggcgggucccuuagacugucuugcgccgcuagcggauucaccuuuaauauccacccuaugcauuggguucggcaggccccgggcaaggggcucgaguggguggcggugauuuccuacgacggaaauaacaaauauuacgcugauucugucaagggccgcuucacaaucagcagagaaaauuccaaaaacacgcuguaucuucagaugaacucucugcggaccgacgauacagccguguacuauugugccaaggaccucggcgagagcgaaaccgaggaguggcccuccgauuacuaugacuuugggcgcgauuacccuggacaggaccccagaggcguuguggggacauucgauauuuggggacacggcaccauggucacagugagcucu

SEQ ID NO: 40521 - RNA, 432 nt, Artificial Sequence
  derived and/or modified sequence opt5 from anti-HIV_cap256-038-104487_VR-Chain
cuggugcagcucgucgagagcggcgggggaguugugcaacccggcaagucccugagacuuucuugcgccgcuagcggguucaccuuuuccucuuacgccaugcacuggauccggcaggcgccuggaaaaggccuggaauggguggcugucauuagcgacgauggguccaucaagaacuaugccgacucugugaaaggacgcuucacaauuagcagagauaauuccaagaacacgcucuaccugcagaugaauagccuucgggccgaggacaccgcuguuuauuacugugccaaagaucugggcgaaucugagaacgaagagugggcuacagacuauuacggcuuuuccaucggguauccgggacaggauccccgcggcguggucgggauuuucgacaucugggcccaaggaaccauggugacaguuagcucu

SEQ ID NO: 40522 - RNA, 432 nt, Artificial Sequence
  derived and/or modified sequence opt5 from anti-HIV_cap256-038-102308_VR-Chain
caggugcaacuggucgagagcggcgggggaguugugcagcccggcgggucccuccggcugucuugcgccgcucuugacuucccuuuuagcuccuucggaaugcacugggugcggcagaccccgggccgcgggcuggaaugggucgccaucauuuggucugauggaagcaacagauacuauguggacuccguuaagggccgguuuacaaucucucgcgauaauagcaaaaacacgcucuaccugcagaugaacucccuuagacccgacgauaccgcgguguauuacugugucaaggaccugggcgagagcgaaaaugaggaaugggcuacagauuauuacgacuucucugugggguauccuggacaaggccccagagggguugugggaauuuuugauaucuggggccaggggaccauggucacaguguccagc

SEQ ID NO: 40523 - RNA, 432 nt, Artificial Sequence
  derived and/or modified sequence opt5 from anti-HIV_cap256-038-091115_VR-Chain
caggugcaacuggucgagagcggcgggggaguugugcagcccggcagaucccuccggcugucuugcgccgugagcggguucaccuuuuccucuuacggacuucacuggguccgccaggcuccuggcaaggggcuggaauggguggccguuaucagcuaugacggauccaacaaauacuaugcggauucugugaagggcagauucacaauuagccgggacaauuccaaaaacacgcucuaccugcagaucaauagccuucgcgcugaggauaccgccgucuauuacugugccaaggaccugggcgaaucugagaacgaagagugggcuacagauuauuacgacuuuuccauuggguacccgggacaagaucccagagccgugguuggcgcuuucgacaucugggggcagggaaccauggugacagucagcucu

SEQ ID NO: 40524 - RNA, 432 nt, Artificial Sequence
  derived and/or modified sequence opt5 from anti-HIV_cap256-038-090262_VR-Chain
caggugcaacuggucgagagcggcgggggaguugugcaggccggcgggucccucagacugucuugcgcugccagcggauucaccuuuaacaauuacggcaugcacugggugcggcaggcgcccgggaagggacuugaaugggcugccuucauccgcuaugacggcuccaacaaauacuaugccgauucugucagaggccgguuuacaauuagccgcgacaauuccaagaacacgcuguaccuccagaugaacucucugagagcugaggauaccgccguguauuacuguguuaaagacgugggggaaagcgagaaugaagagugggcuuccgauuauuacgacuucggacgggauuacccuggccaagacacacgcgccgucgugggggcguuugauaucuggggacagggcaccaugguuacagugagcucu

SEQ ID NO: 40525 - RNA, 432 nt, Artificial Sequence
  derived and/or modified sequence opt5 from anti-HIV_cap256-038-083260_VR-Chain
caggugcaacuggucgagagcggcgggggacucguuaagcccggcgggucccugagacuuucuugcgccgcuagcggauucaccuuuuccgacuacuauaugacauggauccggcaggccccuggcaaagggcuggaauggguggcggugauuucuuacgauggaggcaacaaguauuacgcugacagcgucaaaggccgcuucacgaucuccagagauaauucuaagaacacccucuaucugcagaugaauagccuucgggccgaggacacagcccuguacuauugugcuaaagaucucggggaauccgagaacgaagagugggccagcgacuacuacgauuuuggacgcgacuauccgggccaggauucuagaggggugguuggaaccuucgacguguggggccaagggacaauggucaccguguccagc

SEQ ID NO: 40526 - RNA, 432 nt, Artificial Sequence
  derived and/or modified sequence opt5 from anti-HIV_cap256-038-080981_VR-Chain
caggugcaacuggucgagagcggcgggggaguugugcagcccggcagaucccuccggcugucuugcgccgcuagcggguucaccuuuuccucuuacggaaugcacugggugcgccaggccccuggcaaggggauggaaugggucgcggugaucagcuaugacggauccaacaaauacuaugcugauucuguuaagggcagauucacaauuagccgggacaauuccaaaaacacgcuuuaccugcagaugaauagccuccgcgccguggauaccgccgucuauuacugugcuaaggaccugggcgagggggaaaacgaggaaugggccacagauuauuacgacuuuucuaucggauacccgggccaagaucccagaggggugguuggagcuuucgacauuuggggccaggggaccauggugacagucuccagc

SEQ ID NO: 40527 - RNA, 432 nt, Artificial Sequence
  derived and/or modified sequence opt5 from anti-HIV_cap256-038-080873_VR-Chain
cuggugcagcucgucgagagcggcgggggaguugugcaacccggcgggucccugagacuuucuugcgccgcuagcggauuccgguuuuccucuuacggcaugcacugggugcgccaggccccugggaagggacuggaaugggucgcguucaucagauaugacggcagcuuuaaagauuacgcugacuccgugcggggccgcuucaccauuucuagagauaacagcaagaauacaguuuaucuccagaugaacucccugcgggccgaggacacggccguguacuauugugucaaagaucuuggggaaagcgagaaggaagaguggccgucugacuacuaugauuuuggacgcgacuaccccggccaggauuccagaggggugguuggaguguucgacaucuggggccaagggaccauggucacagugagcucu

SEQ ID NO: 40528 - RNA, 432 nt, Artificial Sequence
  derived and/or modified sequence opt5 from anti-HIV_cap256-038-074413_VR-Chain
caggugcaacuggucgagagcggcgggggaguugugcagcccggcgggucccuccggcugucuugcgccgcuagcggauucaccuuuuccacauacggcaugcacugggugcggcagccuccggggaagggacuugaaugggucgccuucauccgcuaugacggcucuaacacguacuaugcggauagcgugaaaggcagauuuaccauuucccgggacaauucuaagaacacacuguaccuccagaugaauagccugcgcgcugaggauaccgccguuuauuacugugccaaagaccuuggggaauccgagaacgaagagugggcuagcgauuauuacgacuucggaagagauuaccccggccaagacccuagagggguggucggaguguuugauaucuggggccaggggacaaugguuaccgugucuucc

SEQ ID NO: 40529 - RNA, 432 nt, Artificial Sequence
  derived and/or modified sequence opt5 from anti-HIV_cap256-038-073153_VR-Chain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcgcugaucagcuaugacggaacaaacaaauacuaugcugauuccgugaagggcagauucacgauuucucgggacaauagcaaaaacacccucuuucugcagaugaacucccuucgcgccgaggauacagcccuguacuauugugcuaaggaccucggcgaaagcgagaaugaagagugggccucugauuacuaugacuucgggagagauuacccgggacaagacccccggggcguuguggggaccuuugauaucuggggacagggcacaauggucaccguguccagc

SEQ ID NO: 40530 - RNA, 432 nt, Artificial Sequence
  derived and/or modified sequence opt5 from anti-HIV_cap256-038-064227_VR-Chain
gaggugcaggucguugaaagcggcgggggacuggugcaacccggcgggucccucagacugucuugcgccgcuagcggauucaccuuuuccaacuacuggaugucuugggugcggcaggccccuggcaaggggcuugagugggucgcggugaugagcuucuccggaucuggcagcuauuacgcugacuccguuaaaggccgcuuuacaaucagcucugaugacuccaugaauacgguguaucugcagaugaacagccucagagccgaagauaccgccgucuacuauugugcuaaggaccugggggagcgggaaaaugaggagugggccucugauuacuaugacuucggacgcgauuacccgggccaggaccccagaggggugguuggauccauugauacauggggccacgggaccauggugacagucagcucu

SEQ ID NO: 40531 - RNA, 432 nt, Artificial Sequence
  derived and/or modified sequence opt5 from anti-HIV_cap256-038-061640_VR-Chain
caggugcaacuggucgagagcggcgggggaguugugcagcccggcagaucccuccggcugucuugcaccgccagccgcuucuccuuuaacaauuacgcuaugcacugggugagacaggccccugggaagggacuugaaugggucgcgaucauuucuaaagacggcagcgauaacuccuauguggacucuguuaaggggcgguucacaaucagccgcgauaauuccaaaaacacgcuguaccuccagaugaauagccugagagcugaggacaccgccguguauuacugugcccgggaucuuggagaaucugagaacgaagaguggccguccgacuauuacgauuuuggccgcgacuaucccggccaagauccuagaggggucauuggaacauucgacguguggggccaggggaccaugguuacagugagcucu

SEQ ID NO: 40532 - RNA, 414 nt, Artificial Sequence
  derived and/or modified sequence opt5 from anti-HIV_cap256-038-059482_VR-Chain
agaggcgugcagugccaaguccagcugguugagagcgggggaggcguggugcagcccggguucaccuuuuccucuuacgucaugcacugggugcggcaggccccuggaaagggccucgaauggguugcugacaucagcuaugauggguccaauaaauacuaugccgacucugugaagggacgccugacaauuagcagagauaauuccaaaaacacgcuuuaccugcaaaugaacucucuccgggcggaggacaccgcugucuauuacugugugaaggaucugggcgaaagcgagaaagaagaguggccguccgacuauuacgauuucgccacaggcuaccccguucaggacccucgcgccguggucggggcuuuugauaucuggggacagggcaccauggugacagugagcccc

SEQ ID NO: 40533 - RNA, 432 nt, Artificial Sequence
  derived and/or modified sequence opt5 from anti-HIV_cap256-038-054000_VR-Chain
gaggugcagcuggucgaaagcggcggguccguugugagacccggaggcucucuccggcugagcugcgccgcuuccggguucaccuuugacgauucuggaaugagcugggugcgccaaggcccugggaagggacuugagugggucgccgugaucuccuacgacggcggcaacaaauauuacgcggauucuguuaaggggagauucacaauuagccgggacaauuccaaaaacacgcuguaucuccagaugaauagccugcgcgcugaagauaccgcccuuuacuauugugccaaggaccugggagagucugaaaacgaggagugggcuuccgauuacuaugacuuuggcagagauuacccggggcaggacagccggggaguggucggcacauucgaugugugggggcagggaaccaugguuacagugucuucc

SEQ ID NO: 40534 - RNA, 432 nt, Artificial Sequence
  derived and/or modified sequence opt5 from anti-HIV_cap256-038-050554_VR-Chain
gaggugcagcugcucgaaagcggcggggaccugguccaauccggaggcucucuuagacugagcugcguugccuccggguucaccuuuucuacacacgcuaugacgugggugcggcaggcccccggaaagggccucgaguggguggcggucaucagcuccgaugggucuaacaaaaauuucgcugacagcgugaagggacgcuuuaccauuuccagagauaacagcaaaaauacacuguaccuucagaugaacucucugcggccugaagacaccgccguuuauuacugugccaaggaucucggcgaguccgaaaaugaggagugggcuacagacuauuacgauuucagcaccggcuauccggugcaggacccccgcgccgucgugggggcuuuugauaucuggggacaaggcacaaugguuaccgugucuucc

SEQ ID NO: 40535 - RNA, 432 nt, Artificial Sequence
  derived and/or modified sequence opt5 from anti-HIV_cap256-038-044256_VR-Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacaaauaccaugccggaucuguuaagggcagauucauuaucagccgggauaauuccaaaaacacacuguaucuccagaugaauagccugcgcgccgaggacacggcucuuuacuauugugccaaggaucugggcgaaucugagaacgaagagugggcuuccgacuacuaugauuuugggagagacuacccgggacaagauccccggggcguggucgggaccuucgacauuuggggacagggcacaauggugaccguuagcucu

SEQ ID NO: 40536 - RNA, 432 nt, Artificial Sequence
  derived and/or modified sequence opt5 from anti-HIV_cap256-038-040944_VR-Chain
caggugcaacuggucgagagcggcgggggaguugugcagcccggcagaucccuccggcugucuugcgccgcuagcggguucaccuuuuccaacuacgccauggacugggugcgccaggcgccuggaaagggccuugaaugggucgcugugaucucuuaugaugggagcaauaaauacuaugccgacuccguuaagggaagauucacaauuucucgggauaacagcaaaaauacgcuguaccuccagaugaacucccugcgcgccgaggacaccgcuguguauuacugugccaaggaucuuggcgaaagcgagaaugaagagugggcuacagacuauuacgauuuuucuaccggcuacccggggcaagaccccagagccgucgugggagcguucgauaucuggggccaggggacaaugguuaccguguccagc

SEQ ID NO: 40537 - RNA, 432 nt, Artificial Sequence
  derived and/or modified sequence opt5 from anti-HIV_cap256-038-040090_VR-Chain
caggugcaacuggucgagagcggcgggggaguugugcagcccggcagaucccuccggcugucuugcgccgcuagcggguucuccuuuucuaacuacgccauggacugggugcgccaggcgccuggaaagggccuugaaugggucgcugugaucagcuccgaugggucuaauaaaaacuaugccgacagcguuaagggaagauucaccauuucccgggauaauagcaaaaacacacuguaccuccagauggacucucugcgcgccgaugacacggcuguguauuacugugccaaggaucuuggcgaguccgaaaaugaggaaugggcuaccgacuauuacgauuuuagcaucggcuauccgguccaagaccccagaggggugguuggaauuuucgauaucuggggccaggggacaauggugaccgucucuucc

SEQ ID NO: 40538 - RNA, 432 nt, Artificial Sequence
  derived and/or modified sequence opt5 from anti-HIV_cap256-038-032874_VR-Chain
caggugcaacuggucgagagcggcgggggaguugugcagcccggcgggucccuccggcugucuugcgccgcuagcggauucaccuuuuccucuuacggcaugcacugggugcggcaggccccugggaagggacuugaaugggucgcguucauccgcuaugacggcaacaauaaauacuaugcugauagcgugaagggcagauuuacaauuucccgggagaacucuaaaaauacgcuguaccuccagaugaacagccugcgcgccgaagacaccgccguuuaucauugugcuaaggaucuuggggaguccgaaaaagaggagugggccagcgacuacuaugauuucggaagagacuacccgggccaagaucccagagggguggucggaacauuugacaucuggggccacgggaccauggugacaguuucuucc

SEQ ID NO: 40539 - RNA, 432 nt, Artificial Sequence
  derived and/or modified sequence opt5 from anti-HIV_cap256-038-025899_VR-Chain
caggugcaacuggucgagagcggcgggggaguugugcagcccggcagaucccuccggcugucuugcguggccagcggguucaccuuuuccaacuacgcuauguauuggguccgccaggccccuggaaagggccuugaaugggugacaaucauuucuuucgacgggagcaaucaguacuaugcggauuccguuaaaggaagauuuacgaucucucgggagaacagcaagaauacccuguaccuccaaaugaacucccugcgcgcugaagacacagccguguauuacugugccaaagaucuuggcgagagagaaaaugaggagugggcuagcgacuauuacgauuucggccgggacuacccggggcaggauccccgcggagucgugggcucuauugacaccugggggcacggaacaaugguuaccguguccagc

SEQ ID NO: 40540 - RNA, 432 nt, Artificial Sequence
  derived and/or modified sequence opt5 from anti-HIV_cap256-038-024581_VR-Chain
cacauccagcugguggagagcggcgggggagucguucaacccggcgggucccucagacugucuugcgccgcuagcggauucccuuuuuccucuuucggcaugcauugggugcggcagaccccggggcgcggacuugaauggguggccauuaucuggagcgacggcucccacaaggaguacacagauucugucaaaggcagauuuacgauuagccgggacaacucccgcagcaccauggaucugcagaugaauaaccucagacccgaagacacagcgguguauuacugugcuaaggaucugggggagcgggaaaaugaggagugggccucugacuauuacgauuucggacgcgacuauccuggccaggaucccagagggguugugggauccaucgacaccuggggccaugggacaauggucaccgugagcucu

SEQ ID NO: 40541 - RNA, 432 nt, Artificial Sequence
  derived and/or modified sequence opt5 from anti-HIV_cap256-038-013345_VR-Chain
caggugcaacuggucgagagcggcgggggaguugugcagcccggcagaucccuccggcugucuugcgccgugagcggguucaccuuuuccucuuacggaaugcacuggguccgccaggcuccuggcaaggggcuugaauggguggccgcgaucagcuaugacggauccaacaaauacuauguugauucugugaagggcagauucacaauuagccgggacaauuccaaaaacacgcuguaccuccagaugaauagccugcgcgcugaggauaccgccgucuauuacugugccagagaccuuggcgaacgggagaucgaagagugggcuacagauuauuacgacuuuucuauuggguacccgggacaagauccccgcggcgugguugggguguucgacaucuggggacagggcaccauggucacaguguccagc

SEQ ID NO: 40542 - RNA, 438 nt, Artificial Sequence
  derived and/or modified sequence opt5 from anti-HIV_cap256-038-011559_VR-Chain
caggugcaacuggucgagagcggcgggggaguugugcagcccggcagaucccuccggcugucuugcgaagccagcggguucaccuuuuccucuuacggaauggacugggugcgccaggcuccuggcaaggggcuugagugggucgcccugaucagccacgauggauccaacaaacauuaugcggacucugugaagggcagauucacaauuagccgggauaauucccgcaacacgcucuaccugcagaugaauagccuuagagcugaagacaccgcccuguauuacugugccaaagaucucggcgagucugaaaacgaggacgaggaaugggcuuccgauuauuacgacuuugggcgggauuauccgggacaagacagccgcggcguuguggggacauucgauauguggggacagggcaccauggucacagugucuucc

SEQ ID NO: 40543 - RNA, 432 nt, Artificial Sequence
  derived and/or modified sequence opt5 from anti-HIV_cap256-038-009634_VR-Chain
caggugcaacuggucgagagcggcgggggaguugugcagcccggcagaucccuccggcugucuugcgccgcuagcggguucaccuuuacauccuucggaaugcacugggugcgccaggccccuggcaaggggcuugaaugggucgcggugaucucuuacgacggaaacaauaaauauuacgcugauagcguuaagggcagauuuacgauuucccgggagaacucuaaaaauacccuguaucuccagaugaacagccugcgcgccgaagacacagccguguaccauugugcuaaggaucuuggcgaguccgaaaucgaggaguggaccagcgacuauuacgauuucgggagagacuauccgggacaagauccccggggcgucuuugggacauucgacauuuggggacacggcaccauggugacaguuucuucc

SEQ ID NO: 40544 - RNA, 432 nt, Artificial Sequence
  derived and/or modified sequence opt5 from anti-HIV_cap256-038-006730_VR-Chain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcaaagacggauccgauaacucuuacguugacagcgugaagggcagauuuacaauuucccgggauaauagcaaaaacacgcuguaucuccagaugaacucucugcgcgcugaggacaccgccgucuacuauugugccagagaucuuggcgaauccgagaaugaagaguggccgagcgacuacuaugauuucgggcgggacuaccccggacaagauccucgcggcgugaucgggacauuugacguuuggggacagggcaccauggugacagucucuucc

SEQ ID NO: 40545 - RNA, 432 nt, Artificial Sequence
  derived and/or modified sequence opt5 from anti-HIV_cap256-038-004887_VR-Chain
caggugcaacuggucgagagcggcgggggaguugugcagcccggcagaucccuccggcugucuugcgccgcuagcggguucuccuuuucuaccagcggaaugcacugggugcgccaggccccuggcaaggggauggaaugggucgcggugaucuccuacgacggaucuaacaaauauuacgcugauagcguuaagggcagauucacaauuucccgggacaauagcaaaaacacgcuuuaucugcagaugaacucucuccgcgccguggauaccgccgucuacuauugugcuaaggaccugggcgagggggaaaaugaggaaugggccacagauuacuaugacuuuuccaucggauacccggugcaaaaucccagaggccuuguuggggcuuucgauauuuggggacagggcaccauggugacagucagcucu

SEQ ID NO: 40546 - RNA, 432 nt, Artificial Sequence
  derived and/or modified sequence opt5 from anti-HIV_cap256-038-004840_VR-Chain
caggugcaacuggucgagagcggcgggggaguugugcagcccggcagaucccuccggcugucuugcgccgcuagcggguucaccuuuuccucuuucggaaugcacugggugcgccagagcccuggcaaggggcuugaaugggucgccgugaucuccuacgacggaaacaauaaauauuacgcggauucuguuaagggcagauuuacaauuagccgggagaacuccaaaaauacgcuguaucuccagaugaacagccugcgcaccgacgauacagcuguguacuauugugccaaggaccuuggcgaaucugagaccgaagaguggccguccgauuacuaugacuucgggagagauuaccccggacaagacccucggggcgucguggggacauuugauaucuggggacauggcaccaugguuacagugagcucu

SEQ ID NO: 40547 - RNA, 432 nt, Artificial Sequence
  derived and/or modified sequence opt5 from anti-HIV_cap256-038-002181_VR-Chain
gaggugcagcuggucgaaagcggcgggggacucguucaacccggcagaucccugcggcuuucuugcgccgcuagcggguucaccuuugaggacuacgccaugcacugggugcgccaggcgccuggaaagggccuggaauggguggcugucaucuccuaugaugggucuaacaaauacuauguggacagcguuaagggaagauucacaauuucccgggauaauucuaaaaacacgcucuaccugcagaugaauagccuucgcgccgaggacaccgccguguauuacugugcuaaggaucugggcgaauccgagaacgaggaaugggccacagacuauuacgauuuuagcaucggcuacccggggcaggaccccagaggagucgugggcauuuucgauaucugggggcaaggaaccaugguuacagugucuucc

SEQ ID NO: 40548 - RNA, 432 nt, Artificial Sequence
  derived and/or modified sequence opt5 from anti-HIV_cap256-038-001902_VR-Chain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcuacgacggaaacaauaaauauuacgcugauuccguuaagggcagauuuacaauuucucgggagaacagcgaaaauacgcuguaucuccagaugaacucccugcgcgccgacgauaccgccguguacuauugugcuaaagaccuuggcgagagcgaaaaugaggagugggccucugauuacuaugacuucgggagagauuacccgggacaagacacacggggcgucguggggaccuuugauaucuggggacauggcacaaugguuaccguguccagc

SEQ ID NO: 40549 - RNA, 432 nt, Artificial Sequence
  derived and/or modified sequence opt5 from anti-HIV_cap256-038-000976_VR-Chain
caggugcaacuggucgagagcggcgggggaguugugcagcccggcagaucccuccggcugucuugcgccgcuagcggguucaccuuuuccucuuucggaaugcacugggugcgccaggccccuggcaaggggcuugaaugggucgcggugaucagcgacgauggaaacaauaaauacuaugcugacuccguuaagggcagauuuacaauuucucgggauaacagcaaaaauacgcuguaccuccagaugaacucccugcgcguggaggacaccgccgucuauuacugugugaaggauguuggcgaaagcgagaaugaagagugggccucugacuauuacgauuucgggagagacuauccgggacaagauacacgggcuguggucggcgccuuugacaucugggggcagggaaccauggugacaguguccagc

SEQ ID NO: 40550 - RNA, 432 nt, Artificial Sequence
  derived and/or modified sequence opt5 from anti-HIV_cap256-038-000384_VR-Chain
caggugcaacuggucgagagcggcgggggaguugugcagcccggcaagucccucagacugucuugcgccgcuagcggguucaccuuuuccucuuacgugaugcacuggguccggcaggccccuggaaaaggccuugaauggguggcggacaucagcuaugauggguccaacaaguacuaugcugacucuguuaaaggacgccugacaauuagcagagauaauuccaagaacacgcucuaccugcagaugaauagccuucgggccgaggacaccgccguguauuacugugucaaagaucugggcgaaucugagaaggaagaguggccguccgacuauuacgauuucggccgcgacuaccccgggcaagauagcagaggagugguuggcguguuugacaucugggggcagggaacaauggucaccgugucuucc

SEQ ID NO: 40551 - RNA, 321 nt, Artificial Sequence
  derived and/or modified sequence opt5 from anti-HIV_206-314431_VR-Chain
caguucgugcugacccaacccccuagcgucuccgccgcuccgggccagaacguuacaaucucuugcagcgggcccccuucccacauugagaagaaugacgugucuugguaccagagacuccccggaauggccccuaaaauggugaucuaugaaagccggcgcagaccccugggcauuccuguccgguuuacggcgucccgcucugggagcuccgcuacccuugugaucacaggacugcagaccgccgaugaggccgacuacuauuguggcacaugggaugggagaaugaacuucggaaccggcacaaccguuacggugcuc

SEQ ID NO: 40552 - RNA, 321 nt, Artificial Sequence
  derived and/or modified sequence opt5 from anti-HIV_206-247594_VR-Chain
cagagcauccugacccaacccccuuccgugucugccgcuccgggccagaacgucacaauuagcugcuccgggcccccuucucacaucgagaagaaugacguuagcugguaccagagauuccccggaauggccccuaaaaugauuaucuaugaauccaagcggcgccccuuuggcgugccugggagauucucugcgagccgguccggaaaaagcgcuacgcucgccauuaccggccugcagacaggggaugaggccgacuacuauuguggaaccugggauggccgcaugaacuuuggcacagggaccacagugaccguccuu

SEQ ID NO: 40553 - RNA, 321 nt, Artificial Sequence
  derived and/or modified sequence opt5 from anti-HIV_206-116890_VR-Chain
cagagcgugcugacccaacccccuuccgucucugccgcuccgggccagaacguuacaaucagcugcuccgggcccccuucucacauugagaagaaugacgugagcugguaccagcaucuccccggagaagccccuaaaaugaucauuuaugaguccuggagacggcccgcgggcaucccugcucgcuucucugccagcagauccggaaagagcgggacgcuggccauuaccggccuucagacaggggaugaagcugacuacuauuguggaaccuggaacggccggaugaauuuuggcacagggaccacagugaccguccug

SEQ ID NO: 40554 - RNA, 333 nt, Artificial Sequence
  derived and/or modified sequence opt5 from anti-HIV_206-072383_VR-Chain
cagagcgugcugacccaacccccuuccgucucugccgcuccgggccagagaguuaucauuagcugcuccgggaacaauucuacaaucggaaacaauuucgugagcugguaccaacaggugcccggcacggccccuaagcuccugauuuaugagaccaaccggcgccccuccgggaucccugacagauuuucuggaagcaaauccggcacaagcgcgacccuugcuauuucugggcugcagacaggagaugaagccgacuucuacuguaccgucuggggcgugcggaagggcguugccgcuguguuugggacaggaacccgccucacgguccug

SEQ ID NO: 40555 - RNA, 333 nt, Artificial Sequence
  derived and/or modified sequence opt5 from anti-HIV_206-037527_VR-Chain
cagagcgugcugacccaacccccuuccgucucugccgcuccgggccagaagguuaucauuagcugcuccgggaacaauucuacaaucggaaaaauucucgugagcugguaccaacaggugcccggcacggccccuaagcuggucaucuaugagaccaacagacggcccuccgggauuccugaccgcuucucuggaagcaaauccggcacaagcgcgacccuugcuaucacagggcugcagaccggagaugaagccgacuacuuuuguaagguguggggcguuagaaaaggcguggccgcugucuucgggacaggaaccaaggugacgguucuc

SEQ ID NO: 40556 - RNA, 333 nt, Artificial Sequence
  derived and/or modified sequence opt5 from anti-HIV_206-009095_VR-Chain
cagagcgugcugacccaacccccuuccgucucugccgcuccggcccagagaguuaucauuagcugcuccggcgacaacucuacaaucgggaauaacuucgugagcugguaccaacaggugcccggagcggcuccuaagcuccugauuuaugagacgaaucggcgccccuccggcaucccugauagauuuucugggagcaaauccggaaccacagccacccuugccauuagcggccugcagacaggggacgaagcugauuaccacuguaccgucuggggagugcggaagggcguugccgcuguguucggcacagggaccaaagucacggugcuc

SEQ ID NO: 40557 - RNA, 321 nt, Artificial Sequence
  derived and/or modified sequence opt5 from anti-HIV_176-503620_VR-Chain
cagagcgugcugacccaacccccuuccgucucuacagccccgggccagacgguuaccgugagcugcuccgggggaacaucuaacaccggcaauaacuucgugagcugguaccagcaccuccccgggacagcuccuaagcugcuuaucuaugagaauaacaaaagaccccugggagucccugaccgguuuuccggcgccaagucugggaccagcgcgacacucgcucugaccggacuucagacgggcgaugaaggcgacuacuauugugccaccugguccgggagccugaauauuggaacaggcaccaaagugucuguucuc

SEQ ID NO: 40558 - RNA, 321 nt, Artificial Sequence
  derived and/or modified sequence opt5 from anti-HIV_176-478726_VR-Chain
cagagcgugcugacccaacccccuuccgucucugccgcuccgggccagaacguuaauaucagcugcuccgggcccccuucucacauugagagaaacgacgugagcugguaccagcaucuccccggagccgcgccuaagaugaucauuuaugaauccuggcggcgccccgcuggcaucccugauagauucucugccagccgguccggggccagcgcuacacuggccauuacgggacuucagaccggcgacgaggcugauuacuauugugggacauggaauggacgcaugaacuuuggcaccggcacaaccgugacaguccug

SEQ ID NO: 40559 - RNA, 321 nt, Artificial Sequence
  derived and/or modified sequence opt5 from anti-HIV_176-245056_VR-Chain
cagagcgugcugacccaacccccuuccgucucugccgcuccgggccagaacguuacaaucagcugcuccgggcccccuucucacauugagaagaauggagugagcugguaccagcaguuccccggcauggccccuaaaauggugaucuaugaauccaagagacggcccuuuggggucccugcgcgcuucucugcuagcagauccggaaaaagcgccacgcucgccauuaccggccugcaaacaggggacgaggcugauuacuauuguggaaccugggacggccggaugaacuuuggcacagggaccacagugaccguucuu

SEQ ID NO: 40560 - RNA, 321 nt, Artificial Sequence
  derived and/or modified sequence opt5 from anti-HIV_176-164413_VR-Chain
cagagcgugcugacccaacccccuuccgucucugccgcuccgggccagaagguuacaaucagcugcuccgggggaacgucuaacauuggcaauaacuacgugagcugguaucagagacuccccgggaccgccccuaaacugcuuaucuacgagaauaacaagcggcccuccggcauuccugaccgcuucucuggacccaaaagcgggacauccgcgacccuggcuaucacaggacuccagccuggcgaugaagccgacuauuacugugccaccuggagcggcucucugaauuuugggacaggaaccaaggugacgguccuu

SEQ ID NO: 40561 - RNA, 333 nt, Artificial Sequence
  derived and/or modified sequence opt5 from anti-HIV_176-094308_VR-Chain
cagagcgugcugacccaacccccuuccgucucugccgcuccgggccagaagguuaucauuagcugcuccgggaacaauucuacaaucggaaacaauuucgugagcugguaccaacaggugcccggcacggccccuaaacuccuggucuaugagaccuacagacggcccuccgggauuccugaccgcucuagcggauccaagagcggcacaaccgcgacacaggcuaucucugggcuucagaccggagaugaagccgacuaucacuguacaguguggggcguuagaaaaggcguggccgcugucuuugggaccggaacgaaggugaccguucug

SEQ ID NO: 40562 - RNA, 333 nt, Artificial Sequence
  derived and/or modified sequence opt5 from anti-HIV_176-065321_VR-Chain
cagagcgugcugacccagcccccuuccgucucugccgcuccgggcagacggguuaucauuagcugcuccgggaacaauucuacaaucggaaacaauuucgugagcugguaccaacaggugcccggcacggccccuaagcuccuggucuaugagaccaaccgcagacccuccgggauuccugaccgguuuucuggaagcaaauccggcacaagcgcgacccuugcuaucucugggcugcagacaggagaugaagccgacuacuauuguaccguguggggcguucgcaagggcguggccgcugucuucgggacaggaaccaaagugacgguucuc

SEQ ID NO: 40563 - RNA, 324 nt, Artificial Sequence
  derived and/or modified sequence opt5 from anti-HIV_119-099719_VR-Chain
cagagcgugcugacccaacccccuuccgucucugccgcuccgggccagaagguuacaaucagcugcuccgggucuaacagcuacauuggaaauaaauauaucuccugguaccagcaguuccccggcacggccccuaagcuccugauuuaugagaacaauaaaagacccucuggggugccugaccgguuuagcgcguccaagagcgcuaccucugccacacuugccaucaccggacugcacacaggcgaugaagcugacuacuauugugagaccugcgauggguccggaggcguguucggcacagggaccaaagucacggugcuc

SEQ ID NO: 40564 - RNA, 327 nt, Artificial Sequence
  derived and/or modified sequence opt5 from anti-HIV_119-099536_VR-Chain
gagcugacccagcccccuagcguguccgccgcuucuggccaaaacgucaauaucagcugcuccgggggaucuagcaacauuggcuccaauuacguuucuugguaucagcaguucccggggacagcccccaagcuccugaucuacgaaacgaacaaaagaccuagcggcauucccgaccgguuuuccggaagcaagucuggggcguccgcuacccuugccaucacaggacugcagaccggcgaugaggccgacuauuacugugcuacaugggccgauagccucaauucugcucgcguguucggcaccgggacaaaagugaccguccug

SEQ ID NO: 40565 - RNA, 333 nt, Artificial Sequence
  derived and/or modified sequence opt5 from anti-HIV_119-098907_VR-Chain
cagagcgugcugacccaacccccuuccgucucugccacaccgggccagaagguuacgaucagcugcuccgggucuaacagcaauauuggagacaaauacguguccugguaucagcacuuccccggcaccgcuccuaagcuccugguguacgagacauauagacggcccucugggaucccugaucgcuuuagcggauccaaaagcggcaccucugccacacuugcgauuaccgggcugcagacaggagacgaagcugauuacuauuguaccaucuggggcgucagaaagggcgugggggccguuuucggaacgggcaccaaagugauuguccuc

SEQ ID NO: 40566 - RNA, 324 nt, Artificial Sequence
  derived and/or modified sequence opt5 from anti-HIV_119-098555_VR-Chain
cagagcgugcugacccaacccccuuccgucucugccgcuccgggccagaacguuacaaucagcugcuccgggucugccagcaauauuggaaagaacuucguguccugguaccagcagcuccccggcacggcgccuaaacugcuuaucuaugggucuaauaacagacccagcggagugccugaccgguuuuccggcagcaagucugggaccuccgcuagccuggccauuacaggacuccaaaccggcgaugaggccgacuacuauugugaaacaugggauggcucuggggcugucuucggaaccggcacaaaagugaccguucug

SEQ ID NO: 40567 - RNA, 324 nt, Artificial Sequence
  derived and/or modified sequence opt5 from anti-HIV_119-097828_VR-Chain
cagagcgugcugacccaacccccuuccgucucugccgcuccgggccagaagguuacaaucagcugcuccgggucuagcuccaacauuggcaaaaauuacgugucuugguaucagcuccugcccggaacggccccuagacuugugaucuacgagaacgacgaacggcccagcgggaccccugaucgcuucuccggaagcaagucuggcacauccgcgacccuggcuauuacagggcuccacaccggagacgaggccgauuauuacugugaaacaugggacggcagcggcggggucuuuggaaccggcacgaaagugaccguucug

SEQ ID NO: 40568 - RNA, 324 nt, Artificial Sequence
  derived and/or modified sequence opt5 from anti-HIV_119-096480_VR-Chain
cagagcgugcugacccaacccccuuccgucucuggcgccccggggcagagaaucacaauuagcugcuccggaucuacgagcaacaucggccagaauuacguuuccugguaucagcaacuccccgggaccgcuccuaagcugcuuauuucugacaacaaucggcgccccagcuggacaccugauagauucuccggaagcaaaucuggcaccuccgccacacuggcgaucaccgggcuccagacaggagacgaggcugauuacuauugugaaaccugggacggcagcggcgggguguuuggacccggcacgcgggugaccguccug

SEQ ID NO: 40569 - RNA, 324 nt, Artificial Sequence
  derived and/or modified sequence opt5 from anti-HIV_119-095664_VR-Chain
cagagcgugcugacccaacccccuuccgucucugccgcuccgggccagaagguuacaaucagcugcuccgggggagccgcgaacauuggcaaaaauucugugagcugguaccagcagcuccccgggacggcuccuaagcugcuuaucuaugacaacaauagacggcccuccggaaccccugaucgcuucucuggcagcaaauccgggacaagcgccacccuggccauuucuggacuccaaacaggcgacgaggcugauuacuauugugaaaccuggcacggcuccgggggaguguuuggcacagggaccaaggucacggugcug

SEQ ID NO: 40570 - RNA, 321 nt, Artificial Sequence
  derived and/or modified sequence opt5 from anti-HIV_119-095212_VR-Chain
cagagcgugcugacccaacccccuuccgucucugccgcuccgggccagaagguuacaaucagcugcuccgggucuacgagcaacauuggaaaauccgacguguucugguaccagcagcuccccggcaccgccccuaagcugcuuaucucugagacaagcagacggcccuccgggauuccugaucgcuuuagcggagcgaaaucuggcaccuccgcuacacuggccaucaccgggcuccaaacaggagacgaagccgauuauuucuguagcaccuggucuggcucccugaauuuuggcacggggaccagagugacaguccuu

SEQ ID NO: 40571 - RNA, 333 nt, Artificial Sequence
  derived and/or modified sequence opt5 from anti-HIV_119-094773_VR-Chain
cagagcgugcugacccaaucccccacagucucugccgcuccuggccagacgguuaccaucagcugcuccgggggaacaucuaacgugggcaagaauuucgugagcugguaccagcaguuuccgagaaccgcccccaaacuccugauuuaugagaacaauaagcggccuuccgggauccccgaccgcuucucuggaagcaaauccggcacaagcgcgacccuugucauuacagggcugcaaaccggagaugaagcugacuuuuacuguggcacgugggauggcucucucagaaccgggggagugaucggcacagggacccggguuacagugcug

SEQ ID NO: 40572 - RNA, 324 nt, Artificial Sequence
  derived and/or modified sequence opt5 from anti-HIV_119-094508_VR-Chain
cagagcgugcugacccaacccccuuccgucucugccacaccgggccagagaguuacggugagcugcuccgggucuagcuccaacaucggaaaucacuacgugucuugguaucagcagguccccggcaccgcuccuaagcuccugauuagcgagaacucccggcgccccagcgggacaccugacagauucucuggauccaaaagcggcaccucugccacacuugcgaucaccgggcugcaaacaggagaugaagcugacuacuauugugagaccugggauggcuccggcgggguguuuggaacgggcaccaagguuacagugcuc

SEQ ID NO: 40573 - RNA, 324 nt, Artificial Sequence
  derived and/or modified sequence opt5 from anti-HIV_119-093795_VR-Chain
cagagcgugcugacccaacccccuuccgucucugccgcuccgggccagaagguuacaaucagcugcuccgggucuagcuccaacauuggaaauaacuacgugucuugguaucaguaccuccccggcacggccccuaaacugcuuaucagcgagaauaacagacggcccuccgggaccccugaccgcuucagcggaucuaaguccggcacaagcgcgacccuggcuauuacagggcuccagaccggagaugaagccgacuauuacugugagacaugggauggcucuggcgggguguuuggaaccggcacgaaagucaccgugcug

SEQ ID NO: 40574 - RNA, 321 nt, Artificial Sequence
  derived and/or modified sequence opt5 from anti-HIV_119-093732_VR-Chain
cagagcgugcugacccaacccccuuccgucucugccgcugccggccagaacguuaauaucagcugcuccgggagaaagucuaacgugggaggcaauuacgugagcugguaucagcaguucccggggacagcgcccaaacuccugauuuacgaggacaacaagcggccuuccuggauccccgaucgcuuuacggcuucuagaagcggaaccuccgccacacuuggcauuaccgggcugcaaacaggagacgaagccgauuauuucuguagcaccuggucuggcucccucaauuuuggcacagggacccgggucacggugcug

SEQ ID NO: 40575 - RNA, 333 nt, Artificial Sequence
  derived and/or modified sequence opt5 from anti-HIV_119-092903_VR-Chain
cagagcgugcugacccaacccccuuccgucucugccgcuccgagacagaagguuacaaucagcugcuccggcucuagcuccaacauugggaaucacuacgugucuugguaucagcagcuccccggaacggccccuaaacugcuuaucuacgagaacaauaagcggcccagcggcauuccugaccgcuucuccgggagcaaaucuggaaccuccgcgacacuggcuaucaccggccuccaaacaggggaugaagccgacuauuacugugccaccugggcucccagacugaacagcgcccggguguuuggaaauggcacaauggucaccgugcuu

SEQ ID NO: 40576 - RNA, 333 nt, Artificial Sequence
  derived and/or modified sequence opt5 from anti-HIV_119-092284_VR-Chain
cagagcgugcugacccaacccccuuccgucucuggcgccccggggcagagaguuacaaucagcugcacgggauccucuagcaacauuggcggguacgacgugcacugguaucaacaggugcccggaaccgcuccuaagcuccugcuuuacgagaaugaucggcgccccuccggcaucccugacagauucucugggagcaaauccggaacaagcgccacccuggucauuacaggccuccagaccggcgaugaagcggacuuuuauugugggacaugggauggaucucugcggaccggcggggugaucggaacgggcacccgcguuacagugcuu

SEQ ID NO: 40577 - RNA, 333 nt, Artificial Sequence
  derived and/or modified sequence opt5 from anti-HIV_119-091586_VR-Chain
cagagcgugcugacccaacccccuuccaugucugccgcuccgggccagagagucacaaucagcugcuccgggacgucuagcgacauuggacggaacuacguuuccugguaucagcaguuccccggcgccgcgccuaaggugcucaucuacgaaaauucuaaccgccccagcgggauuccugauagauuuuccggaagcaaaucuggcaccuccgcuacacuggccaucagcgggcuucaaaccggagacgaggccgauuauuguugcgcuguguggggcguccggcgcggcgccggggcuguguucggagccggcacaaagguuaccgugcug

SEQ ID NO: 40578 - RNA, 333 nt, Artificial Sequence
  derived and/or modified sequence opt5 from anti-HIV_119-091023_VR-Chain
cagagcgugcugacccaacccccuuccgucucugccgcuccgggccagagaguuacaaucagcugcuccgggucuacgagcaacauuggaaauaacuucguguccugguaccaccaugugcccggcaccgccccuaagcuccugaucuaugacaaugucaaacggcccacaaacgugccugaucgcuuuucugggagcaaguccggaaccagcgcgacacuugcuauuucuggccugcagaccggggacgaggccgauuacuggugugccguuuggggagugagacggggcgcuggcgccgucuucggggcuggaacaaaagugaccguucuc

SEQ ID NO: 40579 - RNA, 333 nt, Artificial Sequence
  derived and/or modified sequence opt5 from anti-HIV_119-090334_VR-Chain
cagagcgugcugacccaacccccuuccgucucuggcgccccggggcagagaguuacaaucagcugcacgggauccgcuucuaacauuggcgacagcgaugugcacugguaccagcagcuccccgggaccgccccuaagcugcuuaucuucgacaaugauaaacggcccuccggcauuccugaccgcuuuucuggaagcaaguccgggacaagcgcgacccuggcuaucacaggacuccaaucuggcgaugaggccgacuauuacugugccguguggggcgucagacagggggcuggagccguguucggcaccgggacaaaaguuaccgugcug

SEQ ID NO: 40580 - RNA, 333 nt, Artificial Sequence
  derived and/or modified sequence opt5 from anti-HIV_119-088694_VR-Chain
cagagcgugcugacccaacccccuuccgucucugccgcuccgggccagaagguuacaaucagcugcuccgggucuagcuccaacauucccaucaauggagugucuugguaccagcaguucccuggcacggcccccaaacuccugguguaugagaccuacagacggccuagcgggauucccgaccgcuuuuccggaagcaagucuggcacauccgcgacccuugcuaucacagggcugcaaaccggagaugaagccgacuauuacuguacagucuggggcgugagaaaaggcguuggggccguguucggaaccggcacgaaggucaccgugcuc

SEQ ID NO: 40581 - RNA, 333 nt, Artificial Sequence
  derived and/or modified sequence opt5 from anti-HIV_119-088499_VR-Chain
cagagcgugcugacccaacccccuuccgucucugccgcuccgggccagaagguuacaaucagcugcuccgggucuaacagcuacauuggaaauaaauauguguccugguaccagcaguuccccggcacggccccuaagcuccugaucuaugagaccaacaaaagacccucugggauuccugaccgguuuagcggauccaagagcggcacaucugcgacccuugcuaucacagggcugcaaaccggagaugaagccgacuacuauugugccacaugggcuccccgccucaauuccgccagaguguucggcaacggcaccauggucacggugcug

SEQ ID NO: 40582 - RNA, 333 nt, Artificial Sequence
  derived and/or modified sequence opt5 from anti-HIV_119-088298_VR-Chain
cagagcgugcugacccagcccccuuccgucucugccgcuccgaaggagaaaguuacaaucagcugcuccggcgggacgucuaacauuggaagaaauuacgugagcugguaucaacaggugcccggcaccgccccuaagcuccugaucuacgaaaacaauaaacggcccuccgggauuccugaccgcuucucuggaagcaaguccggcacaagcgcgacccuugucaucacagggcugcagaccggagaugaggcugacuuuuauuguggcacauggggcgggucucucagaaccggaggcgugcuggggacgggaacccggguuacagugcuu

SEQ ID NO: 40583 - RNA, 324 nt, Artificial Sequence
  derived and/or modified sequence opt5 from anti-HIV_119-087488_VR-Chain
cagagcgugcugacccaacccccuuccgucucugccgcuccgggccagaagguuacaaucuucugcagcgggagauacuccaacauugagucuaauuaugugagcugguaccagcagcuccccggaacggccccuaaacugcuuauccacgaaaacaaucggcgccccuccggcaccccugacagauuuucugggagcaaguccggaacaagcgcgacccuggcuauuacaggccuccauaccggggaugaggccgacuauuacugugaaacaugggauggaucuggcggcguguucgggaccggaacgaaagucaccgugcug

SEQ ID NO: 40584 - RNA, 333 nt, Artificial Sequence
  derived and/or modified sequence opt5 from anti-HIV_119-087423_VR-Chain
cagagcgugcugacccaacccccuuccgucucugccgcuccgggccagaagguuacaaucagcugcuccgccucuagcuccaacauugggaauaacuacgugucuugguaucagcagcuccccgcgacggcuccuaaacugcuuaucuacgacaccgauaagagacccagcgggauuccugaccgguucuccggcagcaaaucugggacauccgccacccuggccaucacaggacuccaaaccggcgaugaggcugacuauuacuguacaguguggggaguccgcaagggagugggcgccguuuuuggcaccgggacgaaagugaccguccug

SEQ ID NO: 40585 - RNA, 324 nt, Artificial Sequence
  derived and/or modified sequence opt5 from anti-HIV_119-087371_VR-Chain
cagagcgugcugacccaacccccuucccucucugccgcuccgggccagagagucacaaucagcugcuccgggggagccucuaacauuggcaagaauagcguuuccugguacguccaggugcccgggacggcgccuaaacugcuuaucuaugagaacaaucagcggcccucuggaauuagcgaccgcuucuccggcagcaagucuggguccagcgcuacccugggaaucacaggccuccaaaccgccgaugaagccgacuacuauugugagacaugggauggcucugggggaguguuuggcaccgggacaaaagugaccguucug

SEQ ID NO: 40586 - RNA, 321 nt, Artificial Sequence
  derived and/or modified sequence opt5 from anti-HIV_119-087279_VR-Chain
cagagcgugcugacccaacccccuuccgucucugccgcuccgggccagaagguuacaaucagcugcuccgggucuagcuccaacauuggcaaaaauuacgugucuugguaucagcaguuccccggaacggccccuaagcuccugauguacgagaacaauaaaagacccagcggggugccugaccgguuuuccggaagcaagucuggcaccuccgcgacacuugauaucagcgggcugcaaaccggagacgaagcugauuauuacuguucuacaugguccggcagccucaacuucggcaccgggacacgcgucaccgugcug

SEQ ID NO: 40587 - RNA, 324 nt, Artificial Sequence
  derived and/or modified sequence opt5 from anti-HIV_119-087146_VR-Chain
cagagcgugcugacccaacccccuuccgucucugccgcuccgggccagaagguuacaaucagcugcuccgggucuagcuccaacauuggcaaaaauucugugagcugguaccagcaguuccccggaacggccccuaagcuccugaucuaugagaacaauaaaagacccuccgggauuccugaccgguuuagcggaucuaaguccggcaccagcgcgacacuugcuaucaccgggcugcacacaggagaugaagccgacuacuauugugagaccugggauggcucuggcgggguguucggaacaggcaccaaagucacggugcuc

SEQ ID NO: 40588 - RNA, 324 nt, Artificial Sequence
  derived and/or modified sequence opt5 from anti-HIV_119-087048_VR-Chain
caguucgugcugacccaacccccuagcgucuccgccgcuccgagacagaagguuaucauuucuugcagcggcuccucuagcaacaucgggaaaaauuacguguccugguaucagcagcuccccggaacagccccuaagcugcuuauuuacgacaacgauaaacggcccucuggcaucagcgaccgcuuuuccgcgagcaagucugggacguccgcuacccuggccauuacaggacuccacaccggcgaugaggccgacuauuacugugaaacaugggaugggagcggaggcguguucggcaccgggacaaaagucaccgugcug

SEQ ID NO: 40589 - RNA, 321 nt, Artificial Sequence
  derived and/or modified sequence opt5 from anti-HIV_119-085802_VR-Chain
cagagcauccugacccaacccccuuccgugucugccgcuccgggccagagagucacaauucccugcuucgggggacacagcaacaucggcuccaauuacguuucuugguaucagcaucucccugggacggcccccaagcugcuuauuuuugagaacaauaaacggccuagcggaauccccgaccgcuucuccggcgcgaagucugggaccagcgcuacacuggccauuaccggacuccagacaggcgaugaagccgacuacuuuugugcuaccugguccggcgggcugaacuucggaacaggcaccaaagugacggugcuu

SEQ ID NO: 40590 - RNA, 324 nt, Artificial Sequence
  derived and/or modified sequence opt5 from anti-HIV_119-085784_VR-Chain
cagagcuuccugacccaacccccuuccgugucugccgcuccgggccagaaggucacaaucagcugcuccgggucuaacagcaauauuggaaacaauuacguuuccugguaucaguaccuccccggcacggccccuaaacugcuuaucuaugagaacgacagacggcccucugggaccccugaucgcuuuagcggauccaagagcggcacaucugcgacccuggcuauuacagggcuccagaccggagacgaagccgauuacuauugugagacaugggacggcuccggcgggguguucggaaccggcacgaaagugaccguccug

SEQ ID NO: 40591 - RNA, 333 nt, Artificial Sequence
  derived and/or modified sequence opt5 from anti-HIV_119-085370_VR-Chain
cagagcgugcugacccaacccccuuccgucucugccgcuccgggccagacaguuacgaucagcugcuccgggucuagcuccaacauuggaaauaccuacgugucuugguaucagcaccuccccggcacagccccuaagcugcuuaucuacgacaacaauauuagacccagcgggaucccugaucgguucuccgcgagcaaaucuggaaccuccgcuacacuggccauuaccggccuccagacaggggacgaggccgauuauuacugugcuaccugggcccccagccugaacucugcucgcguguuuggauccggcacgagagucgccgugcuu

SEQ ID NO: 40592 - RNA, 321 nt, Artificial Sequence
  derived and/or modified sequence opt5 from anti-HIV_119-085276_VR-Chain
cagagcauccugacccaacccccuuccgugucugccgcuccgggccagagagucacaauuagcugcuccgggucuagcuccaacaucggaaauaacuacguuucuugguaucagcacgugcccggcacggccccuaagcuccugauuuacgagaauaaccggcgccccagcgggaccccugacagauucuccggagcgaaaagcggcacaucugcuacccuugccaucacagggcugcagaccggagaugaagccgacuauuuuuguuccacauggagcggcucucucaauuucggcaccgggacgaaggugaccguccug

SEQ ID NO: 40593 - RNA, 333 nt, Artificial Sequence
  derived and/or modified sequence opt5 from anti-HIV_119-084885_VR-Chain
cagagcgugcugacccagcccccuuccgucucugccgcuccgggcgagaagguuacaaucagcugcuccgggucuagcuccaaaauuggaaacaauuucgugucuugguaccaacaggugcccggcacggccccuaagcuccuggucuaugaaagcuacagacggcccuccgggaucccugaccgcuuuagcggaucuaaauccggcaccagcgcgacacuugcuauuaccgggcugcagacaggagaugaggccgacuauuacuguaccguguggggcguuagaaagggcgugggggccgucuucggaacaggcaccaaagugacgguucuc

SEQ ID NO: 40594 - RNA, 333 nt, Artificial Sequence
  derived and/or modified sequence opt5 from anti-HIV_119-084874_VR-Chain
cagagcgugcugacccaacccccuuccgucucuggcgccccgagacagcggguuacaaucagcugcuccgggucugcuagcaacauuggaaagaacuccgugucuugguaccaacaggugcccggcacggccccuaaacuccugaucuaugagaauaauaagcgccccagcgggauuccugacagauucuccggaagcaaaucuggcaccuccgcgacacuugucaucaccgggcugcagacaggagaugaagcugacuuuuacuguggcaccugggauggcagccuccggacagggggagugauuggcaccgggacgcgcguuaccgugcug

SEQ ID NO: 40595 - RNA, 333 nt, Artificial Sequence
  derived and/or modified sequence opt5 from anti-HIV_119-084691_VR-Chain
cagagcgugcugacccaacccccuuccgucucugccgcuccgggccagaagguugugaucagcugcuccgggucuagcuccauuaucgagaaaaacucuauuagcugguaccagcagggacccggcgccgcgccuaagcuccugaucuaugaaaaugacaaaagacccuccgggauuccugaucgguucagcggaucuaaguccgcuacaagcgccacgcuugccaucgugggccugcaaaccggggacgaggcugauuacuguugcgccgucuggggagugcgcagaggcgcuggcgccguuuuuggggcgggaacaaaagugaccguccuc

SEQ ID NO: 40596 - RNA, 324 nt, Artificial Sequence
  derived and/or modified sequence opt5 from anti-HIV_119-083793_VR-Chain
cagagcgugcugacccaacccccuuccgucucugccgcuccgggccagaagguuacaaucagcugcuccgggucuagcuccaacauuggcaaaaauucugugagcugguaccagcagcuccccgccacggcgccuaagcugcuuaucuaugaguccaacaaaagacccagcgggauuccugaccgguucucuggauccaagagcggaaccucugcuacacuggccaucaccggccuccaaacaggggaugaagccgacuacuauugugcuaccugggauggacgcguguccgucauuggcacaggcaccaaagugacgguucug

SEQ ID NO: 40597 - RNA, 324 nt, Artificial Sequence
  derived and/or modified sequence opt5 from anti-HIV_119-083163_VR-Chain
cagagcgugcugacccaacccccuuccgucucuggcgccccggggcagagaguuaucauuagcugcacaggauccucuagcaacaucuggggcuacgacgugcagugguaucagcaacuccccgggacggcuccuaagcugcuucuguacgagaaugaucggcgccccuccggaaccccugacagauucucuggcagcaaauccgggacaagcgccacccucgcgauuacaggacugcacaccggcgaugaagcugacuauuacugugagacaugggauggcucugggggaguguuuggcaccgggacgaaggucaccgugcuu

SEQ ID NO: 40598 - RNA, 333 nt, Artificial Sequence
  derived and/or modified sequence opt5 from anti-HIV_119-082331_VR-Chain
cagagcgugcugacccaacccccuuccaucucugccgcuccgggccagaaggucacaauuagcugcuccgggggaucuagcaacaucggcgccaauuacguuuccugguaucagcaccuccccgggacggcgccuaaacugcuuauuuacgagaccaacaagagacccucuggaaucccugaccgguucagcggcucccagagcgggacaucugcuacccuggugauuacaggacuccaaaccggcgaugaagccgacuuuuauuguggcacauggggagggucccugcgcgccggcggggugaucggaaccggcacgagagucaccgugcuu

SEQ ID NO: 40599 - RNA, 324 nt, Artificial Sequence
  derived and/or modified sequence opt5 from anti-HIV_119-082070_VR-Chain
cagagcgugcugacccaacccccuuccgucucugccgcuccgggccagaagguugugaucagcugcuccgggucuagcuccauuaucgagaaaaacucuauuagcugguaccagcagggacccggcgccgcgccuaagcuccugaucuaugaaaaugacagacggcccuccgggacaccugaucgcuucagcggaucuaaauccggcacgagcgcuacccuugccauuacagggcugcaaaccggagacgaggccgauuacuauugugaaacaugggacggcucuggcgggguguuuggaaccggcacaaaggucaccgugcuc

SEQ ID NO: 40600 - RNA, 333 nt, Artificial Sequence
  derived and/or modified sequence opt5 from anti-HIV_119-081512_VR-Chain
cagagcgugcugacccaacccccuuccgucucugccgcuccgggccagaacguuacauucagcugcuccgggucuaauagcaacaucggagacaauuacguguccugguaucagcagauucccggcacggccccuaagcucgugaucuacgauaacaauaaaagacccucugggauuccugaccgguuuagcggauccaagagcggcaccucugcgacacuggucaucaccgggcuucaaacaggagaugaggcugacuucuauuguggcaccugggauggcucccugcgcacagggggagugauuggcaccgggacgagaguuaccgugcuc

SEQ ID NO: 40601 - RNA, 333 nt, Artificial Sequence
  derived and/or modified sequence opt5 from anti-HIV_119-080816_VR-Chain
cagcuggugcucacccaacccccuagcgccuccggcacaccggggcagagagucacgaucucuugcagcggauccucuagcaacauuggcuccaauuucguuucuugguaccagcagcggcccgggaccgcuccuaagcugcuuaucuaugagacaaacaaacgccccagcggcauuccugacagauuuuccggaagcaagucugggaccuccgccacacuggcgaucaccggacuccaaacaggcgaugaagcugacuacuauugugccaccugggcuccccggcugaauagcgcccgcguguucggcaacgggacgauggugaccguccuu

SEQ ID NO: 40602 - RNA, 333 nt, Artificial Sequence
  derived and/or modified sequence opt5 from anti-HIV_119-079302_VR-Chain
cagagcgugcugacccaacccccuuccgucucugccgcuccgggccagaagguuacaaucagcugcuccgggucuagcuccuacauuggaaacaaauaugugucuugguaccagcaguuccccggcacggccccuaagcuccugaucuaugagaauaacaaaagacuuagcgggauucccgaccgguuuuccgcgagcaagucugcuaccuccgccacacuggccaucagcggacuccaaaccggcgaugaagcugacuucuacugugggacaugggauggaucucugcgcaccggcggcgugauugggacaggaaccagagucacggugcuu

SEQ ID NO: 40603 - RNA, 327 nt, Artificial Sequence
  derived and/or modified sequence opt5 from anti-HIV_119-079292_VR-Chain
cagagcgugcugacccaacccccuuccgucucugccgcuccgggccagaagguuacaaucagcugcuccgggucuaacagcaauauuggaaacaauuacguguccugguaucagcagcuccccggcacggccccuaaacugcuuaucuacgacaacaauaagagacccucugggauuccugaucgguucagcggauccaaaagcggcaccucugcgacacuggggaucaccggacuccaaacaggcgacgaggcuaacuauuacuguggcaccugggauacaucccugagcgggguguuuggaaccggcacggaagucauugugcuu

SEQ ID NO: 40604 - RNA, 321 nt, Artificial Sequence
  derived and/or modified sequence opt5 from anti-HIV_119-079289_VR-Chain
cagagcgcccugacccaacccccuuccgugucugcugccccgggccagagagucacaaucagcugcuccgggaacaauucuaacauuggaaauaacuucguuagcugguaccagcuccugcccggcacggcgccuaaacuucugaucuaugagaauaacaagcgguccucugggauucccgaccgcuuuagcggauccaagagcggcaccucugcuacacucgggaucaccggacugcagacaggcgaugaagccgacuacuucuguuccaccuggagcggcucucuuaauuuugggacaggaaccagagugacggugcug

SEQ ID NO: 40605 - RNA, 324 nt, Artificial Sequence
  derived and/or modified sequence opt5 from anti-HIV_119-078935_VR-Chain
cagagcgugcugacccaacccccuuccgucucugccgcuccgggccagagaguuacaaucagcugcuccgggacgucugccaacauugagaauuacuaugugagcugguaccagcagcuccccggaaccgcgccuaagcugaucauuuaugacgauaacaaacggcccuccggcaucccucaacgcuucucugggagcaaguccggaacaagcgcuacccuuggcauuacagggcugcagaccggagacgaagccgaguacuauugugaaacaugggauggcucuggcgggguguuuggaaccggcacgaaagucaccgugcuc

SEQ ID NO: 40606 - RNA, 324 nt, Artificial Sequence
  derived and/or modified sequence opt5 from anti-HIV_119-078702_VR-Chain
cagagcgugcugacccaacccccuuccgucucugccgcuccgggccagaagguuacaaucagcugcuccgggucuagcuccguguucggcaaaaacuacgugucuugguaucagcaccuccccggaacggccccuaagcugcuuauuuacgagaauaccaaaagacccagcgggaucccugaccgguuuuccggaagcaagucuggcacauccgcgacccuggcuauuacagggcuccagaccggagaugaagccgacuauuacugugagacaugggauggcagcggcggggucuucggaucuggcaccaaagugacgguucug

SEQ ID NO: 40607 - RNA, 324 nt, Artificial Sequence
  derived and/or modified sequence opt5 from anti-HIV_119-078593_VR-Chain
cagagcuuccugacccagcccccuuccgugucugccgcuccgggccagaaggucacaaucagcugcuccgggucuaacagcaauauuggaaacaauuacguuuccugguaucaacaggugcccggcacggccccuaaacuccugaucuacgagaacaauaagagacccucugggauuccugaccgguuuagcggauccaaaagcggcaccucugcgacacuugugaucaccgggcugcacacaggagaugaagcugacuauuacugugagaccugggauggcuccggcggggucuucggaacaggcagcaacgugacccuccug

SEQ ID NO: 40608 - RNA, 333 nt, Artificial Sequence
  derived and/or modified sequence opt5 from anti-HIV_119-077708_VR-Chain
cagagcgugcugacccaacccccuucccucucugccgcuccgggccagaaggucacaaucagcugcuccgggacgaccucuaacauuggaaauaacuacguuagcugguaucagcaccuucccggcacagccccuaaacugcugaucuacgagaauaccaagagacccuccgggauuccugaccgguucucuggaagcaaauccggcacaagcgcgacccucgggaucacaggacugcagaccggcgaugaagcugacuauuacuguacgguguggggcgugcgcaagggggucggagccguguuuggcaccgggacaaaaguuaccgugcuu

SEQ ID NO: 40609 - RNA, 321 nt, Artificial Sequence
  derived and/or modified sequence opt5 from anti-HIV_119-076904_VR-Chain
cagagcgugcugacccaacccccuuccgucucugccgcuccgggccagaagguuacaaucagcugcuccagaucuagcucccacauugagaacucuuacgugagcugguaucagcaucuccccgggacggccccuaaacugcuuaucuacgaaaauaacaagcggcccuccggcauuccugaccgcuucagcggaucuaaauccgggaccagcgcgacacugggaaucucuggccuccagaccggggaugaggcugacuauuuuuguuccacauggagcggaucucugaauuucggcaccggcacaagagugaccguccuu

SEQ ID NO: 40610 - RNA, 324 nt, Artificial Sequence
  derived and/or modified sequence opt5 from anti-HIV_119-075862_VR-Chain
cagagcgugcugacccaacccccuuccaucucugccgcuccgggccagaaggucacaauuagcugcuccgggucugccagcaacaucggcaaaaauuccguuucuugguaccagcaguuccccggaacggcgccuaagcuccugauuuaugagaacaauagacggcccagcgggaccccugaccgcuuuuccggaagcaaaucuggcacauccgcuacccuugccaucacagggcugcaaaccggagaugaagccgacuacuauugugagacaugggauggcagcggcgggguguucggaaccggcacgaaggugaccguccuc

SEQ ID NO: 40611 - RNA, 333 nt, Artificial Sequence
  derived and/or modified sequence opt5 from anti-HIV_119-075465_VR-Chain
cagagcgugcugacccaacccccuuccgucucugccgcuccgggccagaagguugugaucagcugcuccgggucuagcuccauuaucggaaacaauuacgugucuugguaucagcagcuccccggcacagccccuaaacugcuuauuuacgagaacaauagacggcccagcgggaucccugaccgcuucuccggaagcaagucuggcacguccgcgacccuggcuauuagcgggcuccaaacaggagaugaagccgacuauuguugcgccgucuggggcgugagacggggcgcuggggccguuuuuggagcuggcaccaaagugacaguccug

SEQ ID NO: 40612 - RNA, 330 nt, Artificial Sequence
  derived and/or modified sequence opt5 from anti-HIV_119-074822_VR-Chain
agcgugcugacccagcccccuuccgucucugccgcuccgggccaaaacaucacaauuagcugcuccgggggaucuagcaauaucgccaagaacuacauuuccugguaucagcaccuccccggcacggcgccuaaaaucguuauuuacgacaaugauaagagaccccuggggaucccugaccgguucucugcuagcaaauccggaaccagcgccacacuuggcaucaccgggcugcagacaggagaugaggccgacuauuacugugcuguguggggcgugcgcagaggcgucggggccguguuuggagcuggcaccaagguuauugugcuc

SEQ ID NO: 40613 - RNA, 333 nt, Artificial Sequence
  derived and/or modified sequence opt5 from anti-HIV_119-074629_VR-Chain
cagagcgugcugacccaacccccuuccgagucugccgcuccgggccagaaggucacaaucagcugcuccgggggaacgucuaacauuggcaauaacuacguuagcugguauagacggcuccccgggaccgccccuaaacugcuuaucuacgaaaauaaccgcagacccuccggcauuccugaccgguucucuggaagcaaguccgggacaagcgcgacccuggcuaucucuggacuccagacaggcgaugaggccgacuauuguugcgccguguggggcgugcgcagaggggcuggagccgucuuuggcgcugggaccaaagugacaguucug

SEQ ID NO: 40614 - RNA, 324 nt, Artificial Sequence
  derived and/or modified sequence opt5 from anti-HIV_119-074500_VR-Chain
cagagcgugcugacccaacccccuuccgucucugccgcuccgggccagaagguuacaaugagcugcuccgggucuagcuccaacaucggaaauaacuacgugucuugguaucaguaccuccccggcacggccccuaaacugcuuauuuaugagaaugacagacggcccagcgggaucccugaucgcuucuccgcgagcaagucuggaaccuccgcuacacuggccauuaccggccuccagacaggggacgaagccgauuacuauugugagaccugggacggaagcggcggcguguuugggacaggaaccaaagucacggugcug

SEQ ID NO: 40615 - RNA, 333 nt, Artificial Sequence
  derived and/or modified sequence opt5 from anti-HIV_119-073911_VR-Chain
cagagcgugcugacccaacccccuuccgucucugccgcuccgggccagagaguuacaaucagcugcuccgggucuagcuccaacauugagaauaacuacgugucuugguaucagcaccuccccggaacggccccuaagcugcuuguguacgacgauaauaaacggcccagcggcaucccucaucgcuucuccgcgagcaagucugggaccuccgcuacacuggccauuaccggacuccagacaggcgacgaagccgauuauuacuguacccuguggggagucagaaaaggggugggcgcuguuuuuggcacagggaccaaggugacgguccuu

SEQ ID NO: 40616 - RNA, 324 nt, Artificial Sequence
  derived and/or modified sequence opt5 from anti-HIV_119-072765_VR-Chain
cagagcgugcugacccaacccccuuccgucucugccgcuccgggccagaagguuacaaucagcugcuccgggaacucuagcaauauuggaaacaauuucguguccugguaccaacaggugcccggcacggccccuaaacuccuggucuaugagaccuacagacggcccucugggacaccugaccgcuuuagcggauccaagagcggcaccucugcgacacuugcuaucuccgggcugcagaccggagaugaagccgacuauuacuguggcacaugggauggcagcgggggaguguucggcaccgggacgaaaguuaccgugcuc

SEQ ID NO: 40617 - RNA, 333 nt, Artificial Sequence
  derived and/or modified sequence opt5 from anti-HIV_119-072313_VR-Chain
caguucgugcugacccaacccccuagcgucuccgccgcuccgggccagaagguuacaaucucuugcagcgccuccucuagcauuaucgggaaaaacuacguguccugguaucagcaguuucccggaacggcgccuaagcuccugauuuacgaggacaauaaaagacccucuggcaucccugaucgguucagcggguccaagagcggaaccucugcuacacuugccauuaccggccugcaaacaggggacgaagccgauuauuacuguaccguguggggaguccgcaaaggcgugggcgcuguuuuugggacaggaaccaaggugacgguccuc

SEQ ID NO: 40618 - RNA, 333 nt, Artificial Sequence
  derived and/or modified sequence opt5 from anti-HIV_119-072280_VR-Chain
cagagcgugcugacccaacccccuuccgucucugccgcuccgggccagaagguuagcaucuccugcucugggagcgacuccaaccucggagauaauuacgugucuugguaucagcaguuccccggcacagccccuaaacugcuuauucacgacaacaauaagagacccagcgggacgccugaucgguuuuccggaagcaaaucuggcaccuccgcgacacuggcuaucaccgggcuccaaacaggagacgaggccgauuacuauugugccaccugggcuccccgccugaacagcgccagaguguucggcaauggcacaauggucaccgugcuu

SEQ ID NO: 40619 - RNA, 333 nt, Artificial Sequence
  derived and/or modified sequence opt5 from anti-HIV_119-071693_VR-Chain
cagagcgugcugacccaacccccuuccgucucugccgcuccgggccagaagguugugaucagcugcuccgggucuagcuccauuaucgagaaaaacucuauuagcugguaccagcagggacccggcgccgcgccuaagcuccugaucuaugaaaaugacaaaagacccuccgggauuccugaucgguucagcggaucuaaguccggcacaagcgcuacgcuugccaucaccgggcugcaaacaggagacgaggccgauuacuauuguaccaucuggggcgugcgcaaaggcgucggggcuguguuuggaacaggcaccaagguuacagugcuc

SEQ ID NO: 40620 - RNA, 321 nt, Artificial Sequence
  derived and/or modified sequence opt5 from anti-HIV_119-071353_VR-Chain
cagagcgugcugacccaacccccuuccgccucugcugccccgggccagaaggucacaaucagcugcuccgggucuaacagcaauauuggaaacaauuucguuuccugguaccagcucuuucccggcacggcgccuaaacugcuuaucuucgagaacaauaagagacccucugggauuccugaccgguuuagcggagcuaaauccggcaccagcgccacacuggccaucaccgggcuccagacaggagaugaagcugacuauuucuguucuaccugguccggcagccugaacuuuggcacagggacccgcgugacggugcuu

SEQ ID NO: 40621 - RNA, 324 nt, Artificial Sequence
  derived and/or modified sequence opt5 from anti-HIV_119-069711_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgacaauaacaauagacccagcggggugccugaucgguucuccggaagcaagucuggcaccuccgcgacacuggcuauuaccgggcuccaaacaggagacgaggccgauuauuacugugaaaccugggacgauagcggcggcgucuuugggacaggaaccaaagugacgguucug

SEQ ID NO: 40622 - RNA, 333 nt, Artificial Sequence
  derived and/or modified sequence opt5 from anti-HIV_119-069061_VR-Chain
cagagcgugcugacccaacccccuuccgucucugccgcuccgggccagaagguuacaaucagcugcuccgggucuagcuccaacauuggaucuaauuacgugagcugguaucagcagcuccccggcacggccccuaaacugcuuguguacgacaacaaugagagacccuccgggaucccugaucgguucagcggaucuaaguccggcaccagcgcgacacuggcuauuaccgggcuccaaacaggagacgaagccgauuauuacugugccaccugggcuccccgccugaacucugccagagucuuuggcaauggcacaauggugaccguucuu

SEQ ID NO: 40623 - RNA, 324 nt, Artificial Sequence
  derived and/or modified sequence opt5 from anti-HIV_119-068202_VR-Chain
cagagcgugcugacccaagagcccuccgucucuggcgccccugggcagagaguuacaaucagcugcacgggauccaacucuaauauuggcgggcacgacgugcauugguaccagcagcucccgggaaccgcucccaagcugcuuaucuaugauaacgacaaacggccuagcggcauucccgaucgcuucuccgggucuaagagcgacacauccgccagccugggaaucaccggccuccaaacaggcgaugaagcggacuacuauugugagaccugggaugggucuggaggcguguuugggacaggaaccaaagucacggugcug

SEQ ID NO: 40624 - RNA, 324 nt, Artificial Sequence
  derived and/or modified sequence opt5 from anti-HIV_119-068063_VR-Chain
cagagcgcccugacccaacccccuuccgcuucuggcagccucgggcaguccgugacaaucucuugcacgggaaccagaagcgacgucggcaacuacuauguuuccugguaccagcagcugccggggacagcccccaaacuucugauuucugagaauaaccggcgcccuagcggaacccccgauagauucuccggcagcaagucugggacauccgcgacccucgcuaucagcggacugcaaacaggcgacgaagccgauuauuacuguggcaccugggacgggucuggaggcguguuugggacgggaaccaaggugacaguccuu

SEQ ID NO: 40625 - RNA, 333 nt, Artificial Sequence
  derived and/or modified sequence opt5 from anti-HIV_119-067980_VR-Chain
cagagcgugcugacccaacccccuuccgucucugccgcuccgggccagaagguuacaaucagcugcuccgggaacucuagcaauauuggaaacaauuucguguccugguaccaacaggugcccggcacggccccuaaacuccuggucuaugagaccuacagacggcccucugggaucccugaccgcuuuagcggauccaagagcggcacaucugcgacccuugcuauuacagggcugcagaccggagaugaagccgacuaucacugugccaucuggggcgugagaaaaggcguuggggcuguguucggaacaggcaccaaggucacggugguu

SEQ ID NO: 40626 - RNA, 324 nt, Artificial Sequence
  derived and/or modified sequence opt5 from anti-HIV_119-067866_VR-Chain
cagagcgugcugacccaacccccuuccgucucugccgcuccgggccagaagguuacaaucagcugcuccgggucuacgagcaccauuggaaacaauuacguguccugguaucagcaccuccccggcacagccccuaaacugcuuaucuacgacaacaauaagagacccgcggggauuccugaucgguucaccgcuucuaaaagcggaacauccgccacccuggccaucacaggccuccauaccggggacgaggcugauuauuacugugaaacgugggacggaagcggcggcguguuugggaccggaacaaaggucaccgugcug

SEQ ID NO: 40627 - RNA, 321 nt, Artificial Sequence
  derived and/or modified sequence opt5 from anti-HIV_119-067756_VR-Chain
cagagcgugcugacccaacccccuuccgucucugccgcuccgggccagaagguugugaucagcugcuccgggucuacaagcaacauuggcaaaaauuucguguccugguaccagcagcuccccggaacggccccuaagcugcuuaucuaugagaacucuagacggcccagcgggauuccugaccgcuuuuccggagcgaaaagcggcaccucugcuacacuggccaucaccgggcuccaaacaggagaugaagccgacuacuucuguuccaccuggagcggcucucugaauuuuggcacagggaccagagucacggugcuu

SEQ ID NO: 40628 - RNA, 321 nt, Artificial Sequence
  derived and/or modified sequence opt5 from anti-HIV_119-066859_VR-Chain
cagagcgugcugacccaacccccuuccgucucugccgcuccgggccagaagguuacaaucacgugcagcggguccgccucuaacauugagaauaacuacgugagcugguaucagcaguuccccggaccugcgcccaaacuccugaucuacgaaaaugacaagagaccuuccggcauucccgaucgguuuucugggagcgcuuccggaaccagcgccacacuugccaucaccggccugcaaacaggggacgaggcugauuauuucuguucuaccugguccggaagccucaacuuuggcacaggcacccgcgugacgguccug

SEQ ID NO: 40629 - RNA, 333 nt, Artificial Sequence
  derived and/or modified sequence opt5 from anti-HIV_119-065821_VR-Chain
cagagcgugcugacccaacccccuuccgucucugccacaccgggccagagaguuacggugagcugcuccgggucuagcuccaacaucggaaaucacuacgugucuugguaucagcagguccccggcaccgcuccuaagcuccugauuuacgacaacagcaaucggcccuccgggaucccugaucgcuucagcggaucuaaauccggcacaagcgccacccuugggauuacaggacugcaaaccggcgacgaggcggauuauuacuguacaguguggggcguuagaaagggggugggagcugucuuuggcaccgggacgaaagugaccguucuc

SEQ ID NO: 40630 - RNA, 333 nt, Artificial Sequence
  derived and/or modified sequence opt5 from anti-HIV_119-065191_VR-Chain
cagagcgugcugacccaacccccuuccgucucugccgcuccgggccagaagguuacaaucagcugcuccgggaacaauucuaacauuggaaauaacuacgugagcugguaucagcagcuccccggcacggccccuaaacugcuuaucuucgagaaucacaagagacccuccgggauuccugaccgguuuucuggaagcaaauccggcaccagcgcgacacuggggaucaccggacuccaaucuggcgaugaagcugacuacuauugugccacaugggcuccccgccugaacuccgccagaguguucggcaccgggacaaaggucaccgugcuu

SEQ ID NO: 40631 - RNA, 333 nt, Artificial Sequence
  derived and/or modified sequence opt5 from anti-HIV_119-064667_VR-Chain
cagagcgugcugacccaacccccuuccgucucugccgcuccgggccagaagguuacaaucagcugcuccgggucuaacagcuacauuggaaauaaauauguguccugguaccaacaggugcccggcacggccccuaagcuccugaucuaugagaacaauaaaagacccucugggauuccugaccgguucagcggauccaagagcggcaccucugcgacacuugucaucaccgggcugcagacaggagaugaagcugacuuuuacuguggcaccugggauggcucccuccgcacagggggagugauuggcaccgggacgagaguuaccgugcug

SEQ ID NO: 40632 - RNA, 324 nt, Artificial Sequence
  derived and/or modified sequence opt5 from anti-HIV_119-063791_VR-Chain
cagagcgugcugacccaacccccuuccgucucugccgcuccgggccagaagguucccaucagcugcuccgggaacucuagcaauauuggaaacaauuacguguccugguaucagcagcucccuggcacagcccccaaacugcuuaucuacgagaacaauaagagaccuucugggauucccgaccgguucagcggauccaaaagcggcacgucugcgacccuggcuaucacagggcuccacaccggagaugaagccgacuauuacugugagacaugggauggcuccggcgggguguuuggaaccggcacaaaggucaccgugcug

SEQ ID NO: 40633 - RNA, 333 nt, Artificial Sequence
  derived and/or modified sequence opt5 from anti-HIV_119-062989_VR-Chain
cagagcgugcugacccaacccccuuccgucucugccgcuccgggccagagaguuacaaucagcugcuccgggucuagcuccaacauuggaaauaacuucgugucuugguaccagcaguuucccggcacggugccuaagcuccugaucuaugagaauaaccggcgccccagcgggauuccugacagauucuccggaagcaaaucuggcaccuccgccacacuugcgaucaccgggcugcaaacaggagaugaagcugacuacuauugugccgucuggggcgugcggcgcggcguuggggccguguuuggagcuggcaccaaggucauugugcuc

SEQ ID NO: 40634 - RNA, 321 nt, Artificial Sequence
  derived and/or modified sequence opt5 from anti-HIV_119-062286_VR-Chain
cagagcgugcugacccaacccccuuccgucucugccgcuccgggccagaagguuacaaucagcugcuccgggucugccagcaacauuggcaaaaauuucguguccugguaccagcagcuccccggaacggcgccuaagcugcuuaucucugagaacaauagacggcccagcgggaccccugaccgcuuuuccggaagcaaaucuggcgcuuccgccacacuggugauuagcgggcuccaaaccggagaugaagccgacuauuacugugcuacauggucuggcucccugagcaucggcaccgggacaaaggucaccgugcuu

SEQ ID NO: 40635 - RNA, 321 nt, Artificial Sequence
  derived and/or modified sequence opt5 from anti-HIV_119-061416_VR-Chain
cagagcgugcugacccaacccccuuccgucucugccgcuccgggccagaagguugugaucagcugcuccgggucuagcuccauuuucgagaaaaacucuaucagcugguaccagcagggacccggcgccgcgccuaagcuccugauuuaugaaaaugacaaaagacgguccgggauccccgaucgcuuuagcggaucuaaguccgcuacaagcacgacccuugccauugugggccugcaaacaggggacgaggccgauuacuucuguucuaccugguccggaagccucaacuuuggcacaggcaccagagucacagugcug

SEQ ID NO: 40636 - RNA, 321 nt, Artificial Sequence
  derived and/or modified sequence opt5 from anti-HIV_119-061344_VR-Chain
cagagcgugcugacccaacccccuuccgucucugccgcuccgggccagaagguuacaaucagcugcuccgggucuagcuccguguucggaaagaacuacgugucuugguaucagcaccuccccggcacggccccuaagcugcuuauuuacgagaauaacaaaagacccagcgggaucccugaccgguuuuccggagcgaaaagcggcaccgcugccacacuggccauuaccgggcuccagacaggagaugaagcugacuauuacugugccaccuggucuggcucccugaauuucggcacagggaccaaagucacggugcuu

SEQ ID NO: 40637 - RNA, 324 nt, Artificial Sequence
  derived and/or modified sequence opt5 from anti-HIV_119-060240_VR-Chain
cagagcgugcugacccaacccccuuccgaguacggcgccccggggcacaacgucacaguuucuugcagcggaacgaccuccaauaucgaaaacaauuucgugucuugguaucucauugugcccggcacagcuccuaagcugcuuaucuuugacaacgauaaaagacccagcgggauuccugaccgguucuccggaucuaagagcggcaccuccgccacacuggcgaucaccgggcuccagacaggagaugaggcugacuacuauugugccaccugggauggccgcgucagcgugauuggcacggggaccaaaguuacagugcug

SEQ ID NO: 40638 - RNA, 333 nt, Artificial Sequence
  derived and/or modified sequence opt5 from anti-HIV_119-060184_VR-Chain
cagagcgugcugacccaacccccuuccgucucuggcgccccggggcagagaguuacaaucagcugcuccggaucuagcuccaacauuggcucuaauacggugaacugguaccagcagcuccccgggaccgcuccuaagcugcuuaucuaugacaauaacaaacggcccagcggcauuccugaucgcuucuccggaagcaagucugggacauccgccacccuggugaucacaggacuccaaaccggcgacgaggcggauuuuuacuguggcacaugggacgggagccugagaaccggaggcgucauugggacgggaacccgggugacaguucuu

SEQ ID NO: 40639 - RNA, 321 nt, Artificial Sequence
  derived and/or modified sequence opt5 from anti-HIV_119-058035_VR-Chain
cagagcgugcugacccaacccccuuccgucucugccgcuccgggccagaagguuacaaucagcugcuccgggucugccagcaacauuggcaaaaauuucguguccugguaccagcagcuccccggaacggcgccuaagcugcuuaucuaugagaacaauagacggcccucugggaccccugaccgcuuuagcggagcuaaauccggcacaagcgccacccuggccauuacagggcuccaaaccggagaugaagcugacuacuucuguucuacaugguccggcagccugaacuuuggcaccgggacgagagugaccguccuu

SEQ ID NO: 40640 - RNA, 321 nt, Artificial Sequence
  derived and/or modified sequence opt5 from anti-HIV_119-057858_VR-Chain
cagagcgugcugacccaacccccuuccgucucugccgcuccgggccagaacguuaauaucagcugcuccgggggaucuagcaacauuggcuccaauuacgugucuugguaucagcaguuccccgggacagccccuaagcuccugaucuacgagaacaauaaaagacccagcggcauuccugaccgguuuuccggagcuaagagcgggacgucugcgacccuugccaucacaggacugcaaaccggcgaugaagccgacuauuucuguuccacauggagcggcucucucaacuuugggaccggaacacgcgugaccguccug

SEQ ID NO: 40641 - RNA, 324 nt, Artificial Sequence
  derived and/or modified sequence opt5 from anti-HIV_119-057473_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacggccccuaaacugcuuaucuacgacaccuauagcagacccuccgggauuccugaucgguucagcggaucuaaguccggcacaagcgcgacccuggcuaucacagggcuccagaccggagacgaggccgauuacuauuguggcacaugggacggcucugggggaguguuuggcaccgggacgaaagucaccgugcug

SEQ ID NO: 40642 - RNA, 321 nt, Artificial Sequence
  derived and/or modified sequence opt5 from anti-HIV_119-057090_VR-Chain
cagagcgugcugacccaacccccuuccgucucugccgcuccgggccagacaguuacgaucagcugcuccgggucuaccagcaacauuggaaagaaugacguguccugguaccagcagcuccccggcacagccccuaaacugcuuaucucugagaacaauagacggcccagcgggaccccugaucgcuucuccgcgagcaagucuggaacauccgcuacccuggccauuacaggccuccaaaccggggacgaagccgauuauuuuuguagcacguggucuggaucccugaacuucggcaccggcacaagagugaccguccuu

SEQ ID NO: 40643 - RNA, 333 nt, Artificial Sequence
  derived and/or modified sequence opt5 from anti-HIV_119-055754_VR-Chain
cagagcgugcugacccaacccccuuccgucucugccgcuccgggccagaagguuacaaucagcugcuccgggaacucuagcuccauuggaaauaacuucgugucuugguaccagcagcuccccggcacggccccuaaacugcuuguguaugagaauuacagacggcccagcgggaucccugaccgcuuuuccggaagcaagucuggcaccuccgcgacacuggcuauugaugggcuccaaaccugggacgaagccgauuaucacugugccaucuggggagucagaaaaggcgugggcgcuguuuucgggacaggaaccaaggugacagucgug

SEQ ID NO: 40644 - RNA, 324 nt, Artificial Sequence
  derived and/or modified sequence opt5 from anti-HIV_119-054899_VR-Chain
cagagcgugcugacccaacccccuuccgucucugccgcuccgggccagaagguuacaaucagcugcuccgggucuaacagcuacauuggaaauaaauauguguccugguaccagcaguuccccggcacggccccuaagcuccugauccacgagaacaauagacggcccucugggaccccugaccgcuuuagcggauccaaaagcggcacaucugcgacccuugcuauuuccgggcugcaaacaggagaugaagccgacuauuacugugagaccugggauggcagcggcgggguguucggaacaggcaccaaggucacggugcuc

SEQ ID NO: 40645 - RNA, 324 nt, Artificial Sequence
  derived and/or modified sequence opt5 from anti-HIV_119-054501_VR-Chain
cagagcgugcugacccaacccccuuccgucucugccgcuccgggccagaagguuacaaucagcugcuccgggacgucuagcaacauuggaaauaacuacguguccugguaucagcaccuccccggcaccgccccuaaacugcuuaucuucgagacaaauaagagacccucugggauuccugaccgguuuagcgcguccaaaagcggaaccucugcuacacuggccaucaccggccuccagacaggggaugaagccgacuacuauugugagaccugggauggauccggcggcguguucgggcccggaacgcgcgucaccgugcug

SEQ ID NO: 40646 - RNA, 324 nt, Artificial Sequence
  derived and/or modified sequence opt5 from anti-HIV_119-051867_VR-Chain
cagagcgugcugacccaacccccuuccgucucugccgcuccgggccagaagguuacaaucagcugcuccgggaacucuagcaauauuggaaacaauuucaucuccugguaccagcagcuccccggcacggccccuaaacugcuuauuuaugagaacgacagacggcccucugggaccccugaucgcuuuagcggauccaagagcggcacaucugcgacccuggcuaucacagggcuccaaaccggagacgaagccgauuacuauugugagacaugggacggcuccggcgggguguucggaaccggcacgaaagugaccguccug

SEQ ID NO: 40647 - RNA, 324 nt, Artificial Sequence
  derived and/or modified sequence opt5 from anti-HIV_119-051814_VR-Chain
cagagcgugcugacccaacccccuuccgucucugccgcuccgggccagaagguuacaaucagcugcuccgggucuaacagcaauauuggaaacaaagacguguccugguaccagcagauccccgccacggcgccuaagcuccugauuuaugagaauaacaaaagacccucuggcaucccugaucgguucagcggguccaagagcggaaccucugcuacacuugccauuaccggccugcaaacaggggacgaagccgauuacuauugugcuaccugggacggacgcguguccgucaucggcacaggcaccaaugugaucguucuc

SEQ ID NO: 40648 - RNA, 321 nt, Artificial Sequence
  derived and/or modified sequence opt5 from anti-HIV_119-051567_VR-Chain
cagagcgugcugacccaacccccuuccgucucugccgcuccgggccagaagguuacaaucuacugcagcggguccagaucuaacauuggacggaauuaugccagcugguaccagcagcuccccggcacggcgccuaaacugcuuaucuucgacaacaaucgcagacccuccgggauuccugaucgguuuucuggagcuaagagcggcaccuccgccacacuggccaucaccgggcuccaaacaggagacgaggcugauuauuucuguagcaccuggucuggcucccugaacuuuggcacagggacccgcgugacggugcuu

SEQ ID NO: 40649 - RNA, 324 nt, Artificial Sequence
  derived and/or modified sequence opt5 from anti-HIV_119-051483_VR-Chain
cagagcgugcugacccaacccccuuccgucucugccgcuccgggccagaagcucacaaucagcugcuccgggacgucuagcaacauuggaaauaacuacguuuccugguaucagcaccuucccggcaccgccccuaaacugcugaucuacgagaauaacagacggcccucugggauuccugaacgcuucagcgcguccaagagcggaacaucugcuacccucggcaucacagggcugcagaccggagacgaggccgauuauuacugugaaacaugggacgauuccggcggcguguuugggaccggaacgaaagugaccguccuu

SEQ ID NO: 40650 - RNA, 333 nt, Artificial Sequence
  derived and/or modified sequence opt5 from anti-HIV_119-050913_VR-Chain
cagagcgugcugacccaacccccuuccgucucugccgcuccgggccagaagguuacaaucagcugcuccgggggaacgucuaacauuggcaauaacuacgugagcugguaucagcagcuccccgggaccgccccuagacugcuuaucuacgagacaaauaaacggcccuccggcauuccugaccgcuucuuuggaucuaagagcgggaccuccgcgacacuggcuaucagcggacuccaaaccggcgaugaagccgacuauuacuguacaguguggggcgucagaaaaggggugggagccguuuucggcaccgggacgaaggugaccguccug

SEQ ID NO: 40651 - RNA, 333 nt, Artificial Sequence
  derived and/or modified sequence opt5 from anti-HIV_119-050187_VR-Chain
cagagcgugcugacccaacccccuuccgucucugccgcuccgggccagaagguuacaaucagcugcuccgggucuagcuccaacauuggcaaaaauucugugagcugguaccagcaguuccccggaacggccccuaagcuccugaucuaugagaacaauaaaagacccuccgggauuccugaccgguuuagcgauucucaauccggaaccagcgcgacacuugcuaucaccggccugcagacaggggacgaagccgauuacucuugugccaccugggcugccucccucaacagcgcucgcguguucggaacaggcaccagagucacggugcug

SEQ ID NO: 40652 - RNA, 324 nt, Artificial Sequence
  derived and/or modified sequence opt5 from anti-HIV_119-049069_VR-Chain
cagagcgugcugacccaacccccuuccgucucugccgcuccgggccagaagguuacaaucagcugcuccgggucuacgagcaacauuggaaaauccgacguguucugguaccagcagcuccccggcaccgccccuaagcugcuuaucucugagacaagcagacggcccuccgggaccccugaucgcuuuagcggaucuaaauccggcacaagcgcgacccugacaauuaccgggcuccaaacgggagacgaagcugauuauuacugugaggccugggacggcucuggcgggguguucggaaccggcacaaaggucaccgugcug

SEQ ID NO: 40653 - RNA, 333 nt, Artificial Sequence
  derived and/or modified sequence opt5 from anti-HIV_119-048517_VR-Chain
cagagcgugcugacccaacccccuuccgucucugccgcuccgggccagaagguuacaaucagcugcuccgggucuaaauucaacauuggaaauaaggacgugagcugguaccagcacucccccggcacggccccuaaacuccugaucuaugagaacaauaagagacccucugggauuccugaucgguuuagcggauccaaaagcggcaccucugcgacacuugggaucuccggacugcagaccggcgacgaagcugauuacuguugcgccguguggggcguccgcagaggggccggagcuguguucggcgccgggacaaagguuaccgugcuc

SEQ ID NO: 40654 - RNA, 333 nt, Artificial Sequence
  derived and/or modified sequence opt5 from anti-HIV_119-048470_VR-Chain
cagagcgugcugacccaacccccuuccgucucugccgcuccgggccagaagguuacaaucagcugcuccgggucuacgagcaacauuggcaaaaaucucguguccugguaccagcaguuccccggaaccgccccuaagcugcuuaucuaugagaacaauagacggcccucugggauuccugaccgcuuuagcggauccaaaagcggcacaucugcgacccuggugaucacagggcuccaaaccggagaugaagcugacuucuacuguggcacauggggcgggucccugagagccggaggcgucauugggaccggaacgcgggugaccguucuu

SEQ ID NO: 40655 - RNA, 282 nt, Artificial Sequence
  derived and/or modified sequence opt5 from anti-HIV_119-048303_VR-Chain
agcgugcugacccagcccccuuccgucucugccgcuccgggccaaaacaucacaauuagcugcuccgggucuaucagcaauauugccuccaacuucaucucuugguaccagcagcuccccggaacggcgccuaagauuaucaucuaugacaaugaucagagaccccugggcauuccugcucgguuuagcggguccaaaagcggagccucugccacccuuguuaucacaggccugcaaaccggggacgaggcugauuacuauuguggaacaugggacggcucc

SEQ ID NO: 40656 - RNA, 333 nt, Artificial Sequence
  derived and/or modified sequence opt5 from anti-HIV_119-048021_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgacaauaacaagagacccagcgggauuccugaucgguucuccggaagcaaaucuggcaccuccgcgacacuggugaucaccgggcuccaaacaggagacgaggcugauuuuuauuguggcaccugggacggcagccugucugggggaggcgucauugggacaggaacccgcgugacgguucuu

SEQ ID NO: 40657 - RNA, 324 nt, Artificial Sequence
  derived and/or modified sequence opt5 from anti-HIV_119-047928_VR-Chain
cagagcgugcugacccaacccccuuccgucucugccgcuccgggccagaagguuacaaucagcugcuccgggucuaacagcaauauuggaaacaauuguguguccugguaccaacaggugcccggcacggccccuaaacuccugaucuaugagaacaauagacggcccucugggauuccugaccgcuucagcggauccaagagcggcaccucugcgacacuugcuaucuccgggcugcagaccggagaugaagccgacuacuauugcggcacaugggauggcagcgggggagucuuuggcaccgccacaaaagugaccguucuc

SEQ ID NO: 40658 - RNA, 324 nt, Artificial Sequence
  derived and/or modified sequence opt5 from anti-HIV_119-047384_VR-Chain
cagagcgugcugacccaacccccuuccgucucugccgcuccgggccagaagguuacaaucagcugcuccgggucuaacagcaauauuggaaacaaagacguguccugguacagacaggugcccccuacggcccccaagcuccugaucuaugagaauaacaaacggccuucuggcauucccgaucgcuucagcggguccaagagcggaaccucugcgacacuugcuaucaccggccugcagacaggggacgaagccgauuacuauugugccaccugggacggaagagucuccguguuuggcacaggcaccaaaguugcugugcuc

SEQ ID NO: 40659 - RNA, 333 nt, Artificial Sequence
  derived and/or modified sequence opt5 from anti-HIV_119-047145_VR-Chain
cagagcgugcugacccaacccccuuccgucucugccgcuccgggccagacaguuaacaucagcugcuccgggucuaauagcaacauuggauccaaguacgugucuugguaucagcacuuccccggcacggccccuaaacuccugaucuacgagaauaacaagagaagcuccgggauucccgaccgguuuagcggaucuaaauccgcgaccagcgcuacacuugccaucaccggccugcagacaggggaugaagccgacuauuacugugcuaccugggccccuucucucaauuccgcucgcguguucggaacaggcaccaaggucacggugcug

SEQ ID NO: 40660 - RNA, 333 nt, Artificial Sequence
  derived and/or modified sequence opt5 from anti-HIV_119-046752_VR-Chain
cagagcgugcugacccaacccccuuccgucucugccgcuccgggccagaagguuacaaucagcugcuccgggaacucuagcuccauuggaaauaacuucgugucuugguaccagcagcuccccggcacggccccuaaacugcuuguguaugagaauuacagacggcccagcgggaucuccgaccgcuuuagcggaucuaaguccggcaccagcgcgacacuggcuauuaccgggcuccaaacaggagaugaagccgacuauuacuguaccgucuggggcgugagaaaaggcguuggggccguguucggaacaggcaccaaggucacggugcug

SEQ ID NO: 40661 - RNA, 324 nt, Artificial Sequence
  derived and/or modified sequence opt5 from anti-HIV_119-046660_VR-Chain
cagagcgugcugacccaacccccuuccgucucugccgcuccgggccagaagguuacaaucagcugcuccgggucuagcuccaacauuggaaaucacuacgugucuugguaucagcagcuccccggcacggccccuaaacugcuuaucuacgacaacaauaagagacccagcgggauuccugaucgguucuccgcgagcaaaucuggaaccuccgcuacacugggcaucaccgggcuccaaacaggagacgaggccgauuauuacugugccaccugggacggccgcgugagcgucauuggcacagggaccaaggugacgguugug

SEQ ID NO: 40662 - RNA, 333 nt, Artificial Sequence
  derived and/or modified sequence opt5 from anti-HIV_119-046202_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuguguacgagaauuauagacggcccagcgggaucccugaccgcuucuccggaagcaagucuggcaccuccgcgacacuggcuauuaccgggcuccaaacaggagaugaagccgacuaccacugugccaucuggggcgucagaaaaggcgugggggcuguuuuuggaaccggcacaaaggugaccgucgug

SEQ ID NO: 40663 - RNA, 333 nt, Artificial Sequence
  derived and/or modified sequence opt5 from anti-HIV_119-045790_VR-Chain
cagagcgugcugacccaacccccuuccgucucugccgcuccgggccagaagguuacaaucagcugcuccgggucuagcuccaacauuggaaauaacuacgugucuugguaucaguaccuccccggcacggccccuaaacugcuuuucuaugaggacaauagacggcccagcgggaccccugaucgcuuuuccggaagcaagucuggcacauccgcgacccuggcuaucagcgggcuccagacaggagacgaagccgauuacuauuguaccauuuggggcgugagaaaaggcgucggggccguguucggaacaggcaccaagguuacggugcug

SEQ ID NO: 40664 - RNA, 333 nt, Artificial Sequence
  derived and/or modified sequence opt5 from anti-HIV_119-044670_VR-Chain
cagagcgugcugacccaacccccuuccgucucuggcgccccgggggagagaguuacaaucagcugcacgggaaacaccuccaauauuggcacauacgacgugcagugguaucagcaccuccccgggaccgcuccucggcugcuuaucuaccauaacgugaaucugcccucuggagucccugaucgcuucagcgccuccaagucuggcacaagcgcgacccucgcuauuacagggcugcagaccggagacgaagccgauuauuacuguacgaucuggggcgugagaaaaggcguuggggccguguuuggaaccggcacaaaggucaccgugcuu

SEQ ID NO: 40665 - RNA, 321 nt, Artificial Sequence
  derived and/or modified sequence opt5 from anti-HIV_119-044140_VR-Chain
cagagcgugcugacccaacccccuuccgucucugccgcuccgggccagaagguuacaaucagcugcuccgggggaacgucuaacauuggcaaucacuucgugagcugguacagacaucuccccgggaccgccccuaaacugcuuaucuaugagaacaauaaccggcccuccggcauuccugaccgcuuuucuggagcuaagagcgggacauccgcgacccuggccaucacaggacuccagaccggcgaugaaggcgacuacuauugugccacauggagcgggucucugaauauuggaaccggcacgaaagugaccguccuu

SEQ ID NO: 40666 - RNA, 333 nt, Artificial Sequence
  derived and/or modified sequence opt5 from anti-HIV_119-042776_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacggccccuaaacugcuuaucuacgagagcgcgagacggcccuccgggaccccugaccgcuucagcggaucuaaguccggcacaagcgcuacccuggccauuacagggcuccagaccggagaugaagccgacuauuacuguacacuguggggcgugagaaaaggcgucggggcuguguuuggaaccggcacgcggguuaccgugcuu

SEQ ID NO: 40667 - RNA, 333 nt, Artificial Sequence
  derived and/or modified sequence opt5 from anti-HIV_119-042581_VR-Chain
cagagcgugcugacccaacccccuuccgucucugccgcuccgggccagaagguuacaaucagcugcuccgggucuagcuccaacauuggaaauaacuucgugucuugguaccagcagcuccccggcacggccccuaaacugcuuaucuuugagacccacagacggcccagcgggauuccugaccgcuucuccggaagcaagucuggcacauccgcgacccuggcuaucacagggcuccaaagcggagaugaagccgacuauuacugugccguguggggcgucagacagggcgcuggggccguguuuggaaccggcacaaaaguuaccgugcug

SEQ ID NO: 40668 - RNA, 333 nt, Artificial Sequence
  derived and/or modified sequence opt5 from anti-HIV_119-040905_VR-Chain
cagagcgugcugacccaacccccuuccgucucugccgcuccgggccagaagguuacaaucagcugcuccgggaacucuagcaauauuggagacaacuucguguccugguaccagcagcuccccggcaucgccccuaaacugcuuguguaugagacgaauaagagacccucugggauuccugaucgguuugcgggaagcaaauccggcaccagcgcuacacuggucaucaccgggcuccaaacaggagacgaagccgauuucuacuguggcaccugggacggcucucugcgcacagggggagugauuggcaccgggacgagaguuaccgugcuu

SEQ ID NO: 40669 - RNA, 321 nt, Artificial Sequence
  derived and/or modified sequence opt5 from anti-HIV_119-040322_VR-Chain
cagagcgugcugacccaacccccuuccgucucugccgcuccgggccagaagguugugaucagcugcuccgggucuagcuccauuaucgagaaaaacucuauuagcugguaccagcagggacccggcgccgcgccuaagcuccugaucuaugaaaaugacaaaagacccuccgggauuccugaucgguucagcggaucuaaguccggcacaacggggacccuugcuaucacaggacugcaaaccggcgacgaggccgauuacuuuugugccacauggagcggccgccucaacaucgggaccggaacaaaagugaccguccug

SEQ ID NO: 40670 - RNA, 324 nt, Artificial Sequence
  derived and/or modified sequence opt5 from anti-HIV_119-039892_VR-Chain
cagagcgugcugacccaacccccuuccgucucugccgcuccgggccagaagguuacaaucagcugcuccgggucuaacgccaauauuggaaacaaagacgugagcugguaccagcagcuccccgcgacggcuccuaagcugcuuaucuaugaguccaauaaaagacccucuggcauuccugaucgguucagcggguccaagagcggaaccucugccacacuggccaucaccggccuccaaacaggggacgaagcugauuacuauugugccaccugggacggacgcguguccggcauuggcacagggaccaaagucacggugcug

SEQ ID NO: 40671 - RNA, 324 nt, Artificial Sequence
  derived and/or modified sequence opt5 from anti-HIV_119-039764_VR-Chain
cagagcgugcugacccaacccccuuccgucucugccgcuccgggccagaagguuacaaucagcugcuccgggucugccagcaacauuggcaaaaauuucguguccugguaccaacaggugcccggaacggcgccuaagcuccugaucuaugagaacaauagacggcccucugggaccccugaccgcuuuagcggauccaaaagcggcacaucugggacccuugcuauuuccggacugcagacaggcgaugaagccgacuacuauugugagaccugggauggcagcgggggagucuucggcacagggaccaaggugacgguucuc

SEQ ID NO: 40672 - RNA, 333 nt, Artificial Sequence
  derived and/or modified sequence opt5 from anti-HIV_119-039188_VR-Chain
cagagcgugcugacccaacccccuucccucucuggcgccccggggcagacagucacgaucagcugcuccggaucuagcuccaacauuggcaauaacuacguuucuugguaucagcagcugcccgggaccgcuccuaaacuucugaucuacgacagcaauagacggcccuccgggauuccugaucgcuucagcggcucuaaguccgggacaagcgccacccucgcgaucucuggacugcaaacaggcgacgaggcugauuauuguugcgccguguggggcgugagacggggagccggagcugucuuuggcgccgggaccaaggugacaguucuu

SEQ ID NO: 40673 - RNA, 321 nt, Artificial Sequence
  derived and/or modified sequence opt5 from anti-HIV_119-039058_VR-Chain
cagagcgugcugacccaacccccuuccgucucuggcgccccggggcagagaguuacaaucagcugcacgggauccucuagcaacauuggcaauaacuacguguccugguaucggcgccuccccgggaccgcuccuaagcugcuuaucuacgagaauaacaaaagacccucuggcauuccugaccgguucagcggagccaaguccgggacaagcgcgacccuggcuaucacaggacuccagaccggcgaugaagccgacuauuuuuguucuacaugguccggcagccugaauuucgggaccggaacgcgcgugaccguccuu

SEQ ID NO: 40674 - RNA, 321 nt, Artificial Sequence
  derived and/or modified sequence opt5 from anti-HIV_119-038837_VR-Chain
cagagcgugcugacccaacccccuuccgucucugccgcuccgggccagaagguuacaaucagcugcuccgggggaacgucuaacauuggcaauaacuucgugagcugguaccagcaccuccccgggaccgccccuaaacugcuuaucuuugagaauaacaagagacccuccggagugccugaccgguucucuggcgcgaaaagcgggacauccgcuacccuggccauuacaggacuccagaccggcgaugaaggcgacuauuacugugccacauggagcgggucucugaauaucggaaccggcacgaaggucaccgugcuu

SEQ ID NO: 40675 - RNA, 321 nt, Artificial Sequence
  derived and/or modified sequence opt5 from anti-HIV_119-038396_VR-Chain
cagagcgugcugacccagcccccuuccgucucugccacaccgggccagaagguuacgaucagcugcuccgggucuaacagcaauauuggaaacaaauacguguccugguaucaacucuuccccggcaccgcuccuaagcugcuuaucucugagaauaacagacggcccagcgggacaccugaccgcuuuuccggaagcaaaucuggcaccuccgccacacuggcgauuaccgggcuccagacaggagaugaagcugacuacuauugugccaccuggagcggcucucugaauaucggcacggggaccaaggugacaguccuu

SEQ ID NO: 40676 - RNA, 321 nt, Artificial Sequence
  derived and/or modified sequence opt5 from anti-HIV_119-036918_VR-Chain
cagagcgugcugacccaacccccuuccgucucugccgcuccgggccagaagguuacaaucagcugcuccggggccacgucuaacauuugggaccacuacgugagcugguaucuccaggugcccggaaccgcgccuagacugcuuaucuacgauaaugacaaacggcccuccggcauuccugaucgcuucucugggagcaaguccggaacaagcgcuacccuggccaucacaggccuccagaccggggacgagggagauuauuacugugccacauggucuggcucccugaacauuggcaccgggacgaaagucaccgugcuu

SEQ ID NO: 40677 - RNA, 324 nt, Artificial Sequence
  derived and/or modified sequence opt5 from anti-HIV_119-036592_VR-Chain
cagagcgugcugacccaacccccuuccgucucugccgcuccgggccagaagguuacaaucagcugcuccgggucuaacagcaauacgggaaacaaagacguguccugguaccaacaggugcccgccaccgcgccuaagcuccugauuuaugagucuaauaaaagacccagcggcaucccugaucgguucuccgggagcaagucuggaacauccgcuacccuugccauuacaggccugcagaccggggacgaagccgauuacuauugugcuaucugggacggacgcgucagcgugauuggcacaggcaccaaaguuacggugcuc

SEQ ID NO: 40678 - RNA, 324 nt, Artificial Sequence
  derived and/or modified sequence opt5 from anti-HIV_119-036310_VR-Chain
cagagcgugcugacccaacccccuuccgucucugccgcuccgggccagaagguuacaaucagcugcuccgggucuacgagcaacauuggacagaauuacguguccugguaucagcaacuccccggcaccgccccuaaacugcuuaucuacgagaacaauagacggcccucugggagcccugaccgcuucuccggaagcaagucuggcacauccgcgacccuggcuauuacagggcuccagaccggagaugaagccgacuauuacugugagacaugggauggcagcggcgggguguuuggaaccggcacgaaagucaccgugcug

SEQ ID NO: 40679 - RNA, 333 nt, Artificial Sequence
  derived and/or modified sequence opt5 from anti-HIV_119-035618_VR-Chain
cagagcgugcugacccaacccccuuccgucucugccgcuccgggccagaagguuacaaucagcugcuccgggucuagcuucacgauuggaaacaaucacguguccugguaccagcagcuccccggcaccgccccuaaacugcuuaucuuugagucucauaagagacccagcggggugccugaccgguucuccggaagcaaaucuggcacauccgcgacccuggcuauuacagggcuccaaaccggagaugaagccgacuauuacuguacagucuggggcgugcgcaagggcguuggggccguguuuggaaccggcacgaaagucaccgugcug

SEQ ID NO: 40680 - RNA, 321 nt, Artificial Sequence
  derived and/or modified sequence opt5 from anti-HIV_119-035569_VR-Chain
cagagcgugcugacccaacccccuuccgucucuggcgccccggggcagacaguuacgaucagcugcaccggauccucuagcaacauuggcggguacgacgugcacugguaucagcagcuccccggaacagcuccuaagcugcuuaucuacgagaauaacagacggcccuccggcaccccugaucgcuucucuggggccaaaagcggaacauccgcgacccuggcuauuacaggccuccaaaccggcgacgaaggggauuauuacugugccacguggagcggaucucugaauaucggcaccgggacaaaggugaccguccuu

SEQ ID NO: 40681 - RNA, 324 nt, Artificial Sequence
  derived and/or modified sequence opt5 from anti-HIV_119-035466_VR-Chain
cagagcgugcugacccaacccccuuccgucucugccgcugccggccagaacguuaauaucagcugcuccgggaagaaaucuaacauuggaaauaacuacgugagcugguaucagcaguucccgggcacagcgcccaagcuccugaucuacgggaauacgaacagaccuuccggcauucccgaccgguuuucuggaagcaaauccgggaccagcgcuacacuugccaucaccggacugcaaacaggcgaugacgccgauuauuacugugagaccugggacggcucugggggaguguucggcacagggaccaaggucacggugcuc

SEQ ID NO: 40682 - RNA, 333 nt, Artificial Sequence
  derived and/or modified sequence opt5 from anti-HIV_119-035157_VR-Chain
cagagcgugcugacccaacccccuuccgucucugccgcuccgggccagaagguuacaaucagcugcuccgggucuagcuccaacauuggaaauaacuucgugucuugguaccagcagagacccggcacggccccuaaacuccugaucuaugagaccaauaagcggcccagcgggauuccugaccgcuuuuccggaagcaaaucuggcacauccgcgacccuugcuaucacagggcugcaaaccggagaugaagccgacuacuauugugccacaugggcucccagacucaacagcgcccggguguucggcaauggcaccauggucacggugcug

SEQ ID NO: 40683 - RNA, 333 nt, Artificial Sequence
  derived and/or modified sequence opt5 from anti-HIV_119-035121_VR-Chain
cagagcgugcugacccaacccccuuccgucucugccgcuccgggccagaagguuacaaucagcugcuccgggucuacgagcuacauuggaaacaaauauguguccugguaccagcaguuccccggcgccgcgccuaagcuccugaucuaugagaauaacaaaagacccucugggauuccugaccgguuuagcgcuuccaagagcgccaccucugccacacuugcuaucaccggacugcaaacaggcgaugaagccgacuacuguugcgcuguguggggaguccgcagaggggccggcgcgguguucggcgccgggaccaaaguuacagugcuc

SEQ ID NO: 40684 - RNA, 324 nt, Artificial Sequence
  derived and/or modified sequence opt5 from anti-HIV_119-035046_VR-Chain
cagagcgcccugacccaacccgcuuccgugucuggcagcccugggcaguccaucacaauuucuugcacgggaaccagcuccgacgucggcuacgauuauguuucuugguacagacaggugccggccacaacccccaagcuccugaucuaugagaacaauaaacggccuagcgggauucccgaccgcuucuccggaagcaagucuggcacauccgcgacccuugcuaucacagggcugcagaccggagaugaagccgacuacuauugugccacgugggauggcagagugagcgucauuggcaccgggacaaaagugaccguugug

SEQ ID NO: 40685 - RNA, 324 nt, Artificial Sequence
  derived and/or modified sequence opt5 from anti-HIV_119-034754_VR-Chain
cagagcgugcugacccaacccccuuccgucucugccgcuccgggcgagaagguuacaaucagcugcuccgggucuagcuccaacauuggaaauaacuacgugucuugguaucagcagcuccccggcacggugccuaaacugcuuaucuacgacaauaacaagagacccagcgggaccccugaucgguucuccggaagcaaaucuggcacauccgccacccuggcgauuacagggcuccagaccggagacgaagcugauuauuacugugagacaugggacggcagcggcggggucuuuggaaccggcacgaaggugaccguucug

SEQ ID NO: 40686 - RNA, 324 nt, Artificial Sequence
  derived and/or modified sequence opt5 from anti-HIV_119-034318_VR-Chain
cagagcgugcugacccaacccccuuccgucucugccgcuccgggccagaagaucacaauuagcugcuccgggucuagcuccaacaucggaaauaacgacguuucuugguaccagcagcuccccggcacggccccuaaacugcuuauuuaugagaaugauagacggcccagcgggaccccugaccgcuucuccggaagcaagucuggcacauccgcgacccuggcuaucacagggcuccaaaccggagaugaagccgacuacuauugugagacaugggauggcagcggcgggguguuuggaaccggcacgaaagugaccguccug

SEQ ID NO: 40687 - RNA, 333 nt, Artificial Sequence
  derived and/or modified sequence opt5 from anti-HIV_119-033780_VR-Chain
cagagcgugcugacccaacccccuuccgucucugccgcuccgggccagagaguuacaaucagcugcuccgggacgucuagcaacauuggagagaauuacguguccugguaucagcagauccccggcaccgccccuaagcuccugauuuacgaaaacaauaaacggcccucugggaucccugaccgcuucagcggauccaagagcggcacaucugcgacccuugugauuacagggcugcaaaccggagaugaggcugacuuuuauuguggcacauggggcgggucccucagaaccggaggcguccuggggacgggaacccgggugacaguucuu

SEQ ID NO: 40688 - RNA, 333 nt, Artificial Sequence
  derived and/or modified sequence opt5 from anti-HIV_119-033632_VR-Chain
cagagcgugcugacccaacccccuuccgucucugccgcuccgggccagagaguuacaaucagcugcuccgggggaucuagcaacauuggcuccaauuacgugucuugguaucagcagcuccccgggacggccccuaagcugcuuaucuaccaaaacaauaaacggcccagcgggauuccugaccgcuucuccggcagcaagucugggaccuccgcgacacugggaaucaccggccuccagacaggcgaugaggcugacuauuacuguaccguguggggagucagaaaaggagugggcgccguuuuugggacaggaaccaaggugacgguccug

SEQ ID NO: 40689 - RNA, 333 nt, Artificial Sequence
  derived and/or modified sequence opt5 from anti-HIV_119-033183_VR-Chain
cagagcgugcugacccaacccccuuccgucucugccgcuccgggccagaugguuacaaucagcugcuccgggggagccucuaaccucggcaagaauagcguguccugguaccagcagcugcccgggacggcgccuaaacuucugauuuaugaggacaacagacggcccucuggaaccccugaucgcuucagcggcuccagaagcgggacaucugcuacccucgccaucacaggacugcaaaccggcgacgaagccgauuacuauuguacaauuuggggcgugcggaagggggucggagcuguguuuggcaccgggacgaaaguuaccgugcuu

SEQ ID NO: 40690 - RNA, 333 nt, Artificial Sequence
  derived and/or modified sequence opt5 from anti-HIV_119-030696_VR-Chain
cagagcgugcugacccaacccccuuccgucucuggcgccccggggcagaucguuacacucagcugcacgggagcuaugaccaacauuggcaauaacgacgugcacugguaccagcaucugcccgggacaggaccuaaacuucugaucuaugagaauaacaagagacccuccggcauuccugaucgguucucugggagcaaguccggaaccucugccacacucgugaucaccggccugcagacaggcgacgaagcggauuuuuacugugggaccugggacggaagccuucgcacgggcggggucauuggaaccggcacaagagugaccguucug

SEQ ID NO: 40691 - RNA, 324 nt, Artificial Sequence
  derived and/or modified sequence opt5 from anti-HIV_119-030059_VR-Chain
cagagcgugcugacccaacccccuuccgucucugccgcuccgggccagaagguugugaucagcugcuccgggucuagcuccauuaucgagaaaaacucuauuagcugguaccagcagggacccggcgccgcgccuaagcuccugaucuaugaaaaugacaaaagacccuccgggauuagcgaucgguucucuggauccaagagcgcuacaucugccacgcuugccaucaccggccugcacacaggggacgaggcugauuacuauugugaaaccugggacggauccggcggcguguuugggacaggaaccaaagucacagugcuc

SEQ ID NO: 40692 - RNA, 333 nt, Artificial Sequence
  derived and/or modified sequence opt5 from anti-HIV_119-029589_VR-Chain
cagagcgugcugacccaacccccuuccgucucugccgcuccgggccagaagguuacaaucagcugcuccgggacgucuagcaacauuggaaauaacuucguguccugguaccagcuccugcccggcaccgccccuagacuucugaucuaugacaauaacaaacggcccucugggacaccugaucgcuuuagcggauccaagagcggcaccucugcgacacucgggauuaccggacugcagacaggcgacgaggcugauuucuacuguggcaccugggacgggucccuuagaacgggaggcgugaucgggaccggaacacgggucaccgugcug

SEQ ID NO: 40693 - RNA, 324 nt, Artificial Sequence
  derived and/or modified sequence opt5 from anti-HIV_119-029448_VR-Chain
cagagcgugcugacccaacccccuuccgucucugccgcuccgggccagaagguuacaaucagcugcuccgggaacucuagcaauauuggcaaaaacuccgugucuugguaccaccagcuccccggaacggccccuaagcugcuuaucuaugagaaugacagacggcccagcgggaccccugaucgcuucuccggaagcaaaucuggcacauccgcgacccuggcuauuacagggcuccagaccggagacgaagccgauuacuauugugagacaugggacggcagcggcgggguguuuggaaccggcacgaaggucaccgugcug

SEQ ID NO: 40694 - RNA, 333 nt, Artificial Sequence
  derived and/or modified sequence opt5 from anti-HIV_119-029220_VR-Chain
cagagcgugcugacccaacccccuuccgucucugccgcuccgggccagaagguuacaaucagcugcuccgggucuacgagcaacauuggacagaauuacguguccugguaucagcaacuccccggcaccgccccuaaacugcuuaucuacgagaacgacagacggcccucugggauuccugaucgcuucagcggauccaagagcggcacaucugcgacccuggcuaucuccgggcuccagacaggagacgaagccgauuauuguugcgccguguggggcgucagacggggcgcuggggccguguuuggacccggcaccaaaguuacagugcug

SEQ ID NO: 40695 - RNA, 333 nt, Artificial Sequence
  derived and/or modified sequence opt5 from anti-HIV_119-028317_VR-Chain
cagagcgugcugacccaacccccuuccgucucugccgcuccgggccagaagguuacaaucagcugcuccgggucuagcuccaacauuggaaaugacuacgugucuugguaucagcagcuccccggcacggccccuaaacugcuuaucuacgagaacaauaagagacccagcgggauuccugaucgguucuccggaagcaaaucuggcaccuccgcgacacuggcuaucaccgggcuccaaacaggagacgaagccgauuauuacuguaccauuuggggcgugcgcaagggcgucggggccguguuuggaacaggcaccaaaguuacggugcug

SEQ ID NO: 40696 - RNA, 324 nt, Artificial Sequence
  derived and/or modified sequence opt5 from anti-HIV_119-028165_VR-Chain
cagagcgugcugacccaacccccuuccgucucugccgcuccgggccagacaguuacgaucagcugcuccgggauuaccucuaacaucggaaagaaugacgugagcugguaccagcagcuccccggcacagccccuaaacugcuuauuuccgagaacaauagacggcccucugggaucccugaucgcuucagcggauccaagagcggcaccucugcgacacuggcuauuaccgggcuccaaacaggagacgaagccgauuauuacugugccaucugggacggcagaguguccgucaucggcaccgggacgaaagugaccguucug

SEQ ID NO: 40697 - RNA, 324 nt, Artificial Sequence
  derived and/or modified sequence opt5 from anti-HIV_119-027147_VR-Chain
cagagcgugcugacccaacccccuuccgucucugccgcuccgggccagacaguuacgaucagcugcuccgggucuaccagcgacauuggaaagaacgauguguccugguaccagcagcuccccggcaucgccccuaaacugcuuauuucugagaauaacagacggcccagcgggacaccugaccgcuucuccggaagcaagucuggcaccuccgcgacacuggcuaucaccgggcuccaaacaggagaugaagccgacuauuacugugagaccugggauggcagcggcgccguguuugggacgggaaccaaagucacagugcug

SEQ ID NO: 40698 - RNA, 333 nt, Artificial Sequence
  derived and/or modified sequence opt5 from anti-HIV_119-026743_VR-Chain
cagagcgugcugacccaacccccuuccgucucugccgcuccgggccagaacguuacaaucagcugcuccgggucuagcuccaauauuggaaacaauuucgugucuugguaccagcagagacccggcacggggccuaagcuccugaucuaugagaccaaccggcgccccagcggcauuccugacagauuuuccggaagcaaaucugggacauccgccacccuugcgaucacaggacugcaaaccggcgaugaagcugacuacuauugugccacaugggcccccagccucaauucugcucggguguucggcaccgggacgaaggucaccgugcug

SEQ ID NO: 40699 - RNA, 333 nt, Artificial Sequence
  derived and/or modified sequence opt5 from anti-HIV_119-026508_VR-Chain
cagagcgugcugacccaacccccuuccgucucugccgcuccgggccagaagguuacaaucagcugcuccgggucuagcuccacgauuggaaacaauuacaucucuugguaucaggugcuccccggcaccgccccuaaacuggugauuuucaagaacaaugagagacccagccgggucccugaccgcuuuuccgggagcaaaucuggaacauccgcgacccuuggcaucacagggcugcagcucggagaugaaggcgacuacuauuguggcaccugggagacaagccugucugggggaggcguguucgggaccggaacgaagguuaccgugcuu

SEQ ID NO: 40700 - RNA, 324 nt, Artificial Sequence
  derived and/or modified sequence opt5 from anti-HIV_119-025683_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagacccagcgggauuccugaccgguucuccgauagccaaucuggaaccuccgcgacacuggcuaucaccggccuccagacaggggacgaagccgauuauuacugugagaccugggacggaagcggcggcguguuugggacaggaaccaaagucacggugcug

SEQ ID NO: 40701 - RNA, 333 nt, Artificial Sequence
  derived and/or modified sequence opt5 from anti-HIV_119-025614_VR-Chain
cagagccugcucacccaacccccuuccgugucugccgcuccgggccagaacgucaucauuagcugcuccgggucuagcuccaauaucggaaagaacuacguugccugguaucaacaggugcccggcacagcgccuaaaauuguggucuucgagacgaccaauagacccucugggaucccugaccgguuuagcggauccaagagcggcacaucugcuacccuggccauuacagggcuucagaccggagaugaagccgacuacuauuguacaguguggggcguucgcaaaggcgugggggcugucuucggaaccggcacgaaggugaccguucug

SEQ ID NO: 40702 - RNA, 324 nt, Artificial Sequence
  derived and/or modified sequence opt5 from anti-HIV_119-025548_VR-Chain
cagagcauccugacccaacccccuuccgugucugccgcuccgggccagaaggucacaauuagcugcuccgggucuagcuccaacaucggaaauaacuacguuucuugguaucagcacgugcccggcacggccccuaaacuccugauuuacgagaauaacagacggcccagcgggaccccugaccgcuucuccggaagcaagucuggcacauccgcgacccuugcuaucacagggcugcagagcggagaugaagccgacuauuacuguggcaccugggauggcucugggggaguguuuggcacagggaccaaagucacggugcuc

SEQ ID NO: 40703 - RNA, 333 nt, Artificial Sequence
  derived and/or modified sequence opt5 from anti-HIV_119-025526_VR-Chain
cagagcgugcugacccaacccccuuccgucucugccgcuccgggccagaagguuacaaucagcugcuccgggucugccagcaacauuggcaaaaauuucguguccugguaccagcagcuccccggaacggcgccuaagcugcuuaucuaugagaacaauagacggcccucugggaccccugaccgcuuuagcggauccaaaagcggcacaucugcuacccuggccauuacagggcuccaaaccggagaugaagccgacuacuauuguacaguguggggcgucagaaagggcgugggggcuguuuucggaaccggcacgaaagugaccguccug

SEQ ID NO: 40704 - RNA, 324 nt, Artificial Sequence
  derived and/or modified sequence opt5 from anti-HIV_119-023552_VR-Chain
cagagcgugcugacccaacccccuuccgucucugccgcuccgggccagacaguuacgaucagcugcuccgggucuaccagcaacauuggaaagaaugacguguccugguaccagcagcuccccggcacagccccuaaacugcuuaucucugagaacaauagacggcccagcgggaccccugaucgcuucuccgcgagcaagucuggaacauccgcuacccuggccauuacaggccuccaaaccggggacgaagccgauuauuacugugagacguggcacggaagcggcggcguguuugggaccggaacaaaagucaccgugcug

SEQ ID NO: 40705 - RNA, 321 nt, Artificial Sequence
  derived and/or modified sequence opt5 from anti-HIV_119-023092_VR-Chain
cagagcgugcugacccaacccccuuccgucucugccgcuccgggccagaagguuacaaucagcugcuccgggucuacgagcgaccucggacagaccagaguguccugguaccagcaacugccccggucugccccugagcuucugauuuucgaaaacaaucgcagacccagcggcaucccugaucgguuuuccggggcgaaaagcggaacaucugcuacccucgccauuacaggccugcagaccggggacgaggccgauuauuucuguuccacauggagcggaucucuuaacuuuggcaccggcacgcgcgugaccguccug

SEQ ID NO: 40706 - RNA, 324 nt, Artificial Sequence
  derived and/or modified sequence opt5 from anti-HIV_119-022793_VR-Chain
cagagcgugcugacccaacccccuuccgucucugccgcuccgggccagaagguuacaaucagcugcuccgggggaacgucuaacauuggcaauaacuacgugagcugguauagacggcuccccgggaccgccccuaaacugcuuaucuacgagaauaacaagcgccccuccggcauuccugacagauucucuggagcgaaaagcgggacauccgcuacccugggaaucacaggccuccagaccggcgaugaagccgacuauuacugugagacaugggaugacagcgggggaguguuuggcaccgggacgaaggucaccgugcug

SEQ ID NO: 40707 - RNA, 324 nt, Artificial Sequence
  derived and/or modified sequence opt5 from anti-HIV_119-022395_VR-Chain
cagagcgugcugacccaacccccuuccgucucugccgcuccgggccagacaguuacgaucagcugcuccgggucuaccagcaacauuggaaagaaugacguguccugguaccagcagcuccccggcacagccccuaaacugcuuaucucugauaacaauagacggcccagcuggaccccugaccgcuucuccgggagcaagucuggaacauccgcgacccuggcuauuacaggccuccaaaccggggaugaggccgacuauuacugugaaacgugggauggaagcggcggcguguuugggcccggaaccagagucacagugcug

SEQ ID NO: 40708 - RNA, 333 nt, Artificial Sequence
  derived and/or modified sequence opt5 from anti-HIV_119-022334_VR-Chain
cagagcgugcugacccaacccccuuccgucucugccgcuccgggccagaacguuaauaucagcugcuccgggggaucuagcaacauuggcuccaauuacgugucuugguaucagcaguuccccgggacagccccuaagcaccucaucuacgagaacaauaaaagacccagcggcauuccugaccgguuuuccgauagccaaucuggaacguccgcgacccuggggaucacaggacuucagaccggcgacgaagcugauuauuacuguggcacaugggacgggagccugcgcaccggaggcgugauugggacaggaaccagagucacggugcuc

SEQ ID NO: 40709 - RNA, 321 nt, Artificial Sequence
  derived and/or modified sequence opt5 from anti-HIV_119-021866_VR-Chain
cagagcgugcugacccaacccccuuccgucucugccgcuccgggccagagaguuacaaucagcugcuccgggucugccagcaacauuggaaagaauuucguguccugguaccagcagcuccccggcaaagcgccuaagcugaucauuuaugaggugacgaaacggcccucuggggucccugcucgcuuuagcggauccaagagcggcaccucugccacacuugccaucaccgggcugcaaacaggagacgaagcugauuacuucuguuccaccuggagcggcucucucaacuuuggcacagggaccagagugacgguucug

SEQ ID NO: 40710 - RNA, 324 nt, Artificial Sequence
  derived and/or modified sequence opt5 from anti-HIV_119-021278_VR-Chain
cagagcgugcugacccaacccccuuccgucucugccgcuccgggccagaagguuacaaucagcugcuccgggucugccagcaacauuggcaaaaauuucguguccugguaccagcagcuccccggaacggcgccuaagcugcuuaucuaugagaacaauagacggcccucugggaccccugaccgcuuuagcggauccagaagcggcacaucugcuacccuggggauuacaggacuccaaaccggcgaugaagcccacuacuauugugagacaugggacgauuccggcgggguguucggaaccggcacgaaagucaccgugcug

SEQ ID NO: 40711 - RNA, 333 nt, Artificial Sequence
  derived and/or modified sequence opt5 from anti-HIV_119-021183_VR-Chain
cagagcgugcugacccaacccccuuccgucucugccgcuccgggccagaagguuacaaucagcugcuccgggaacucuagcaauauuggaaacaauuucguguccugguaccagcaguuucccggcacggccccuaaacuccugguguucgagacccacagacggcccucugggaucccugaccgcuuuagcggauccaagagcggcacaucugcgacccuugcuauuacagggcugcaaaccggagaugaagccgacuauuacugugccgucuggggcgugagacggggcguuggggcuguguucggagccggcacaaaagucaccgugcuc

SEQ ID NO: 40712 - RNA, 333 nt, Artificial Sequence
  derived and/or modified sequence opt5 from anti-HIV_119-019376_VR-Chain
cagagcgugcugacccaacccccuuccgucucugccgcuccgggccagaagguuacaaucagcugcuccgggucuagcuccaacauuggaaauaacuacgugucuugguaucaacaggugcccggcacggccccuaaacuccuggucuacgagaccuauagacggcccagcgggaucccugaccgcuucuccggaagcaagucuggcacauccgcgacccuugcuauuacagggcugcagaccggagaugaagccgacuacuauuguacaaucuggggcgugagaaaaggcguuggggccguguuuggaaccggcacgaaggucaccgugcuc

SEQ ID NO: 40713 - RNA, 321 nt, Artificial Sequence
  derived and/or modified sequence opt5 from anti-HIV_119-019238_VR-Chain
cagagcgugcugacccaacccccuuccgucucugccgcuccgggccagaagguuacaaucagcugcuccgggacgucuagcaacauuggaaauaaccacguguccugguaccaacaggugcccggcaccgccccuaaacuccugaucuaugagaauaacaagagacccucugggauuccugcgcgguucagcgcugccaaauccggaacaagcgccacccuugcuaucacaggccugcagaccggggacgaagccgauuacuuuugugcuacauggucuggacgccucaauauuggcaccggcacgaaggucaccgugcug

SEQ ID NO: 40714 - RNA, 333 nt, Artificial Sequence
  derived and/or modified sequence opt5 from anti-HIV_119-018500_VR-Chain
cagagcgugcugacccaacccccuuccgucucugccgcuccgggccagaagguuaacaucagcugcuccgggucuagcuccaauauuggaaacaauuucgugucuugguaccagcagagacccggcacagccccuaaacuccugaucuaugagacgaaccggcgccccagcgggauuccugacagauuuuccggaagcaagucuggcaccuccgcgacacuugcuaucaccgggcugcaaacaggagaugaagccgacuacuauugugccaccugggcugccagccucacaucugcucggguguucggcauuggcaccaaagucacggugcug

SEQ ID NO: 40715 - RNA, 324 nt, Artificial Sequence
  derived and/or modified sequence opt5 from anti-HIV_119-018318_VR-Chain
cagagcgugcugacccaacccccuuccgucucugccgcuccgggccagacaguuaucauuagcugcuccgggucuacgagcaacaucggaaagaaugacguguccugguaccagcagcuccccggcaccgccccuaaacugcuuauuucugagaacaauagacggcccagcgggacaccugaucgcuucuccggaagcaagucuggcaccuccgcgacacuggcuaucaccgggcuccaaacaggagacgaugccgacuauuacugugaaaccugggauggcagcggcgggguguuuggaacgggcaccaaagucacacuggug

SEQ ID NO: 40716 - RNA, 333 nt, Artificial Sequence
  derived and/or modified sequence opt5 from anti-HIV_119-018218_VR-Chain
cagagcgugcugacccaacccccuuccgucucugccgcuccgggccagaagguuacaaucagcugcuccgggaacucuagcaauauuggaaacaauuucguguccugguaccagcagcuccccggcacggccccuaaacugcuuaucuaugagaacaauagacggcccucugggauuccugaccgcuuuagcggauccaagagcggcaccucugcgacacuggcuaucuccgggcuccaaaccggagaugaagccgacuacuggugugccguguggggcgucagacggggcgcuggggccguguucggagcuggcacaaaaguuaccgugcug

SEQ ID NO: 40717 - RNA, 324 nt, Artificial Sequence
  derived and/or modified sequence opt5 from anti-HIV_119-017876_VR-Chain
cagagcgugcugacccaacccccuuccgucucugccgcuccgggccagaagguuacaaucagcugcuccgggucuacgagcaaaauuggacagaacuccgugucuugguaccagcaacuccccggcaccgccccuaagcugcuuaucuaugagaaugacagacggcccagcgggacaccugaucgcuucuccgcgagcaaaucuggaaccuccgcuacacuggccauuaccggccuccagacaggggacgaagccgauuacuauugugagaccugggacgauagcggaggcguguuuggcacggggaccaaggucacagugcug

SEQ ID NO: 40718 - RNA, 324 nt, Artificial Sequence
  derived and/or modified sequence opt5 from anti-HIV_119-017740_VR-Chain
cagagcgugcugacccaacccccuuccgucucugccgcuccgggccagaagguuacaaucagcugcuccgggucuaacagcaauauuggaaacaaagacguguccugguacagacaggugcccgccacggcgccuaagcuccccaucuaugagaauaaaaacgaaccuucuggcguccccgaucgguucagcggguccaagagcggaaccucugcuacacuggccauuaccggccuucagacaggggacgaggccgauuacuauugugcuaccugggacggacgcguguccguuaucggcacaggcaccaaagugacggucgug

SEQ ID NO: 40719 - RNA, 321 nt, Artificial Sequence
  derived and/or modified sequence opt5 from anti-HIV_119-017128_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagacccagcgggauuccugaccgguucuccggagcgaaaagcggcaccucugcuacacuggccaucaccgggcuccaaacaggagaugaagccgacuauuuuuguuccaccuggagcggcucucugaauuucggcacagggacccgcgugacgguccuu

SEQ ID NO: 40720 - RNA, 324 nt, Artificial Sequence
  derived and/or modified sequence opt5 from anti-HIV_119-017044_VR-Chain
cagagcgugcugacccaacccccuuccgucucugccgcuccgggccagaagguuacaaucagcugcuccgggucuaacagcaauauuggaaacaauuacguguccugguaucaccaucuccccggcacggccccuagacugcuuaucuacgacaacaauaaacggcccucugggauuccugaucgcuucagcggauccaagagcggcaccucugcgacacuggcuaucaccgggcuccagacaggagacgaggccgauuauuacugugccaccugggacggcagaguguccgucauuggcacagggacccaggugacgguucug

SEQ ID NO: 40721 - RNA, 321 nt, Artificial Sequence
  derived and/or modified sequence opt5 from anti-HIV_119-016644_VR-Chain
cagagcgugcugacccaacccccuuccgucucugccgcuccgggccagaagguuacaaucagcugcuccgggggaacgucuaacauuggcaauaacuacgugagcugguaucagcagcuccccgggaccgccccuaaacugcuuaucuacgagaauaacaagagacccuccggcauuccugcgcgguucucugcugccaaaagcggaacauccgccacccuggcuaucacagggcuccaaaccgaagacgaggccgauuauuacugugcuacauggagcggaucucugaauauuggcaccggcacgaaggugaccguccuu

SEQ ID NO: 40722 - RNA, 333 nt, Artificial Sequence
  derived and/or modified sequence opt5 from anti-HIV_119-015878_VR-Chain
cagagcgcccugacccaacccccuuccgcuucuggcagcccggggcaguccgugacaaucucuugcagcggauccucuagcaacauuggcaauaacuucgucuccugguaccagcagagacccgggacggccccuaagcuccugaucuaugagaccaauaaacggcccagcggcauuccugaccgcuuuucuggauccaagagcgggacaucugcgacccuugcuaucacaggacugcaaaccggcgaugaagccgacuacuauugugccacaugggcucccagacucaacuccgcccggguuuucggcaaugggaccauggugacggugcug

SEQ ID NO: 40723 - RNA, 321 nt, Artificial Sequence
  derived and/or modified sequence opt5 from anti-HIV_119-015538_VR-Chain
cagagcgugcugacccaacccccuuccgucucugccacaccgggccagaagguuacgaucagcugcuccgggucuagcuccaacauuggaaauaacuacgugucuugguauagacggcuccccggcaccgcuccuaaacaccugaucuacgagacaaauaaccgccccagcggggugccugccagacuuuccgcggcuaagagcggaaccucugccacacuggccauuaccggccuccagacagaagacgaggcugauuauuacugugccaccugguccgggagccugaauaucggaacgggcaccaaagucacagugcuu

SEQ ID NO: 40724 - RNA, 321 nt, Artificial Sequence
  derived and/or modified sequence opt5 from anti-HIV_119-015455_VR-Chain
cagagcgugcugacccaacccccuuccgucucugccacaccgggccagaagguuacgaucagcugcuccgggucuaacagcaauauuggaaacaaagacguguccugguaccagcacuuccccggcaccgcuccuaagcuccugaucuaugagaauaacaaaagacccucugggauuccugaucgguuuagcggauccaagagcgccacaucugcgacccuuacaaucaccggccugcagacagaagacgaggcugauuacuauugugccaccugguccgggagccucaauauuggaacgggcaccaaagugacaguccug

SEQ ID NO: 40725 - RNA, 321 nt, Artificial Sequence
  derived and/or modified sequence opt5 from anti-HIV_119-014425_VR-Chain
cagagcgugcugacccaacccccuuccgucucugccgcuccgggccagaagguuacaaucagcugcuccgggggaacgucuaacauuggcaauaacuacgugagcugguaucagcaccuccccgggaccgccccuaaacugcuuaucuacgagaauaacaagagacccuccggcauuccugaccgguucucuggagcgaaaagcgggacauccgcuacccuggccaucacaggacuccagaccggcgaugaaggcgacuauuacugugccacauggagcgggucucugaauauuggaaccggcacgaaggugaccguccuu

SEQ ID NO: 40726 - RNA, 324 nt, Artificial Sequence
  derived and/or modified sequence opt5 from anti-HIV_119-013582_VR-Chain
cagagcauggugacccaaucccccucugucagcgccgcuccuggccagaagguuacaaucuccugcucugggacgagcuccaacauuggacagaauuacgugucuugguaucagcaacugccgggcaccgcccccaaacuccugaucagcgagaacaauagacggccuuccgggacacccgaccgcuucagcggaucuaaguccggcaccagcgcgacacuugcuauuaccgggcugcagacaggagaugaagccgacuacuauugugagaccugggauggcucuggcgggguguuuggaacgggcaccaaagucacagugcuc

SEQ ID NO: 40727 - RNA, 333 nt, Artificial Sequence
  derived and/or modified sequence opt5 from anti-HIV_119-013364_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgacaauaacaagagacccagcgggauuccugaucgguucuccggaagcaaaucuggcaccuccgcgacacuggcuaucaccgggcuccacacaggagacgaggccgauuauuacuguaccguguggggcguccgcaagggcgugggggccguuuuuggaacaggcaccaaagugacgguccug

SEQ ID NO: 40728 - RNA, 333 nt, Artificial Sequence
  derived and/or modified sequence opt5 from anti-HIV_119-012886_VR-Chain
cagagcauccugacccaacccccuuccgugucugccgcuccgggccagaaggucacaauuagcugcuccgggucuagcuccacgaucggaaccaacuacguuucuugguaucagcaguuccccggcacagccccuaaacuccugguguuugagacccacagacggcccagcgggauuccugaccgcuucuccggaagcaagucuggcacauccgcgacccuugcuaucacagggcugcaaaccggagaugaagccgacuacuauugugccguguggggcgucagacggggcgugggggcuguuuuuggagccggcacgaaagugaccguccuc

SEQ ID NO: 40729 - RNA, 333 nt, Artificial Sequence
  derived and/or modified sequence opt5 from anti-HIV_119-012249_VR-Chain
cagagcgugcugacccaacccccuuccgucucuggcgccccggggcagaagguuacaaucagcugcuccggaucuagcuccaacauuggcagaaauuacgugucuugguaucagcagcuccccgggacggcuccuaaacugcuuaucuacgagaacaauaagcggcccagcggcauuccugaccgcuucuccggaagcaaaucugggaccuccgccacacuggugaucaccggacuccaaacaggcgaugaagcggacuuuuauuguggcaccugggaugggagccugucuggaggcggggucauuggaacaggcaccagagugacgguucuu

SEQ ID NO: 40730 - RNA, 324 nt, Artificial Sequence
  derived and/or modified sequence opt5 from anti-HIV_119-012161_VR-Chain
cagagcuuccugacccaacccccuuccgugucugccgcuccgggccagaaggucacaaucagcugcuccgggucuaacagcaauauuggcaaaaacuacguuuccugguaucaguaccuccccggaacggugccuaagcugcuuaucuaugagaaugacaaaagacccucugggauuccuggacgguuuagcgccuccaagagcggcaccucugcgacacuggcuaucaccgggcuccagacaggagaugaagccgacuacuauuguggcaccugggauggcuccgggggaguguucggcacagggaccaaagucacggugcug

SEQ ID NO: 40731 - RNA, 324 nt, Artificial Sequence
  derived and/or modified sequence opt5 from anti-HIV_119-012110_VR-Chain
cagagcgugcugacccaacccccuuccgucucugccgcuccgggccagacaguuacgaucagcugcuccgggucuaccagcaacauuggaaagaaugacguguccugguaccagcagcuccccggcacagccccuaaacugcuuaucucugagaacaauagacggcccagcgggaccccugaucgcuucuccggaagcaagucuggcacauccgcgacccuggcuauuagcgggcuccaaacaggagacgaagccgauuauuacuguggcaccugggacggcucugggggaguguuuggcacggggaccaaagucacagugcug

SEQ ID NO: 40732 - RNA, 333 nt, Artificial Sequence
  derived and/or modified sequence opt5 from anti-HIV_119-012100_VR-Chain
caggccgugcugacccaacccccuagcgucuccgcugccccgggccagaagguugcgaucucuugcagcggguccucuagcaacauuggaaauaacuacguguccugguaucagcagcuccccggcacagugccuaaacugcuuaucuacgacacggauaagagacccucugggauuccugaccgguucagcggauccaaaagcggcaccucugcuacacuggggaucacccgccuccaaacaggagaugaggccgacuauuacugugccaccugggcucccagacuuaauuccgcccgggucuuuggcaacggcacaauggugaccguucug

SEQ ID NO: 40733 - RNA, 324 nt, Artificial Sequence
  derived and/or modified sequence opt5 from anti-HIV_119-011651_VR-Chain
cagagcgugcugacccaacccccuuccgucucugccgcuccgggccagaagguuacaaucagcugcuccgggaacucuagcaauauuggaaacaauuacguguccugguaucagcagcuccccggcacggccccuaaacugcuuaucuacgagaacaauaagagacccucugggauuccugaccgguucagcggauccaaaagcggcaccucugcgacacuggcuaucaccgggcuccaaacaggagaugaagccgacuauuacugugccaccugggauggccgcguguccgucuuuggcacagggaccaagguggcuguucug

SEQ ID NO: 40734 - RNA, 333 nt, Artificial Sequence
  derived and/or modified sequence opt5 from anti-HIV_119-011479_VR-Chain
cagagcgugcugacccaacccccuuccgucucugccacaccgggccagaagguuacgaucagcugcuccgggucuaacagcaauauuggaaacaaauacguguccugguaucagcacuuccccggcaccgcuccuaagcuccugaucuacgagaauaacagacggcccucugggauuccugaccgcuuuagcggauccaaaagcggcacaucugccacccuugcgaucacagggcugcagaccggagaugaagcugacuauuacuguacaauuuggggcgugagaaagggcgucggggccguguucggaaccggcacgaaaguuaccgugcuc

SEQ ID NO: 40735 - RNA, 333 nt, Artificial Sequence
  derived and/or modified sequence opt5 from anti-HIV_119-011232_VR-Chain
cagagcgugcugacccaacccccuuccgucucugccgcuccgggccagaacguuaauaucagcugcuccgggggaucuagcaacauuggcuccaauuacgugucuugguaucagcaguuccccgggacagccccuaagcuccugaucuacgacgaugacaaaagacccagcggcauuccucaccgguuuuccgcgagcaagucuggaacguccgcuacccuugccaucagcgggcugcaaacaggagaugaggccgacuauuguugcgcuguguggggcguccgcagaggcgccggggcuguguucggagccggcaccaaaguuacagugcuc

SEQ ID NO: 40736 - RNA, 333 nt, Artificial Sequence
  derived and/or modified sequence opt5 from anti-HIV_119-011175_VR-Chain
cagagcgugcugacccaacccccuuccgucucugccgcuccgggccagaagguuacaaucagcugcuccgggucuaacagcuacauuggaaauaaauauguguccugguaccagcaguuccccggcacggccccuaagcuccugaucuaugagaacaauagacggcccucugggauuccugaccgcuuuagcggauccaaaagcggcaccucugcgacacuugcuaucuccgggcugcaaaccggagaugaagccgacuacuguugcgccguguggggcgucagacggggcgcuggggccguguucggacccggcacaaagguuaccgugcuc

SEQ ID NO: 40737 - RNA, 321 nt, Artificial Sequence
  derived and/or modified sequence opt5 from anti-HIV_119-008396_VR-Chain
cagagcgugcugacccaacccccuuccgucucugccgcuccgggccagaagguuacaaucagcugcuccgggucuagcuccaacauuggaaauaacuacgugucuugguaucaacaggugcccggcacggccccuaaacuccuggucuacgagaauaccagacggcccagcggggugccugaccgcuucuccggagcuaagagcggcacaucugcgacccuugccaucacagggcugcagaccggagaugaaggcgacuauuacugugccacaugguccggcagccucaacauugggaccggaacgaaaguuaccgugcug

SEQ ID NO: 40738 - RNA, 324 nt, Artificial Sequence
  derived and/or modified sequence opt5 from anti-HIV_119-007148_VR-Chain
cagagcgugcugacccaacccccuuccgucucugccgcuccgggccagaagguuacaaucagcugcuccgggucuacgagcaacauuggcaaaaauuacguguccugguaucagcaccuccccggaaccgccccuaagcugcuucuguacgagaacgacagacggcccucugggacaccugaucgcuucagcggauccaaaagcggcaccucugcgacacucgcuaucaccgggcugcauacaggagacgaagccgauuauuacugugagaccugggacggcuccggcgggguguuuggaacgggcaccaaggucacagugcuu

SEQ ID NO: 40739 - RNA, 333 nt, Artificial Sequence
  derived and/or modified sequence opt5 from anti-HIV_119-007029_VR-Chain
cagagcgugcugacccaacccccuuccgucucugccgcuccgggccagaagguuacaaucagcugcuccgggaacucuagcaauauuggaaacaauuucguguccugguaccaacaggugcccggcacggccccuaaacuccugcuuuaugagaccuacagacggcccucugggaucagcgaccgcuuuuccggaagcaagucuggcacauccgcgacccuggcuauuacagggcuccagaccggagaugaagccgacuauuacuguacagucuggggcgugagaaaaggcguuggggccguguucggaaccggcacgaaggucaccgugcug

SEQ ID NO: 40740 - RNA, 324 nt, Artificial Sequence
  derived and/or modified sequence opt5 from anti-HIV_119-004707_VR-Chain
cagagcgugcugacccaacccccuuccgucucugccgcuccgggccagaagguuacaaucagcugcuccgggucuacgagcaacauuggcaaaaaugacguguccugguaccagcagcuccccggaaccgccccuaagcugcuuaucucugagaacaauagacggcccagcgggacaccugaucgcuucuccggaagcaaaucuggcaccuccgcgacacuggcuauuaccgggcuccaaacaggagacgaagccgauuauuacugugagaccugggacggcagcggcgggguguuuggaacgggcaccaaggucacagugcug

SEQ ID NO: 40741 - RNA, 333 nt, Artificial Sequence
  derived and/or modified sequence opt5 from anti-HIV_119-003910_VR-Chain
cagagcgugcugacccaacccccuuccgucucugccgcuccgggccagaagguugccaucagcugcuccgggaacacaucuagcauuggaaauaacuucguguccugguaccaacaggugcccggcacggcgccuaaacuccuggucuaugagaccuacagacggcccucugggaucccugaccgcuuuagcggauccaagagcggcacaucugcuacccuugccauuacagggcugcagaccggagaugaagccgacuauuacuguacaguguggggcguuagaaaaggcgugggggcugucuucggaaccggcacgaaggugaccguucuc

SEQ ID NO: 40742 - RNA, 321 nt, Artificial Sequence
  derived and/or modified sequence opt5 from anti-HIV_119-002450_VR-Chain
cagagcgugcugacccaacccccuuccgucucuggcgccccggggcagagaguuacaaucagcugcacgggauccucuagcaacauuggcaauaacuacguguccugguaucaggggcuccccggaaccgcuccuaagcugcuuaucuacgagaauaacaaacggcccucuggcauuccugaccgcuucagcggggccaaguccggaacagcggcuacccuggccaucacaggccuccagaccggcgaugaagccgacuauuacugugcuacauggagcgggucucugaauuuuggaaccggcacgaaagugaccguccuu

SEQ ID NO: 40743 - RNA, 321 nt, Artificial Sequence
  derived and/or modified sequence opt5 from anti-HIV_119-001552_VR-Chain
cagagcgugcugacccaacccccuuccgucucugccgcuccgggccagaagguuacaaucagcugcuccgggucuaacagcuaccucggaaauaaauauguguccugguaccagcaguuccccggcacggccccuaagcugcuuauuuaugagaacaauaaaagacccucugggaucccugaccgguuuagcgcguccaagagcgcugccucugccacccuggcuauuacaggacuccaaaccggcgaugaaggggacuacuauugugccacauggaccggaucccugaacaucggcacaggcaccaaagugacgguccuu

SEQ ID NO: 40744 - RNA, 333 nt, Artificial Sequence
  derived and/or modified sequence opt5 from anti-HIV_059-188169_VR-Chain
cagagcgugcugacccaacccccuuccgucucugccgcuccgggccagaagguuacaaucagcugcuccgggucuacgagcaacauuggagacaauuacguguccugguaucaacaggugcccggcaccgccccuaaacuccugaucuacgagaacaauagacggcccucugggacaccugaucgcuucagcggauccaagagcggcaccucugcgacacuugcuauuaccgggcugcagacaggagacgaagccgauuauuacuguggcaccugggacacgucccucagcaccggcggggucuuuggaacaggcaccaaagugacaguucug

SEQ ID NO: 40745 - RNA, 333 nt, Artificial Sequence
  derived and/or modified sequence opt5 from anti-HIV_059-183739_VR-Chain
cagagcgugcugacccaacccccuuccgucucugccgcuccgggccagaagguuacaaucagcugcuccgggucuacgagcaacauuggcaaaaauuacguguccugguaucagcagcuccccggaaccgccccuaagcugcuuaucuacgagaacaauagacggcccucugggacaccugaccgcuucagcggauccaaaagcggcaccucugcgacacuggggauuuccggacuccaaaccggcgaugaagcugacuauuacuguggcacaugggauaccagccugucugggggaggcguguuugggacgggaaccaaggucacagugcuu

SEQ ID NO: 40746 - RNA, 333 nt, Artificial Sequence
  derived and/or modified sequence opt5 from anti-HIV_059-182376_VR-Chain
cagagcgugcugucccaacccccuucugucagcgccgcuccgggccagaagguuaccaucuccugcucugggagcuccucuaacauuggaaauuacuaugugagcugguaccagcaguuccccggcacagccccuaaacuccugaucuauaagaacgacaauagacccuccgggauuccugaucgguuuagcggaucuaaauccggcacgagcgcgacccuugggaucucuggacugcaaacaggcgacgaggcugauuacuauuguggcaccugggggacaucccucagcggaggcgggguguucggaaccggcacaaaggucaccgugcug

SEQ ID NO: 40747 - RNA, 333 nt, Artificial Sequence
  derived and/or modified sequence opt5 from anti-HIV_059-182199_VR-Chain
cagagcgugcugacccaacccccuuccgucucugccgcuccgggccagaacaucacaauuagcugcuccgggucuagcuccaauaucggaucucacagcauuuccugguaccagcaucuccccggcacggccccuaagaucguuauuuaugacaacgauaaaagaccccuggggaucccugaccgguucagcggaucuaaguccggcaccagcgcgacacuugggaucaccggacugcagacaggcgaugaggcugacuacuauuguggcaccugggauacaucucucuccgggggaggcguguuugggcccggaaccaaagugacgguccug

SEQ ID NO: 40748 - RNA, 324 nt, Artificial Sequence
  derived and/or modified sequence opt5 from anti-HIV_059-169202_VR-Chain
cacagcgugcugacccagcccccuuccgucucugccgcuccgggccaaaagguuacaaucagcugcuccgggucuagcuccaaaauuggaaacaauuucgugucuugguaccagcagcuccccggcacggccccuaagcugcuuaucuaugagaacaauaaaagacccagcgggauuccugaccgguuuuccggaagcaagucuggcaccuccgcgacacuggcuaucaccgggcuccagacaggagaugaagccgacuacuauuguggcaccugggauggccgcgugagcgucauugggucuggaacaaaacugaccgugcuu

SEQ ID NO: 40749 - RNA, 324 nt, Artificial Sequence
  derived and/or modified sequence opt5 from anti-HIV_059-155645_VR-Chain
cagagcgcccugacccaacccgcuuccgugucuggcagcccugggcaguccaucacaauuucuugcacgggaaccagcuccgacgucggcuacaacuauguuucuugguaccagcagcucccggggacagcccccaagcugcuuaucuaugagaauaacaaaagaccuagcggcauucccgaucgguucuccggaagcaagucugggaccuccgcgacacuggcuaucaccggacuccaaacaggcgacgaagccgauuacuauuguggcaccugggacgggcgccugagcgugauuggaacgggcaccaaagugacaguccuu

SEQ ID NO: 40750 - RNA, 333 nt, Artificial Sequence
  derived and/or modified sequence opt5 from anti-HIV_059-151619_VR-Chain
cagagcgugcugacccaacccccuuccgucucugccgcuccgggccagaagguuacaaucagcugcuccgggucuagcuccaacauuggaaauaacuucgugucuugguaccagcuccugcccggcacgccucccaaacuucugaucuuuaagaauaacgagagaccuagcgggauucccgaccgguucuccggaagcaaaucuggcaccuccgccacacucgggaucaccggacugcagacaggcgaugaaggcgacuauuacugugggaccugggauacaagccuuucuggaggcgggguguuuggaaccggcacgcgcgucaccgugcug

SEQ ID NO: 40751 - RNA, 333 nt, Artificial Sequence
  derived and/or modified sequence opt5 from anti-HIV_059-146503_VR-Chain
cagagcgugcugacccaacccccuuccgucucugccacaccgggccagaagguuacgaucagcugcuccgggucugcuagcaacauuggaaauaacuacguguccugguaucagcaguuccccggcaccgccccuaaacuccugaucuacgacacaaauaagagacccucugggauuccugaucgguuuagcggauccaaaagcggcaccucugcgauccuugggauuacaggacugcaaaucggcgacgaggcugauuauuacuguggcaccugggacacaucccucagcgggggaggcguguucgggaccggaacgaaggucaccgugcug

SEQ ID NO: 40752 - RNA, 324 nt, Artificial Sequence
  derived and/or modified sequence opt5 from anti-HIV_059-136098_VR-Chain
cagagcgugcugacccaacccccuuccgucucugccgcuccgggccagagaguuacaaucagcugcuccgggucuagcuccaacauuggaaauaacuacgugucuugguaucagcagcuccccggcacggccccuaagcugcuuaucuacgagaauaaccggcgccccagcgggauuccugacagauucuccggaagcaaaucuggcaccuccgcgacacuggcuaucaccgggcuccaaacaggagaugaaggcgacuauuacugugcccggugggauggccgccugagcgugauugggucuggaaccaaggucacagugcuu

SEQ ID NO: 40753 - RNA, 333 nt, Artificial Sequence
  derived and/or modified sequence opt5 from anti-HIV_059-105516_VR-Chain
cagagcgcccugacccaacccccuuccgugucugcugccccgggccagaaggucacaaucagcugcuccgggucuagcuccaacauuggaaauaacuacguuucuugguaucagcagcuccccggcacggcgccuaaacugcuuaucuacgacaauaacaagagacccagcgggauuccugaucgguucuccggaagcaaaucuggcaccuccgcuacacuggccaucgccgggcuccaaaccggagacgaggcuaauuauuacuguggcacaugggauggcagccugcgcaccgggggaguguuuggcacagggaccaaggugacgguccuu

SEQ ID NO: 40754 - RNA, 333 nt, Artificial Sequence
  derived and/or modified sequence opt5 from anti-HIV_059-095709_VR-Chain
cagagcgugcugacccaacccccuuccgucucugccgcuccgggccagaagguuacaaucagcugcuccgggagaucuagcaacauuggaaauaacuucguguccugguaccagcuccugcccggcacggccccuaaacuucugaucuauaagaauaacgagcggcccucugggauuccugaccgcuuuagcgcguccaaaagcggaaccucugcuacacucggcaucaccgggcugcagacaggagaugaagccgacuacuauuguggcaccugggauacaucccuuagcggcgggggaguguucggcaccgggacgaaggucaccgugcug

SEQ ID NO: 40755 - RNA, 333 nt, Artificial Sequence
  derived and/or modified sequence opt5 from anti-HIV_059-069468_VR-Chain
cagagcgugcugacccaacccccuuccgucucuggcgccccgagacagagcguuaucauuuccugcacagggucuagcuccaacaucggaggcuucgacgugcacugguaccagcagcuccccgggacggcuccuaagcugcuuauuuaugagaauaaccggcgccccucuggaaccccugauagauuuagcggcuccaaaagcgggacaucugccacccuggcgaucacaggacuccaaaccggcgacgaagcugauuacuauuguggcacaugggacgggucccugagcaccggaggcgugauugggacgggaaccaaggucacagugcuu

SEQ ID NO: 40756 - RNA, 333 nt, Artificial Sequence
  derived and/or modified sequence opt5 from anti-HIV_059-060026_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggugccuaaacugcuuaucuacaagaaugacaaaagacccagcgggauuccugaucgguucuccggaagcaagucugccaccuccgcgacacugggcaucaccgggcuccaaacaggagacgaggcugauuauuacuguggcauuugggacaccagccugucugccggcggggucuuuggaacaggcacccgcgugacgguucuu

SEQ ID NO: 40757 - RNA, 333 nt, Artificial Sequence
  derived and/or modified sequence opt5 from anti-HIV_059-053668_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagaagcuccgggauucccgaccgguucagcggaucuaaauccggcaccagcgcgacacuggcuaucaccgggcuccaaacaggagaugaagccgacuauuacuguggcacccgcgauucuucccugagcggcgggggagugauuggcacagggaccaaggucacggugcuu

SEQ ID NO: 40758 - RNA, 333 nt, Artificial Sequence
  derived and/or modified sequence opt5 from anti-HIV_059-052864_VR-Chain
cagagcgugcugacccaacccccuucccucucugccgcuccgggccagagagucacaaucagcugcuccgggucuagcuccaacauuggaaauaacuacguuucuugguaucagcagcugcccggcacggccccuaaacuucugaucuacgagagcaauaagcggcccuccgggaccccugaccgcuucagcggaucuaaguccggcacaagcgcgacccucgcuauuacagggcugcaaaccggagaugaagccgacuauuacuguggcacaugggaugccucucuuuccagcggcggggugaugggaaccggcacgaaagugaccguccug

SEQ ID NO: 40759 - RNA, 333 nt, Artificial Sequence
  derived and/or modified sequence opt5 from anti-HIV_059-050968_VR-Chain
cagagcgugcugacccaagcccccuccgucucugcugccccuggcgagaagguuacaaucagcugcuccgggacgucuagcaacauuggauacuauuacguguccugguaucagcaguucccgggcaccgcgcccaaaguggucaucuacgaaaauaacagacggccuucugggacacccgaccgcuuuagcggauccaagagcggcaccucugcuacacucgccauuaccgggcugcagacaggagaugaggccgacuauuacuguggcaccuggggcgggucccuuagcacgggaggcgugaucgggaccggaacaaaaguuaccgugcug

SEQ ID NO: 40760 - RNA, 333 nt, Artificial Sequence
  derived and/or modified sequence opt5 from anti-HIV_059-046422_VR-Chain
cagagcgugcugacccaacccccuuccgucucugccgcuccgggccagaagguuacaaucagcugcuccgggucuagcuccacgauuggaaacaauuacaucucuugguaucagcuccugcccggcaccccucccaacuaccuuauuuucaaaaucagcgagagaccuuccggggugcccgaccgguuuagcggaucuaaguccggcacaagcgccacccugcacauuacagggcuccagaccggagaugaaggcgacuauuacuguggcacaugggauaccucucuguccgggggaggcguguucgggacgggaaccaaagucacagugcuu

SEQ ID NO: 40761 - RNA, 333 nt, Artificial Sequence
  derived and/or modified sequence opt5 from anti-HIV_059-045120_VR-Chain
cagagcgugcugacccaacccccuuccgucucugccgcuccgggccagaagguugccaucagcugcuccgggucuagcuccacaauuggaaacaauuacgugucuugguaucagcuccugcccggcacgccucccaaacuucugaucuucaagagccacgagagaccuuccgggauucccgaccgguuuagcggaucuaaauccggcaccagcgcgacacucgggaucaccggacugcagacaggcgaugaaggcgacuacuauugugggaccugggauucuucccuuagcgugggaggcgucuucgggacaggaaccaaggugacgguucug

SEQ ID NO: 40762 - RNA, 333 nt, Artificial Sequence
  derived and/or modified sequence opt5 from anti-HIV_059-039932_VR-Chain
cagagcgugcugacccaacccccuuccgucucugccgcuccgggccagaagguuacaaucagcugcuccgggucuagcuccauuaucggcaaaaacuacgugucuugguaucagcaccuccccggaacggccccuaagcugcuuauuuacgagaauaacaaaagacccagcgggaucccugaccgguucuccggaagcaagucuggcaccuccgcgacacuggcuauugccgggcuccagaccggagaugaagccaauuauuacuguggcacauggggcgggagccugucuaccggaggcguguuugggacaggaaccaaagucacggugcuu

SEQ ID NO: 40763 - RNA, 333 nt, Artificial Sequence
  derived and/or modified sequence opt5 from anti-HIV_059-038595_VR-Chain
cagagcgugcugacccaacccccuuccgucucugccgcuccgggccagaagguuacaaucagcugcuccgggagaucuagcaacauuggaaauaacuucguguccugguaccagcagcuccccggcacggccccuaaacugcuuaucuaugagaauaacaagcggcccucugggauuccugaccgcuuuagcggauccaaaagcggcaccucugcgacacuggggaucaccggacuccaaacaggcgaugaagcugacuacuauuguggcaccugggauacaucccugagcgccgggggaguguucggcucugggaccaaggucauugugcuu

SEQ ID NO: 40764 - RNA, 333 nt, Artificial Sequence
  derived and/or modified sequence opt5 from anti-HIV_059-035082_VR-Chain
cagagcgugcugacccaacccccuuccgucucugccgcuccgggccagaagguuacaaucagcugcuccgggucuacgagcaacauuggaaaauccuucgugucuugguaccagcagcuccccggcaccgccccuaagcugcuuaucuaugacaauaacagacggcccagcgggacaccugaucgcuuuuccggaagcaaaucuggcaccuccgcgacacuggcuauuaccgggcuccaaacaggagacgaggccgauuacuauuguggcaccuggggcgggagccugucuacgggaggcgugaucgggaccggaacaaaggucaccgugcuu

SEQ ID NO: 40765 - RNA, 333 nt, Artificial Sequence
  derived and/or modified sequence opt5 from anti-HIV_059-029204_VR-Chain
cagagcgugcugacccaacccccuuccgucucugccgcuccgggccagaagguuacaaucagcugcuccgggucuacgagcaacauuggaaaaauccucguguccugguaccagcagcugcccggcaccgccccuaagcccucuauuuaugacaauaacagacggccuagcgggacacccgaucgcuucuccggaagcaaaucuggcaccuccgcgacacuugcuaucaccgggcugcaaacaggagacgaggccgauuacuauuguggcaccugggacggcagccucucuaccgggggagugauuggcacggggacaaaggucaccgugccu

SEQ ID NO: 40766 - RNA, 324 nt, Artificial Sequence
  derived and/or modified sequence opt5 from anti-HIV_059-025235_VR-Chain
cagagcgugcugacccaacccccuuccgucucuggcgccccggggcagaagaucacaauuagcugcuccggaucuacgagcaacaucggcaaauccuacguuucuugguaucagcagcuccccgggaccgcuccuaagcugcuuauuuacgagaauaacagacggcccagcggaacaccugaccgcuucuccggcagcaaaucugggaccuccgccacacuggcgaucaccggacuccaaacaggcgaugaagcugacuauuacuguggcaccugggaugggagcggaggcgugauugggacgggaaccaaggugacaguccug

SEQ ID NO: 40767 - RNA, 333 nt, Artificial Sequence
  derived and/or modified sequence opt5 from anti-HIV_059-015192_VR-Chain
cagagcgugcugacccaacccccuuccgucucugccgcuccgggccagaagguuacaaucagcugcuccgggucuagcuccacgauuggagacaaauacgugucuugguaucagcuccugcccggcaccgccccuaaacuucugaucuacaagaacaauaagagacccagcgggauuccugaucgguucuccggaagcaaaucuggcacauccgcgacccucgggaucacaggacugcagaccggcgacgaggcugauuauuacuguggcacaugggacaccagccuuucugucgggggaguguuuggcacggggaccaaggugacaguucug

SEQ ID NO: 40768 - RNA, 333 nt, Artificial Sequence
  derived and/or modified sequence opt5 from anti-HIV_059-007060_VR-Chain
cagagcgugcugacccaacccccuuccgucucugccgcuccgggccagaagguuacaaucagcugcuccgggucuagcuccaacauuggaaauaaauacgugucuugguaucagcagcuccccggcacggccccuaagcugcuuaucuacgagaacaaaaagagacccagcgggauuccugaccgguucuccggaagcaaaucuggcaccuccgcgacacuggggaucaccggacuccaaacaggcgaugaagcugacuauuuuuguggcaccugggauacaagccugucugggggaggcguguucggguccggaaccaaggucacggugcuu

SEQ ID NO: 40769 - RNA, 324 nt, Artificial Sequence
  derived and/or modified sequence opt5 from anti-HIV_059-006953_VR-Chain
cagagcgugcugacccaacccccuuccgucucugccgcuccgggccagaagguuacaaucagcugcuccgggucuagcuccaacauuggagugucuugguaccaacaggugcccggcacggccccuaaacuccugaucuaugacaaugauaagagacccaccgggauuccugaccgguucagcggauccaaaagcggcacaucugcgauccuugcuauuaccgggcugcagacaggagaugagggcgacuacuauuguggcaccugggaaacaucccucagcgggggaggcgucuuugggaccggaacgaaggugaccguucug

SEQ ID NO: 40770 - RNA, 333 nt, Artificial Sequence
  derived and/or modified sequence opt5 from anti-HIV_059-005953_VR-Chain
cacagcgugcugacccagcccccuuccgucucugccgcuccgggccaaaagguuacaaucagcugcuccgggacgucuagcaacauuggcaaaaauuacguguccugguaucagcagcuccccggaaccgccccuaagcugcuuaucuacgagaacaauagacggcccucugggacaccugaccgcuucagcggauccaaaagcggcaccucugcgacacuggcuauuaccgggcuccagacaggagaugaagccgacuauuacuguggcaccugggauacgucccugagcaccggcgggguguuuggaacaggcaccaaggucacagugcuu

SEQ ID NO: 40771 - RNA, 324 nt, Artificial Sequence
  derived and/or modified sequence opt5 from anti-HIV_059-003725_VR-Chain
cagagcgugcugacccaacccccuuccgucucugccgcuccgggccagaagcucacaaucagcugcuccgggucuacgagcaaaauuggaaacaauuacguuuccugguaucagcaccuucccggcaccgccccuaagcugcugguguacgagaacaauaaaagacccucugggaucccugaccgguucagcggauccaagagcggcacaucugcgacccucgcuauuacagggcugcagaccggagaugaagccgacuauuacuguggcacaugggauggccgccuuuccgugaucgggaccggaacgaaagucaccgugcug

SEQ ID NO: 40772 - RNA, 333 nt, Artificial Sequence
  derived and/or modified sequence opt5 from anti-HIV_059-002618_VR-Chain
cagcuggugcucacccaacccccuagcgucuccgccgcuccgggccagaagguuacaaucucuugcagcggguccucuagcaacauuggaaauaacuucguguccugguaccagcagcugcccggcacggccccuaaacuucugaucuaugagaauaacaagagacccucugggauuccugaccgguuuagcggauccaaaagcggcaccucugcgacacucgggaucaccggacugcaaacaggcgaugaagcugacuacuauuguggcaccugggauacacgccuuuccgccgggggaguguucggcaccgggacgaaggucaccgugcug

SEQ ID NO: 40773 - RNA, 324 nt, Artificial Sequence
  derived and/or modified sequence opt5 from anti-HIV_059-001522_VR-Chain
cagagcgugcugacccaacccccuuccgucucugccgcuccgggccagaagguuacaaucagcugcuccgggucuaacagcaauauuggaaacaauuacguguccugguaucagcagcuccccggcacggccccuaaacugcuuaucuacgagaacaauaagagacccucugggauuccugaccgguucagcggauccaaaagcggcaccucugcgacacuggcuaucaccgggcuccaaacaggagaugaagccgacuauuacuguggcaccugggauggccgccuguccgugauuggggccggaacaaaggucaucgugguu

SEQ ID NO: 40774 - RNA, 333 nt, Artificial Sequence
  derived and/or modified sequence opt5 from anti-HIV_059-000731_VR-Chain
cagagcgugcugacccaacccccuuccgucucugccgcuccgggccagaagguuacaaucagcugcuccgggucuacgagcaacauuggaaauaaauacguguccugguaucaacaggugcccggcaccgccccuaagcuccugaucuacgagaacaauagacggcccucugggauuccugaccgcuucagcggauccaaaagcggcacaucugcgacccuugcuaucacagggcugcagaccggagaugaagccgacuauuacuguggcacaugggaugccucccucagaaccggcggggucauuggaacgggcaccaaggugacaguucug

SEQ ID NO: 40775 - RNA, 333 nt, Artificial Sequence
  derived and/or modified sequence opt5 from anti-HIV_059-000634_VR-Chain
cagagcgugcugacccaacccccuuccgucucugccgcuccgggccagaagguuacaaucagcugcuccgggucuagcuccacgauuggaaacaauuacgugucuugguaucaggugguccccggcaccgccccuaaacuccugaucuacaagauuaacgagagacccagcgggaucccugaccgguucuccggaagcaaaucuggcacauccgcgacccuugggauuacaggacugcagaccggcgaugaagcugacuauuacuguggcacaugggauaccagccucucugggggaggcguguuugggcccggaacgaagguuaccgugcug

SEQ ID NO: 40776 - RNA, 333 nt, Artificial Sequence
  derived and/or modified sequence opt5 from anti-HIV_048-250757_VR-Chain
cagagcgugcugacccaacccccuuccgucucuggcgccccggggcagagaguuacaaucagcugcacgggaaccacauccaacauuggcucuaauuacguggcuugguaucagcagcuccccgggaccgccccuaagcugcuuaucuacgacaacgauaaacggcccagcggcauuccugaccgcuucuccggaucuaagagcgggacauccgcgacccugggaaucacaggccuccaaaccggcgaugaggcugacuauuacugugggacgugggauaccagccugucugccggaggcguguuugggacaggaaccaaagucacagugcuu

SEQ ID NO: 40777 - RNA, 333 nt, Artificial Sequence
  derived and/or modified sequence opt5 from anti-HIV_048-250716_VR-Chain
cagagcgugcugacccaacccccuuccgucucugccgcuccgggccagaagguuacaaucagcugcuccgggucuagcuccaacauuggaaauaaauacgugucuugguaucagcagcuccccggcacggccccuaagcugcuuaucuacgagaacagcaaaagacccuccgggauuccugaccgguucagcggaucuaaguccggcaccagcgcgacacuggggaucaccggacuccaaacaggcggccaggcugauuauuacugugggaccugggacacaucucuguccgccggaggcguguuugggagcggaaccaaagucacggugcuu

SEQ ID NO: 40778 - RNA, 333 nt, Artificial Sequence
  derived and/or modified sequence opt5 from anti-HIV_048-250463_VR-Chain
cagagcgugcugacccaacccccuuccgucucugccgcuccgggccagaagguuacaaucagcugcuccgggucuagaagcaacaauggaaacaauuacguguccugguaucagcagcuccccggcacggccccuaagcugcuuauuuacgagaacaauaagcggcccucugggaucccugaccgcuucagcggauccaaaagcggcaccucugcgacacuggcuauuaccgggcuccaaacaggagaugaagccgacuauuacuguggcaccugggauuccagccugucuggcgggggagugaucggcacagggaccaaacuuacgguccug

SEQ ID NO: 40779 - RNA, 333 nt, Artificial Sequence
  derived and/or modified sequence opt5 from anti-HIV_048-248153_VR-Chain
cagagcgcccugacccaacccgcuuccgugucugccagcuucggccaguccaucacaauuucuugcacgggggcggcuagcgacgucggauacaacuauguuuccugguaccagcagcucccuggcaccacaccgaagcugcuuaucuauagaaauaaccaacggcccucugggauuccugaucgcuuuagcggauccaaaagcggcaccucugccacacuggggaucaccggacuccagacaggcgacgaggccgauuacuauuguggcaccugggacacgucccugagcgcugggggaguguucggcaccgggacaaaggugaccguccuu

SEQ ID NO: 40780 - RNA, 333 nt, Artificial Sequence
  derived and/or modified sequence opt5 from anti-HIV_048-247532_VR-Chain
cagagcgugcugacccaacccccuuccgucucugccgcuccgggccagcagguuacaaucagcugcuccgggacgaccucuaacauuggaacaaauuacgugagcugguaucagcaaaugcccccugccgcgcccaagcuccugaucuacgacaacaaaaagagaccuuccgauauucccgaccgguucucuggcagcaaauccgggaccagcgcuacacuuggaaucaccggccugcagacaggggaugaggccgacuauuacuguggaaccugggauacgucucucuccgccggcggcguguuugggaccggaacaaaggucaccgugcug

SEQ ID NO: 40781 - RNA, 333 nt, Artificial Sequence
  derived and/or modified sequence opt5 from anti-HIV_048-245846_VR-Chain
cagagcgugcugacccaacccccuuccgucucugccacaccgggccagagaguuacgaucagcugcaccggguccucuagcaacauuggaggcuacgacguguccugguaucaggugcuccccgggacagcuccuaagcugcuuaucuacgauucugacaaacggcccagcggcauuccugaucgcuucuccggaagccagucugggaccuccgccacacugggaaucaccggccuccaaacaggcgacgaggcggauuauuacugugggaccugggacacgagccugucuggaggcggggucuuuggaaccggcacaaaggugaccguucuu

SEQ ID NO: 40782 - RNA, 333 nt, Artificial Sequence
  derived and/or modified sequence opt5 from anti-HIV_048-244016_VR-Chain
cagagcgugcugacccaacccccuuccgucucuggcgccccggggcagagaguuacaaucagcugcacgggauccucuagcaacauuggcggguacgacgugcacugguaucagcagcuccccggaaccgcuccuaagcugcuuaucuacaaaaaugauaagcggcccuccggcauuccugaccgcuucucugggagcaaauccggaacaagcgccauccugggcauuaccggccuccaaacaggggaugaggcggacuauuacuguggagcuugggauaccucucuguccgccggcgggguguuuggaacaggcaccaaggucacggugcuu

SEQ ID NO: 40783 - RNA, 333 nt, Artificial Sequence
  derived and/or modified sequence opt5 from anti-HIV_048-243682_VR-Chain
cagagccugcucacccaacccccuuccgugucugccgcuccgggccagaaggucacaaucagcugcacgggguccucuagcaacauuggaggcuacgacguucacugguaucagcagcugcccgggaccgccccuaaacuucugaucuacgagaauaacaagagacccuccggcauuccugaucgguucucuggaagcaaauccgggacaagcgcgacccucggaaucacaggccugcaaaccggcgacgaagcugauuauuacugugggacaugggacucuucccuuagcgccggaggcguguuugggaccggaacgaaggugaccguccug

SEQ ID NO: 40784 - RNA, 333 nt, Artificial Sequence
  derived and/or modified sequence opt5 from anti-HIV_048-243588_VR-Chain
cagagccugcucacccaacccccuuccgugucugccccgcccggccagauggucagcaucuccugcucugggagcucccacaacauuggagacaauuacguuucuugguaucagcaucugccuggcacagcucccaaacuucugaucuacgauaacaauagcagaccuuccgggauucccgaccgguucagcggaucuaaguccggcacgagcgccacccucgggaucacaggacugcagaccggcgaugaggcggacuauuacuguggcacaugggauaccucucuuuccgggggaggcguguuugggacaggaaccaaggugacgguccug

SEQ ID NO: 40785 - RNA, 333 nt, Artificial Sequence
  derived and/or modified sequence opt5 from anti-HIV_048-241775_VR-Chain
cagagcgugcuggcccaacccccuuccgucucuggcgcuccggggcagagaguuaccaucagcugcacaggauccucuagcaacauuggcgaguacgacgugcacugguaucagcagcuccccgggacggccccuaagcugcuuaucuacgaaaauaacaaacggcccuccggcauuccugaucgcuucucuggaagcaaguccgggaccagcgcgacacugggaaucaccggccuccaaacaggcgacgaggcugauuauuacugugggaccugggacucuucccugagcgccggaggcguguuugggacaggaaccaaagucacggugcuu

SEQ ID NO: 40786 - RNA, 333 nt, Artificial Sequence
  derived and/or modified sequence opt5 from anti-HIV_048-237996_VR-Chain
cagagcgugcugacccaacccccuuccgucucuggcgccccggggcagagaguuacaaucagcugcacgggauccucuagcaacauuggcggguacgacgugcacugguaucggcagcuccccggaaccgcuccuaagcugcuuaucuacgauacagugaaacgccccuccggcauuccugacagauucucugggagcaaguccggaaccagcgccacacugggcaucaccggccuccagacaggggaugaggcggacuauuacuguggaaccugggauacgucucuguccgcuggcggggucuuuggaaccggcacaaaagugaccguucuu

SEQ ID NO: 40787 - RNA, 330 nt, Artificial Sequence
  derived and/or modified sequence opt5 from anti-HIV_048-237730_VR-Chain
agcgugcugacccagcccccuuccgucucuggcgccccggggcagagaguuacaaucagcugcacgggaaccaacuccaauuucggcucuaacuacgcucacugguaucaacaggugcccgggacagccccuaagcuccugauuuacagcaauaacgcgcggcccuccggaaucccugaccgcuuuucuggcagcaaauccgggaccagcgcuacacuuggaauuaccggccugcagacaggcgaugaggccgacuauuacugugggaccugggauacgucucucuccgccggaggcguguucgggaccggaacaaaggucaccgugcug

SEQ ID NO: 40788 - RNA, 333 nt, Artificial Sequence
  derived and/or modified sequence opt5 from anti-HIV_048-237253_VR-Chain
cagagcgugcugacccaacccccuuccgucucugccgcuccgggccagaagguuacagugagcugcuccgggucuagcuccaacaucggaucuaaugacgugagcugguaccagcaguuccccggcgccgcgccuaaacuccugauuuauaagaacaaugagagacccuccgggaucccugaucgguuuagcggaucuaaauccggcacgagcgcuacccuugggauuacaggacugcaaaccggcgacgaagccgauuacuauuguggcacaugggacaccucucucuccgccgggggagucuucggcacagggaccaaggugacgguucug

SEQ ID NO: 40789 - RNA, 333 nt, Artificial Sequence
  derived and/or modified sequence opt5 from anti-HIV_048-234100_VR-Chain
cagagcaugcugacccagcccccuuccgugucugccgcuccgggcgagaaggucacaaucagcugcuccgggucuagcuccaacauuggaaaaacguucguuucuugguaccaacaggugcccggcaccgccccuaagcuccugaucuauaaaaaugacaacagacccagcgggauuccugaucgguuuuccggaagcaagucuggcacauccgcgacccuugggaucagcggacugcagacaggcgacgaagcugauuacuauuguggcaccugggacacaucucucuccgggggaggcguguucgggaccggaacgaaagucaccgugcug

SEQ ID NO: 40790 - RNA, 333 nt, Artificial Sequence
  derived and/or modified sequence opt5 from anti-HIV_048-230882_VR-Chain
cagagcgugcugacccaacccccuuccgucucugccgcuccgggccagaagguuacaaucagcugcuccgggaacucuagcaauauuggauccaacuucgugucuugguaccagcagcuccccggcacggccccuaaacugcuuaucuaugagaauaacaagagacccagcgggauuccugaccgguuuuccggaagcaaaucuggcaccuccgcgacacuggggaucaccggacuccaaacaggcgaugaagcugacuacuauuguggcaccugggauacaagccugucucccgggggaguguucggcaccgggacgaaggucaccgugcuu

SEQ ID NO: 40791 - RNA, 333 nt, Artificial Sequence
  derived and/or modified sequence opt5 from anti-HIV_048-229473_VR-Chain
cagagcgugcugacccaacccccuuccgucucugccgcuccgggccagaagguuacaaucagcugcuccgggucuagcuccaacauuggaaauaacuacgugucuugguaucagcaguuccccggcacggccccuaaacuccugaucuacgagaauaacaagagacccagcgggauuccugaccgguuuuccggaagcaaaucuggcaccacagcgacccuugcuaucacacgccugcaaaccggggaugaagccgacuauuacuguggaacauggggcggcucccucagcgccgggggaguguucggcaccgggacgaaggucaccgugcug

SEQ ID NO: 40792 - RNA, 333 nt, Artificial Sequence
  derived and/or modified sequence opt5 from anti-HIV_048-228238_VR-Chain
cagagcgugcugacccaacccccuuccgucucugccgcuccgggccagaagguuacaaucagcugcuccgggucuagcuccaacauuggaaucaauuacgugucuugguaucagcagcuccccggcacggccccuaaacugcuuauuuacgacaacaccaagagaccccaagggaucccugaucgguucagcggauccaaaagcggcacaucugcgacccuggcuauuacagggcuccagaccggagacgaggccgauuauuacuguggcacaugggacggcucccugagcaccgggggagugaucggcacggggaccaaggucacagugcuu

SEQ ID NO: 40793 - RNA, 333 nt, Artificial Sequence
  derived and/or modified sequence opt5 from anti-HIV_048-228027_VR-Chain
cagagccugcucacccaaucccccucugccagcggcccuccggggcagagagugacaaucuccugcucuggaagcaacuccaauauuggcucuaacacggucaauugguaccaccaucugcccggggcugccccuaaacuucugaucuaugagaacagcaagcggcccuccggcauuccugaccgcuucagcggaucuaaguccgggaccagcgcgacacucggaaucaccggccugcagacaggcgaugaagcugacuacuauugugggaccugggauacaucucuuuccgccggaggcguuuuugggagcggaaccaaagugacggugcug

SEQ ID NO: 40794 - RNA, 333 nt, Artificial Sequence
  derived and/or modified sequence opt5 from anti-HIV_048-227795_VR-Chain
cagagcgugcugacccaacccccuuccgucucugccgcuccgggccagaagguuacaaucagcugcuccgggucuagcuccaacauugagucuagaagcgugcacugguaccagcagaaacccggacaagccccugugcucgucaucuauuacgacuccgaucggcccagcggcauuccugaccgcuucucuggguccaagagcggaacggcggcuacccugggcaucacagggcuucagaccggagaugaagccgacuauuacuguggcacaugggauaccucucuguccgccggcgggguguuuggaacaggcaccaaaguuacggugcuc

SEQ ID NO: 40795 - RNA, 333 nt, Artificial Sequence
  derived and/or modified sequence opt5 from anti-HIV_048-227770_VR-Chain
cagagcgugcugacccaacccccuuccgucucuggcgccccggggcagagaguuacaaucagcugcacgggauccucuagcaacauuggcccccgggacgugcacugguaccagcagcucccugggaccgugcccaagcugcuuaucuaugauacauacacccgcccuuccggcauucccgacagauucucuggaagcaaauccggggcuagcgccacacuggauaucaccggacuccaaacaggcgacgaggcggauuauuacuguggcauuugggacaccucucuguccgcugggggagucuuuggcacggggaccaaggugacaguucuu

SEQ ID NO: 40796 - RNA, 333 nt, Artificial Sequence
  derived and/or modified sequence opt5 from anti-HIV_048-225298_VR-Chain
cagagcgcccugacccaacccagauccgugucuggcagcccugggcaguccgucacaaucucuugcacgggaaccagcaacgacguuggcuacgauuauguguccugguaccagcagcucccggggacagcucccaagcugcuuauuuaugacaucaauaaacggccuucuggcauucccgaucgcuucagcggauccaagagcgggaccucugccacacugggaaucaccggccuccaaacaggcgacgaggcggauuacuauugugggaccugggacacgucccugagcgcuggaggcguguuugggaccggaacaaaagucaccgugcuu

SEQ ID NO: 40797 - RNA, 327 nt, Artificial Sequence
  derived and/or modified sequence opt5 from anti-HIV_048-225090_VR-Chain
gagcugacccagcccccuagcguguccggcgccccggggcaaagagucacaaucucuugcacgggaagcuccucuaacauuggcggguacgacguucacugguaucagcagcuccccggaaccgcuccuaagcugcuuaucuacgauaauaacaaacggcccagcggcauuccugaccgcuucuccgggucuaagagcggaacauccgccacccugggcaucacaggccuccagaccggggaugaagcggacuauuacuguggaacaugggauaccagccugucuacgggcgggguguuuggaaccggcacaaaagugaccguccuu

SEQ ID NO: 40798 - RNA, 333 nt, Artificial Sequence
  derived and/or modified sequence opt5 from anti-HIV_048-224187_VR-Chain
cagagcgugcugacccaacccccuuccgccucuggcacaccggggcagagagucacgaucagcugcuccggaucuagcgcuaacauuggcaccaauuacguuuucugguaucagcaccuccccgggacaaccccucggcugcuuaucuuucgcaacaaugagagacccuccggcauuccugaccgguucucuggaagcaaguccgggacaagcgccacccugggaaucacaggccuccagaccggcgaugaagcggacuacuauugugggacgugggauaccucucuguccgcuggaggcguguuugggacaggaaccaaagugacaguccuu

SEQ ID NO: 40799 - RNA, 333 nt, Artificial Sequence
  derived and/or modified sequence opt5 from anti-HIV_048-223055_VR-Chain
cagagcgugcugacccaacccccuuccgucucugccgcuccgggccagaagguuacaaucagcugcuccgggucuagcuccaacauuggaaauaacuacgugucuugguaucagcaguuccccggcacggccccuaaagugcucaucuacgggaauagcaagagacccuccggcauuccugaccgguuuagcggaucuaaauccgggaccagcgcgacacugggaaucaccggccuucaaacaggcgaugaggcugacuauuacugugggaccugggauacaucucuguccgccggaggcgucuucgggagcggaaccaaggugacgguucuc

SEQ ID NO: 40800 - RNA, 333 nt, Artificial Sequence
  derived and/or modified sequence opt5 from anti-HIV_048-222711_VR-Chain
cagcccgugcugacccaaccuccgagcgucuccggcgcccccgggcagagaguuacaaucucuugcacgggaagcuccucuaacauuggcggguacgacgugcacugguaucaacaggugccuggaaccgcucccaagcuccugaucuucgagaauaaccggcgcccuagcggcauucccgauagauuuuccgggucuaaaagcggaacauccgccacccuugcgaucacaggccugcagaccggcgacgaagcugauuacuauugugggacaugggacggaagccucucuaccggcggggucauuggaacgggcaccaaggugacaguucug

SEQ ID NO: 40801 - RNA, 333 nt, Artificial Sequence
  derived and/or modified sequence opt5 from anti-HIV_048-221209_VR-Chain
cagagcgugcugacccaacccccuuccgucucuggcgccccggggcagagaguuacaaucagcugcacgggaaacuccucuaauauuggcgacuacgaugugcacugguaucaacagguggcugggaccgcccccaagcuccugaucuucaaaaacaaugagcggccuagcggcauucccgaccgcuuuuccggaucuaagagcgggacauccgcgacccuuggaaucacaggccugcagaccggcgaugaagcugacuacuauugugggacaugggauaccagccucucugccggaggcgucuucggguccggaacgaaagugaccguucug

SEQ ID NO: 40802 - RNA, 333 nt, Artificial Sequence
  derived and/or modified sequence opt5 from anti-HIV_048-220629_VR-Chain
cagagcgcccugacccaacccgcuuccgugucuggcagccucgggcaguccaucacaauuucuugcacgggaaccagcagagacgucggcuacuccuauguuucuugguaccagcaccuuccugggacagccccgaagcugcugaucuaugagaacaauaaacggcccagcggcauuccugaucgcuucuccggaagcaagucugggaccuccgcgacacucggaaucaccggccugcagacaggcgacgaagcugauuacuauugugggaccugggacagcucucuuuccgccggaggcguguuugggacgggaaccaaagugacaguccug

SEQ ID NO: 40803 - RNA, 333 nt, Artificial Sequence
  derived and/or modified sequence opt5 from anti-HIV_048-219430_VR-Chain
cagagcgugcugacccaacccccuuccgucucugccgcuccgggccagaugguuacaaucagcugcuccgggucuacgagcaacauuggaaucaauuacguguccugguaucagcacgugcccggcaccgccccuaagcuccugauuuacgacaacaauaaaagacccucugggaucccugaucgguucagcggauccaagagcggcacaucugcgacccuugggauuacaggacugcauaccggcgacgaggcugauuauuacuguggcacaugggacaccucccucagcgccgggggagucuuuggcacggggaccaaagugacaguucug

SEQ ID NO: 40804 - RNA, 333 nt, Artificial Sequence
  derived and/or modified sequence opt5 from anti-HIV_048-216250_VR-Chain
cagagcgugcugacccaacccccuuccgucucugccgcuccgggccagaagguuacaaucagcugcacggggaccacauccgacuucggauacaacugugugucuugguaucagcagcaccccggcagagccccuaaagugauuaucagcggggucaauaagcggcccuccggcauuccugaucgcuuuucuggaagcaaauccgggaccagcgcgacacucggaaucaccggccugcaaacaggcgacgaggcugauuacuauugcgggaccugggacucuucccuuagcgccggaggcguguucgggacgggaaccaagguuacagugcug

SEQ ID NO: 40805 - RNA, 321 nt, Artificial Sequence
  derived and/or modified sequence opt5 from anti-HIV_048-216133_VR-Chain
acccagcccccuagccuguccgccacaccgggccaaagagugucuaucagcugcuccgggggaggcucuaacauugggaauaacgacgucuucugguuucagcaguuccccggagcuggcccucggcuccugaucuacgauaaucacaagcgccauuaugggacgcccgacagauuuagcggauccaaaucuggcaccagcgccacacuugcgauuaccggccugcagacaggggaugaggcugccuacuauuguggaaccugggacggcucccucagcacagggggaguuaucggcaccgggacgaaggugaccgugcug

SEQ ID NO: 40806 - RNA, 333 nt, Artificial Sequence
  derived and/or modified sequence opt5 from anti-HIV_048-214886_VR-Chain
cagagcgcccugacccaacccagauccgugucuggcagcccugggcaguccgucacaaucucuugcacgggaaccagcuccgacguuggcuacaacuaugugucuugguaccagcaccauccggggacagcucccaagcuccugauuuauaaaaauaacaaucggccuagcggaauccccgaucgcuucuccggcagcaagucugggaccuccgccacacuuggaauuaccggccugcagacaggcgacgaggcggauuacuauugugggaccugggacacgagccucucugcuggaggcguguuugggaccggaacaaaagucaccgugcug

SEQ ID NO: 40807 - RNA, 333 nt, Artificial Sequence
  derived and/or modified sequence opt5 from anti-HIV_048-214709_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaaugacagacggcccagcgggauuccugaucgcuucuccggaagcaagucuggcaccuccgcgacacuggggaucaccggacuccaaacaggcgacgaagcugauuauuacuguggcaccugggacacaagccugucugccgggggaguguuuggcaccgggacgaaagucaccgugcuu

SEQ ID NO: 40808 - RNA, 333 nt, Artificial Sequence
  derived and/or modified sequence opt5 from anti-HIV_048-214001_VR-Chain
cagagcgugcugacccaacccccuuccgucucuggcgccccggggcagacaguuacgaucagcugcuccggaucuaacagcaauauuggcaaccacgacgugcauugguaccagcacgugcccgggaccgcuccuaagcuccugaucuaugauaauaacaaaagacccuccggcauuccugaccgguucucuggaagcaaguccgggacaagcgccacccuuggaaucacaggccugcagaccggcgaugaggcggaauacuauugugcuacaugggacgccucucucuccgggggaggcgucuuucgcaccgggacgaaagugaccguucug

SEQ ID NO: 40809 - RNA, 333 nt, Artificial Sequence
  derived and/or modified sequence opt5 from anti-HIV_048-213230_VR-Chain
cagagcgugcugacccaacccccuuccaugucugccgcuccgggccagaaggucacaaucagcugcuccgggucuagcaacaauauuggcaaaaacguuguguccugguaccagcagcuccccggaacggccccuaaggugcugaucuaugagaauaacaaaagacuuucugggauucccgaccgguucagcggauccaagagcggcaccucugcgacacuggucaucaccgggcuccaaacaggagaugaagcugacuacuauuguggcaccugggauuccagccugucugccggcgggguguuuggaacaggcaccaaaguuacggugcuu

SEQ ID NO: 40810 - RNA, 333 nt, Artificial Sequence
  derived and/or modified sequence opt5 from anti-HIV_048-212574_VR-Chain
cagagcgugcugacccaacccccuuccgucucugccgcuccgggccagagaguuacagugagcugcuccgggucuacgagcaacaucgaguccaauuacgugucuugguaucagcagguccccggaaccgccccuaagcuccugauuuacgaaaacaauaaacggcccagcggcaucccugaccgcuucuccgggagcaagucuggaacauccgcgacccuugcuauuacaggccugcaaaccggggaugaggccgccuauuacuguggaacaugggacggcagccucucuaccggcggggugaucggaacgggcaccaaaguuacagugcug

SEQ ID NO: 40811 - RNA, 333 nt, Artificial Sequence
  derived and/or modified sequence opt5 from anti-HIV_048-212207_VR-Chain
cagagcgugcugacccaacccccuucccucucugccgcuccgggccagaaggucacaaucagcugcuccgggggaucuagcaacauuggcaauaacuacguuuccugguaucagcaccuucccgggacggccccuaaacugcugaucuacgacaauuauaagagacccucuggcauuccugaucgguucagcggauccaaaagcgggaccucugcgacacucgacaucaccggacugcagacaggcgaugaggcugacuacuauuguggcaccugggauacaucccuuagcgccgggggaguguuuggcaccgggacgaaggugaccguccug

SEQ ID NO: 40812 - RNA, 333 nt, Artificial Sequence
  derived and/or modified sequence opt5 from anti-HIV_048-209146_VR-Chain
cagagcgugcugacccaacccccuuccgucucuggcgccccggggcagaagaucacaguuagcugcacgggaaccacauccaacauuggcccccacgacgugcauugguaccagcucgugccugggagacccccuaaacugcuuaucuuccacaauaacauucggcccucuggaaucccugaucgcuuuagcggcuccaagucugggaugagcgcuacccugggaauuacaggccuccagaccggcgacgaggccgauuauuacugugggacaugggacuccagccugucugcgggaggcgucuucgggaccggaacgaaagugaccguucuu

SEQ ID NO: 40813 - RNA, 333 nt, Artificial Sequence
  derived and/or modified sequence opt5 from anti-HIV_048-208206_VR-Chain
cagagcgugcugacccaacccccuuccgucucugccgcuccgggccagaagguuacaaucagcugcuccgggucuagcuccaacauuggaucuaauuacgugagcugguaucagcaguuccccggcacggccccuagacuccugaucuacgagaacgacaaacggcccuccgcgauuccugaucgcuuuagcgggucuaaguccggaaccagcgcuacacuuggcaucaccgggcugcacacaggagacgaagccgauuauuacuguggcaccugggacggcucucucuccacagggggagugauuggcaccgggacgaaagucaccgugcug

SEQ ID NO: 40814 - RNA, 333 nt, Artificial Sequence
  derived and/or modified sequence opt5 from anti-HIV_048-208194_VR-Chain
cagagcgcccugacccaacccccuuccgcuucuggcagcccggggcaguccgugacaaucucuugcacgggaaccagcuccgacauuggcuacaaguaugucucuugguaccagcuccugcccgggacaccucccaaacuucugaucuucaagaacaaugagagaccuagcggcauucccgaucgguuuuccggaagcaaaucugggaccuccgccacacucggaaucaccggccugcagacaggcgacgaagcggauuauuacuguggggcuugggacaccagccuuucugccggaggcguuuucgggacgggaaccaaggugacagugcug

SEQ ID NO: 40815 - RNA, 333 nt, Artificial Sequence
  derived and/or modified sequence opt5 from anti-HIV_048-207744_VR-Chain
cagagcgcccugacccaacccgcuuccgugucugccagcuucggccaguccaucacaauuucuugcacgggggcggcuagcaccaucggaaacaaucucgucuccugguacagacugcuuccuggcacagccccgaagcugcucauuuauaaaaacgacaaucggcccucugggaucccugaucgcuuuagcggauccaagagcggcaccucugccacacuggggauuuccggacuucagaccggcgacgaggcugauuacuauuguggcacaugggacaccagccugucugggggaggcguuuucgggacgggaaccaaagugacagugcuc

SEQ ID NO: 40816 - RNA, 333 nt, Artificial Sequence
  derived and/or modified sequence opt5 from anti-HIV_048-206501_VR-Chain
cagagcgugcugacccaacccccuuccgucucuggcgccccggggcagagaguuacaaucagcugcuccggaucuagcuccaacauuggcaauaacgcugugaauugguaccagcagcuccccgggaaggccccuaaacugcuuaucuaugagaacaauaagcggcccucuggcauuccugaccgcuucagcggauccaaaagcgggacgucugcgacccugggaaucacaggccuccaaaccggcgaugaagcugacuacuauugugggacaugggauuccagccugucugccggaggcguguuugggaccggaacaaaggucaccgugcuu

SEQ ID NO: 40817 - RNA, 333 nt, Artificial Sequence
  derived and/or modified sequence opt5 from anti-HIV_048-204221_VR-Chain
cagagcgugcugacccaacccccuuccgccucuggcacaccggggcagagagucacgaucagcugcuucggauccucuagcaacauugcuuccucugccguuaauugguaccagcagcuccccggcaccgcgccuaagcugcuuaucuauaaaaacgacaagcggcccagcgggauuccugaucgcuuuuccggaagcaaaucuggcacauccgcuacccuggggaucacaggacuccaaaccggcgacgaggccgauuacuauuguggcacaugggacaccagccugucugccgggggaguguucggcacggggaccaaggugacaguccuu

SEQ ID NO: 40818 - RNA, 333 nt, Artificial Sequence
  derived and/or modified sequence opt5 from anti-HIV_048-204015_VR-Chain
cagagcgugcugacccaacccccuuccgccucuggcacaccggggcagagagucacgaucagcugcuccggaucuagcuccaacauuggcucuaaguacguuuauugguaccagcagcuccccgggaccgcuccuaaacugcuuaucuauaagaaugacaaccggcccagcggcauuccugaucgcuucuccggaagcaaaucugggacauccgccacccugggaaucagcggccuccaaacaggcgacgaggcggauuacuauugugggaccugggacacaucucuguccggaggcgggguguuuggaaccggcacgaaggugaccguccuu

SEQ ID NO: 40819 - RNA, 333 nt, Artificial Sequence
  derived and/or modified sequence opt5 from anti-HIV_048-201240_VR-Chain
cagagcgugcugacccaacccccuuccgucucugccgcuccgggccagaagguuacaaucagcugcuccgggucuagcuccaacauuggaaauaacuacguggccugguaucagcagcuccccggcacggcgccuaaacugcuuaucaaggaaaauucucaaagacccagcgggauuccugaccgguucuccggaagcaaaucuggcaccuccgcuacacuggccaucaccgggcuccagacaggagaugaggccgacuacuauuguggcaccugggauacaagccugucuaccggcgggguguuuggaacgggcaccaaggucacagugcuu

SEQ ID NO: 40820 - RNA, 333 nt, Artificial Sequence
  derived and/or modified sequence opt5 from anti-HIV_048-200455_VR-Chain
cagagcgcccugacccaacccgcuuccgugucuggcagcccugggcaguccaucacaauuucuugcacgggaaccagcuccgacgucggcuacaacuauguuucuugguaccaggugcucccggggacagcccccaagcugcuuaucuauaaaaauaccgagagaccuagcggcauucccgaucgguucuccggaagcaagucugggacauccgcgacccuggacaucacaggacuccagaccggcgaugaagcugacuacuauuguggcacgugggauaccagccugucugccgggggaguguuuggcacagggaccaaagucacagugcuu

SEQ ID NO: 40821 - RNA, 333 nt, Artificial Sequence
  derived and/or modified sequence opt5 from anti-HIV_048-200319_VR-Chain
cagagcguggucacccaacccccuuccgccucuggcacaccggggcagagaguuacgaucagcugcuccggaucuagcuccaacauuggcucuaaguacguguauugguaccaccagcaucccgggaccgcuccuaaacugcucaucuaugacaauaacaaucggcccagcggcauuccugaucgcuucuccggaagcaagucugggacauccgccacccugggaaucacaggccuucagaccggcgacgaggcggauuacuauugugggacaugggacaccagccugucuagaggaggcguguuugggacgggaaccaaagucacagugcuc

SEQ ID NO: 40822 - RNA, 333 nt, Artificial Sequence
  derived and/or modified sequence opt5 from anti-HIV_048-197896_VR-Chain
cagagcgugcugacccaacccccuuccgucucugccgcuccgggccagaagguuacaaucagcugcuccggggccucuuacaacauuggcaaaaauagcguguccugguaucagcagcuccccggaacgccucccaagcugcuuaucuucaaaaacaaugagagaccuucugggauucccgaccgguuuagcggauccaagagcggcaccucugcgacacuggggaucaccggacuccaaacaggcgaugaagcugacuacuauugugccaccugggauacaucccugagcgccggcgggguguucggaaccggcacgaaagucaccgugcuu

SEQ ID NO: 40823 - RNA, 333 nt, Artificial Sequence
  derived and/or modified sequence opt5 from anti-HIV_048-193813_VR-Chain
cagagcgugcugacccaaucccccucugucagcgccgcuccuggccagaagguuacaaucuccugcucugggagcaacuccaaugugggaaacuacuaugugucuugguaccagcaccucccgggcacggcccccaaaguccugauuuaugaggggaauaagagaccuagcggagugcccgaccgguucuccggcagcaaaucugggaccuccgcgagccuugcuaucacaggacugcagaccggcgaugaagccgacuacuauuguggcacaugggauaccucucucuccgccgggggaguuuuuggcagcgggacaaaggugaccguccug

SEQ ID NO: 40824 - RNA, 333 nt, Artificial Sequence
  derived and/or modified sequence opt5 from anti-HIV_048-192098_VR-Chain
cagagcgugcugacccaacccccuuccgccucuggcacaccggggcagagagucacgaucagcugcuccggaucuaccagcaacauuggcuccaauuacguuuauugguaccagcagcuccccgggacaaccccuaagcugcuuaucuaugagaacaauaaacggcccucuggaauuacagaccgcuucuuuggcagcaaguccgggccuagcgcuacccuggauaucacaggacuccaaaccggcgacgaagccgauuacuauuguggcacgugggacgcgucucuguccgcugggggaguguucggcaccgggacaaaagugaccguccuu

SEQ ID NO: 40825 - RNA, 333 nt, Artificial Sequence
  derived and/or modified sequence opt5 from anti-HIV_048-191786_VR-Chain
cagagcgugcugacccaacccccuuccgucucugccgcuccgggccagaacguuaauaucagcugcuccgggucuagcuccaacauugagaauaacuucgugucuugguaccagaagcuccccggaacagccccuaaacugcuuaucuaugacaauaacaagagacccagcggcauucgggaucgcuuuuccgggagcaaaucuggaacguccgcgacccugggcaucacagggcuccagaccggagacgaagcugauuacuauuguggcacaugggacaccagccugucugccggcgggguguucggauccggcacaaaggucaccgugcuu

SEQ ID NO: 40826 - RNA, 333 nt, Artificial Sequence
  derived and/or modified sequence opt5 from anti-HIV_048-188746_VR-Chain
cagagcgugcugacccaacccccuuccgccucuggcacaccggggcagaaggucacgaucagcugcuccggaucuaacagcaauauuggcuccaacuucguuucuugguaccagcuccugcccgggaccacaccuaaacuucugaucuauagaaauaaccagcggcccagcggagugccugaccgcuuuuccggcagcaagucugggaccuccgcuacacucggaauuaccggccugcaaacaggcgaugaggccgacuacuauugugggaccugggauagcucucuuuccgcgggaggcguguucgggacgggaaccaaagucacagugcug

SEQ ID NO: 40827 - RNA, 333 nt, Artificial Sequence
  derived and/or modified sequence opt5 from anti-HIV_048-185937_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaauaacaagagacccagcgggauuccuuaucccaucuccggaagcaaaucuggcaccuccgcgacacuggggauuaccggacuccaaacaggcgacgaagcugauuacuauuguggcaccugggacagcucucuguccgccgggggaguguucggcacagggaccaaggucacggugcuu

SEQ ID NO: 40828 - RNA, 333 nt, Artificial Sequence
  derived and/or modified sequence opt5 from anti-HIV_048-184849_VR-Chain
cagagcgugcugacccaagcccccuccgcuucuggcacaccugggcagacggucaccaucagcugcuccggaucuagcuccaacauuggcacaaaguacguuuauugguaccagcagcucccggggaccgcccccaaacugcuuaucuauaagaauaacgagagaccuucuggcauucccgaccgguucagcggauccaaaagcgggacaucugcgacccugggaaucacaggccuccaaaccggcgaugaagcugacuacuauugugggacgugggauaccucccugagcccuggaggcguguuugggacaggaaccaaggugacaguccuu

SEQ ID NO: 40829 - RNA, 333 nt, Artificial Sequence
  derived and/or modified sequence opt5 from anti-HIV_048-183089_VR-Chain
cagagcgugcugacccaacccccuuccgccucuggcacaccggggcagagagucacgaucagcugcuccggaucuagcuccaacauuggcucuagcuacguuuauugguaccagcuccugcccgggaccccucccaaacuucugaucuucaagaauaacgagcggccuuccggcauucccgaccgcuuuagcggaucuaaguccgggacaagcgcuacccucggaaucacaggccugcagaccggcgaugaagccgacuauuacugugggacaugggauaccucucuuuccgcgggaggcguguucgggacgggaaccaaagugacaguccug

SEQ ID NO: 40830 - RNA, 333 nt, Artificial Sequence
  derived and/or modified sequence opt5 from anti-HIV_048-181509_VR-Chain
cagagcgugcugacccaacccccuuccgucucuggcgccccggggcagagaguuacaaucagcugcacgggauccucuagcaacauuggcggguacgacgugcacugguaucaucagcuccccggagcugccccuaagcugcuuaucuacaaaaaugauaaccggcccuccggcauuccugaccgcuucucugggagcaaguccggaaccagcgcgacacugggcaucucuggccuccagaccggggaugaggcugacuauuacuguggaacaugggauaccucccugagcggcgggggaguguuuggcacagggaccaaagucacggugcuu

SEQ ID NO: 40831 - RNA, 333 nt, Artificial Sequence
  derived and/or modified sequence opt5 from anti-HIV_048-180990_VR-Chain
cagagcgugcugacccaacccccuuccgucucugccgcuccgggccagagaguuacaaucagcugcuccgggucuacgagcaacauuggaaauaacuacguguccugguaucagcacuuccccggcaaggugccuaaagucgugaucucugagaccacaaagcggcccagcgggauuccugaccgcuuuuccggaagcaaaucuggcaccuccgccacacucgggaucaccggacugcagacaggcgaugaagcggacuacuauuguggcaccugggauagcucucuuuccgcugggggaguuuucggcacggggaccaaggugacaguccug

SEQ ID NO: 40832 - RNA, 333 nt, Artificial Sequence
  derived and/or modified sequence opt5 from anti-HIV_048-177532_VR-Chain
cagagcgcccugacccaacccccuuccgcuucuggcagccucgggcaguccgugacaaucucuugcacgggaaccagcuccgacgucggcaacaauuucguuucuugguaccagaagaaaccggggaaggcccccaaacugauuguguaugaggugaacaagagaccuagcggaauccccgaucgguuuuccggcagcaaaucugggacauccgcgacccuuggaauuacaggccugcagaccggcgacgaagcugauuacuauugugggacaugggacaccagccucucuacgggaggcgucuucgggaccggaacaaaggugaccguucug

SEQ ID NO: 40833 - RNA, 324 nt, Artificial Sequence
  derived and/or modified sequence opt5 from anti-HIV_048-177426_VR-Chain
cugacccagccccacagcguguccgagucuccuggcaagacagucacgaucagcugcaccgggacauccucugacguuggauacaacuaugugagcugguaccaacaucacccgggcaaagcgcccaagcuccugauuuaugaagugaccaaaagaccuuccgggauccccgaucgguucucuggaagcaaguccggcacaagcgcuacccuugggauuacaggacugcagaccggcgacgaggccgauuacuauuguggcacgugggacucuucccucagcgccgggggagucuuuggcaccgggacaaaagugaccguucug

SEQ ID NO: 40834 - RNA, 333 nt, Artificial Sequence
  derived and/or modified sequence opt5 from anti-HIV_048-177389_VR-Chain
cagagcgugcugacccaacccccuuccaugucugccgcuccgggcgagagagucacaaucagcugcuccgggucuagcuccaacauuggaaaucaccauguuucuugguaccagcagcggcccggcacggccccuaagcuccugaucuaugaaaacaaugagcgccccagcgggauuccugacagauucuccggaagcaaaucuggcaccuccgcgacacuugggaucaccggacugcagacaggcgaugaagcugacuacuauuguggcaccugggauacaagccucucugccgggggaguguuuggcuccgggaccaaggugacgguccug

SEQ ID NO: 40835 - RNA, 333 nt, Artificial Sequence
  derived and/or modified sequence opt5 from anti-HIV_048-174266_VR-Chain
cagagcgugcugacccaacccccuuccgucucuggcgccccggggcagagaguuacaaucagcugcuccggaucuagcuccaacauuggcucucacuacgugagcugguaucaacaggugcccgggacggcuccucggcucgucaucuacgacaccauuaagcgccauuccggaauccccgauagauucagcggcucuaaauccgggacaagcgccacccugggaauuacaggccuucagaccggcgacgaggcggauuauuacugugggacaugggacaccucucuguccgcuggaggcguguuugggacgggaaccaagguuacagugcuc

SEQ ID NO: 40836 - RNA, 333 nt, Artificial Sequence
  derived and/or modified sequence opt5 from anti-HIV_048-172847_VR-Chain
cagagcgugcugacccaacccccuuccgucucugccgcuccgggccagagaguuacagugagcugcuccgggucuacgagcaacaucgaguccaauuacgugucuugguaucagcagguccccggaaccgccccuaagcuccugauuuacgaaaacaauaaacggcccagcggcaucccugaccgcuucuccgggagcaagucuggaacauccgcgacccuuggcauuacagggcugcaaaccggagaugaggcugacuauuacuguggcacaugggauaccagccucucugccggcgggguguuuggaacgggcaccaaaguuacagugcug

SEQ ID NO: 40837 - RNA, 333 nt, Artificial Sequence
  derived and/or modified sequence opt5 from anti-HIV_048-172845_VR-Chain
cagagcgcccugacccaacccccuuccgcuucuggcagcccggggcaguccgugacaaucucuugcacgggaaccagcuccgacgucggcuacaacuauguuucuugguaccagcagcuccccgggacagccccuaagcugcuuauuuauagaaauaaccaacggcccagcggagugccugaucgcuucuccggcagcaaaucugggaccuccgcgacacugggaaucaccggccuccagacaggcgacgaggcugauuacuauugugccaccugggacacgagccugucugccgggggaguguuuggcaccgggacaaaggucaccgugcuu

SEQ ID NO: 40838 - RNA, 333 nt, Artificial Sequence
  derived and/or modified sequence opt5 from anti-HIV_048-172363_VR-Chain
cagagcgugcugacccaacccccuuccgucucugccgcuccgggccagaagguuacaaucagcugcuccgggucuggaagcaacauuggcaauacguacguguccugguaucagcagcuccccgggaccgccccuaagcugcuuaucuucgaggacaacaagagacccucuggcauuccugaucgguuuagcggauccaaaagcgggacaucugcgacccuggcuaucacaggacuccaaaccggcgacgaagccgauuacuauuguggcacaugggacuccagccugucugggggaggcgugauugggaccggaacgaaacuuaccguccug

SEQ ID NO: 40839 - RNA, 333 nt, Artificial Sequence
  derived and/or modified sequence opt5 from anti-HIV_048-171609_VR-Chain
cagagcgugcugacccaacccccuuccgucucugccgcuccgggccaggagguuacaaucagcugcuccgccucuagcuccucuauugggaacgacuucgugagcugguaccagcagcuccccggaacggcgccuaagcugcuuaucuauggcaauuccaacagacccagcgggauuccugaucgguuuucuggauccaaaagcggcaccucugcuacacuggggaucaccggacuccaaacaggcgacgaagccgauuacuauuguggcaccugggacacaucccugagcaccgggggaguguucggcacggggaccaaggucacagugcuu

SEQ ID NO: 40840 - RNA, 333 nt, Artificial Sequence
  derived and/or modified sequence opt5 from anti-HIV_048-170705_VR-Chain
cagagcgugcugacccaacccccuuccgucucugccgcuccgggccagaugguuacaaucagcugcuccgggucuacgagcaacauuggaaucaauuacguguccugguaucagcacgugcccggcaccgccccuaagcuccugauuuacgagaacgucgaaagacggucugggauccccgaccgcuucagcgcguccaaaagcgcuacaucugccacccuuggaauuacaggccugcagaccggggaugaggccgacuauuacuguggaacaugggauaccucccucagcgcuggcggcguguuugggucuggaacgaagguuaccgugcug

SEQ ID NO: 40841 - RNA, 333 nt, Artificial Sequence
  derived and/or modified sequence opt5 from anti-HIV_048-168381_VR-Chain
cagagcgcccugacccaacccgcuuccgugucuggcagcccugggcaguccaucacaauuucuugcacgggaaccagcuccaacaucggcucuaauuacgucagcugguaucagcagcucccggggacagcccccaagcugcuuauuuacgagaacaaucaaagaccuuccggaauccccgaccgguucagcggcucuaaauccgggaccagcgcgacacugggaauuaccggccuccagacaggcgaugaagcugacuauuacugugggaccugggauacgucucuguccgccggaggcguuuuugggagcggaaccaaggugacagugcuu

SEQ ID NO: 40842 - RNA, 333 nt, Artificial Sequence
  derived and/or modified sequence opt5 from anti-HIV_048-166619_VR-Chain
cagagcgugcugacccaacccccuuccgucucuggcgccccggggcagagaguuacaaucagcugcacgggauccucuagcaacauuggcggguaccacacccauugguaucagcagcuccccggaacagcuccuaagcugcuuaucuacgaaaauuccaaacggcccucuggcauuccugaccgcuucagcggguccaagagcggaaccucugccacacugggcaucaccggccuccaaacaggggaugaggcggacuauuacuguggaaccugggauacgucccugagcgcuggcgggguguuuggaucuggcaccaaagugacaguccuu

SEQ ID NO: 40843 - RNA, 333 nt, Artificial Sequence
  derived and/or modified sequence opt5 from anti-HIV_048-162036_VR-Chain
cagagcgugcuggcccaacccccuuccgucucuggcgcuccggggcagaccguuacaaucagcugcacgggauccucuagcaacauuggcggguacgacgugcacugguaucagcagcuccccggaaccgccccuaagcugcuuaucuacaaagaugacaagagacccuccggcauuccugaucgguucucugggagcaaauccggaacaagcgcgacccugggcaucacaggccuccaaaccggggacgaggcugauuauuacuguggaacaugggacaccucucugaaucgcggcgggguguuuggaacgggcaccaaggucacagugcuu

SEQ ID NO: 40844 - RNA, 333 nt, Artificial Sequence
  derived and/or modified sequence opt5 from anti-HIV_048-160042_VR-Chain
cagagcgugcugacccaacccccuuccgucucugccgcuccgggccagaagguuacaaucagcugcuccgggucuagcuccaacauuggaaucaauuacauuucuugguaucagcagcuccccggcacggccccuaaaauccugauuuacgacaacgauaagagaccccuugggaucccugaccgguucagcggauccaaaagcggcaccucugcgacacuggggaucaccggacuccaaacaggcgaugaggcugacuauuacuguggcaccugggaugccucccugagcgccgggggaguguuuggcacagggaccaaggugacgguccuu

SEQ ID NO: 40845 - RNA, 333 nt, Artificial Sequence
  derived and/or modified sequence opt5 from anti-HIV_048-159676_VR-Chain
cagagcgugcugacccaacccccuuccgucucugccagcccgggccagaagguuacaaucuccugcucugggagcuccucugacauuggaagcaacuacguguccugguaugugcagcuccccggcacggcuccuaaacugcuuaucuacaagaauaacgagagacccagcgggauuccugaucgguucucuggauccaaaagcggcaccucugccacacuggggaucaccggacuccagacaggcgacgaagcggauuauuacuguggcaccugggacacaucccugagcgcugggggagucuuuggcaccgggacgaaggugaccguucuu

SEQ ID NO: 40846 - RNA, 333 nt, Artificial Sequence
  derived and/or modified sequence opt5 from anti-HIV_048-159500_VR-Chain
cagagcgugcugacccaacccccuuccgucucugccgcuccgggccagaacguuacaaucagcugcuccgggucuuggagcaauauuggagccaacuacguguccugguaucagcagcuccccggcacggcgccuaagcugcuuaucuacgagaauaacaaaagacccucugggauuccugaccgguucagcggauccaagagcggcaccucugcuacacugggguuuaccggacuccaaacaggcgaugaagccgacuauuacuguggcaccugggauacaucccugagcgccgggggaguguucggcaccgggacgaaagucaccgugcuu

SEQ ID NO: 40847 - RNA, 333 nt, Artificial Sequence
  derived and/or modified sequence opt5 from anti-HIV_048-159421_VR-Chain
cagagccugcucacccaagcccccuccgugucugcugccccuggccagacagucacgaucagcugcuccgggucuaacgcggacauuggaaagaauuucguuagcugguaccagcaguccccgggcgcugcccccaaacugcuuaucuaugagaacgauagacggccuucugggauucccgaccgcuuuagcggauccaagagcggcaccucugccacacuggggaucaccggacuccaaacaggcgaugaagcugaguacuauugugccaccugggacgcuucccugagcggcgggggaguguucggcacagggaccaaagugacgguccuu

SEQ ID NO: 40848 - RNA, 333 nt, Artificial Sequence
  derived and/or modified sequence opt5 from anti-HIV_048-159333_VR-Chain
cagagcgugcugacccaacccccuuccgccucuggcacaccggggcagagagucacgaucagcugcuccggaucuaacagcaauauuggcuccgacucuguuuacugguaucagcagcuccccgggcggagcccuaagcugcuuaucuaccgcaacaaugagagacccuccggcauuccugaucgguucagcggaucuaaauccgggaccagcgcuacacugggaaucaccggccuccaaacaggcgacgaagccgauuauuacugugggaccugggacacaucucuguccgcgggaggcguguuugggaccggaacgaaggugaccguccuu

SEQ ID NO: 40849 - RNA, 333 nt, Artificial Sequence
  derived and/or modified sequence opt5 from anti-HIV_048-158932_VR-Chain
cagagcgugcugacccaacccgccuccgucucuggcagcccugggcaguccaucacaauuucuugcagcggauccucuagcaacaucggcgacauuuucguuuccugguaccaacaggugccgggggcugcccccaagcuccugaucuaugauaaugacaaaagaccuagcggcauucccgaucgguuuucuggauccaagagcgggacgucugcgacccuugacaucacaggacugcagaccggcgaugaggcugacuacuauuguggcacaugggauaccucccucagcgccgggggaguguucggcacagggaccaaagucacggugcug

SEQ ID NO: 40850 - RNA, 333 nt, Artificial Sequence
  derived and/or modified sequence opt5 from anti-HIV_048-155811_VR-Chain
cagagcgcccugacccaacccgcuuccgugucuggcagcccugggcaguccaucacaauuucuugcacgggaaccagcuccgacgucggcuacgauuauguuucuugguaccagcuccugccggggacacccccuaaacuucugaucuucaagaacaaugagagacccagcggcauuccugaccgguuuuccggaagcaagucugggaccuccgccacacucggaaucaccggccugcagacaggcgaugaagcggacuauuacugugcuaccugggauacgagccuuucugccgggggaguguucggcaccgggacaaaagugaccguccug

SEQ ID NO: 40851 - RNA, 333 nt, Artificial Sequence
  derived and/or modified sequence opt5 from anti-HIV_048-155464_VR-Chain
cagagcgcccugacccaacccgcuuccgugucuggcagcccugggcaguccaucacaauuucuugcacgggagccaccggcgacagcgggcacacauacgucuccugguaucagcagcucccgggaaccgcgcccaagcugcuuaucuacucuaacaaugagagaccuagcggcguucccgaucgguucuccgggagcaaaucuggaacauccgcuacccugggcauuacaggccuccaaaccggggacgaagccgauuauuacuguggaacgugggacaccagccugucugccggcgggguguuuggauccggcacaaaggugaccguccuu

SEQ ID NO: 40852 - RNA, 333 nt, Artificial Sequence
  derived and/or modified sequence opt5 from anti-HIV_048-155392_VR-Chain
cagagcgugcugacccaacccccuuccgucucugccgcuccgggccagaugguuacaaucagcugcuccgggucuagcuccaacauuggagacaauuacgugucuugguaucagcagcuccccggcagagggccuaagcugcuuguguacgauacguauaaacgguaccuggagacccccgaccgcuucagcggauccaagagcggcacaucugccacccucgggaucacaggacugcaaaccggcgaugaagcggacuauuacuguggcacaugggauaccucccuuagcgcugggggagucuuuggcacggggaccaaagugacaguucug

SEQ ID NO: 40853 - RNA, 333 nt, Artificial Sequence
  derived and/or modified sequence opt5 from anti-HIV_048-155389_VR-Chain
cagagcgugcugacccaacccccuuccgucucugccgcuccgggccagaagguuacaaucagcugcuccgggauuucuagcaacaucggaaauaaccccguguccugguaccagcaguucccuggcacggcccccaaacuccugauuuauaagaaugacaaaagaccuucugggauccccgaucgguuuagcggauccaagagcggcaccucugcgacacuugggauuaccggacugcaaacaggcgacgaggcugauuacuauuguggcaccugggacacaucccucagcaccgggggaguguucggcacggggaccaaagucacagugcug

SEQ ID NO: 40854 - RNA, 333 nt, Artificial Sequence
  derived and/or modified sequence opt5 from anti-HIV_048-154449_VR-Chain
cagagcgugcugaagcaacccccuuccgucucuggcgccccggggcucagaguuaccaucagcugcacaggaggcuccucuaacauugggggauucgacgugcacugguaccagcauuuucccggcacggcuccuaaacugcuuaucuaugauaaugaccagcggcccagcgggauuccugaucgcuucuccggaucuaagagcggcaccuccgccacacugggcaucaccgggcuccagacaggagacgaggcggauuacuauuguggcaccugggacagcucucuguccgcugggggaguguuuggcacagggaccaaagucacggugcuu

SEQ ID NO: 40855 - RNA, 333 nt, Artificial Sequence
  derived and/or modified sequence opt5 from anti-HIV_048-153379_VR-Chain
cagagcgugcugacccaacccccuuccgucucugccacaccgggccagaagguuacgaucagcugcuccgggucuagaagcaacauuggaucccacuacgugucuugguaucagcaguuccccgagagcgcuccuaaacuccugaucuacaagaaugacaaccggcccuccggcauuccugaucgcuuuagcgggucuaaauccggaaccagcgccacacuuggcaucucugggcugcaaaccggagacgaagcggauuauuacuguggcacaugggacaccucccucagcggcgggggaguguucggcacagggaccaaggucacggugcug

SEQ ID NO: 40856 - RNA, 333 nt, Artificial Sequence
  derived and/or modified sequence opt5 from anti-HIV_048-153171_VR-Chain
cagagcgugcugacccaacccccuuccgucucugccgcuccgggccagaagguuacaaucagcugcuccgggucuacgagcaacauugaggacaucuacguguccugguaucagcaccuccccggaaccgccccuaaacugcuuauuuacgauaauaacaagagacccucuggcaucccugaccgguucagcggguccaaaagcggaacaucugcgacccuggcuauuacaggccuccagaccggggaugaagccgacuauuacuguggaacaugggauaccucccugagcgccggcggcguguuugggacgggaaccaaggucacagugcuu

SEQ ID NO: 40857 - RNA, 333 nt, Artificial Sequence
  derived and/or modified sequence opt5 from anti-HIV_048-152324_VR-Chain
cagagcauggugacccaaucccccucugucagcgccgcuccuggccagaagguuacaaucuccugcucugggacgagcuccaacauuggacagaauuacgugucuugguaucagcaacugccgggcaccgcccccaaacuccugaucuacgagaacagcaagagaccuuccgggauucccgaccgguucagcggaucuaaauccggcacaagcgcgacccuugggaucacaggacugcagaccggcgaugaagcugacuauuacuguggcacaugggauaccucucucuccgccgggggaguguuuggcagcgggacgaaggucaccgugcug

SEQ ID NO: 40858 - RNA, 333 nt, Artificial Sequence
  derived and/or modified sequence opt5 from anti-HIV_048-146102_VR-Chain
cagagcgugcugacccaacccccuuccgucucugccgcuccgggccagaagguuacaaucagcugcuccgggucuagcuccacgauuggaaacaauuacaucucuugguaucagcuccugcccggcaccccucccaaacuucugauuuacaagaacaaugagagaccuagcgggauccccgaccgguucuccggaagcaaaucuggcacauccgccacccucgggauuacaggacugcagaccggcgaugaagcggacuauuacuguggcacaugggauaccagccuuucugcugggggaguguuuggcacggggaccaaggugacaguccug

SEQ ID NO: 40859 - RNA, 333 nt, Artificial Sequence
  derived and/or modified sequence opt5 from anti-HIV_048-145984_VR-Chain
cagagcgugcugacccaaccccucuccgucucuggcgccccugggcagagaguuacaaucagcugcacgggauccucuagcaacauuggcuccaauuucgugucuugguaccaggugcugccggggaccacacccaaacuucugaucuuuaagaacaaugagcggccuagcggcauucccgaccgcuucuccggaagcaagucugggaccuccgcuacacucggaaucaccggccugcagacaggcgaugaagccgacuauuacuguggggcgugggauaccagccuuucugcuggaggcgucuuugggacgggaaccaaagugacaguucug

SEQ ID NO: 40860 - RNA, 333 nt, Artificial Sequence
  derived and/or modified sequence opt5 from anti-HIV_048-145371_VR-Chain
cagagcgugcugacccaacccccuuccgucucugccgcuagcggccagaagguuuccaucccgugcucugggggaacaagcaacauuggcgacaauuacguguccugguuccagcaguuucccgggucugccccuaaaauccucauuuaugauagcgacaagagacccucccggaucagcgaucgcuucucugcguccaaaagcggaacgucugcuacccuggacauuacaagacuucaaaccggcgaugaggccgacuacuauugugggacaugggauaccucccugagcgccggaggcguguuuggcacagggaccaaggucacggugcuc

SEQ ID NO: 40861 - RNA, 333 nt, Artificial Sequence
  derived and/or modified sequence opt5 from anti-HIV_048-144907_VR-Chain
cagagcgcccugacccaacccgcuuccgugucuggcagcccugggcaguccaucacaauuucuugcacgggaaccagacgggacgucggcuucaacuacguuagcugguaucagcagcacccggggacagcccccaagcuccugaucuacgagaauaacaaacgcccuuccggcauucccgauagauuuucuggaagcaaguccgggaccagcgcgacacuuggaaucaccggccugcaaacaggcgacgaagcugauuauuacugugggaccugggacucuucccucagcgccggaggcguguucgggacgggaaccaaagugacaguccug

SEQ ID NO: 40862 - RNA, 333 nt, Artificial Sequence
  derived and/or modified sequence opt5 from anti-HIV_048-142298_VR-Chain
cagagcgugcugacccaacccccuuccgccucuggcacaccggggcagagagucacgaucagcugcuccggaucuagcuccaccauuggcaacaauuacaucucuugguaucagcuccugcccgggacaccucccaaacuucugauuuucaagaacaaugagcggccuagcggaauccccgaccgcuuuuccgcuagcaagucuggcaccuccgccacacucgggauuaccggacugcagacaggcgaugaagcggacuacuauuguggcaccugggauacgagccuuucugcugggggaguuuucggcaccgggacaaaagugaccgugcug

SEQ ID NO: 40863 - RNA, 333 nt, Artificial Sequence
  derived and/or modified sequence opt5 from anti-HIV_048-142277_VR-Chain
cagagcgugcugacccaacccccuuccgucucuggcgccccggggcagagaaucacaauuagcugcacgggauccucuagcaacaucggcgcuuacgacguucagugguaucagcaccuccccgggaccgccccuaagcugcuuauuuacaaaaauacagagcggcccuccggaaucccugaucgcuucucuggcagcaaguccgggaccagcgcgacacuggacauuaccggacuccaaacaggcgaugaagcugacuauuacuguggcaccugggauacgucucuguccgccgggggaguguuuggcaccgggacaaaagugaccguccuu

SEQ ID NO: 40864 - RNA, 333 nt, Artificial Sequence
  derived and/or modified sequence opt5 from anti-HIV_048-141934_VR-Chain
cagagcgugcugacccaacccccuuccgucucuggcgccccggggcagagaguuacaaucagcugcacgggaaacuccucuaauauuggcgcuuacgacgugcacugguaucagcagcuccccgggaccgccccuaagcugaugaucuacgaggugagcaaacggcccuccggcauuccugaucgcuucucuggaagcaaguccgggacaagcgcgacccuuggaaucacaggccugcaaaccggcgacgaagcugauuauuacugugggacaugggacaccucucucuccgccggaggcgucuuugggagcggaacgaaagugaccguucug

SEQ ID NO: 40865 - RNA, 333 nt, Artificial Sequence
  derived and/or modified sequence opt5 from anti-HIV_048-141207_VR-Chain
cagagcgugcugacccaacccccuuccgucucugccgcuccgggccagaagguuacaaucgccugcagcggguccucuagcaacauuggaaauaacuacguguccugguaucagcagcuccccggcacggcgccuaaacugcuuaucuacgcuaauaacagacggcccucugggauuccugaccgcuucagcgccuccaagagcggaaccucugccacacugggcaucaccgggcuccaaacaggagaugaggcugacuauuacuguggcaccugggauacaucccugagcgccggcgggguguuuggaaccggcacgaaagucaccgugcuu

SEQ ID NO: 40866 - RNA, 333 nt, Artificial Sequence
  derived and/or modified sequence opt5 from anti-HIV_048-140796_VR-Chain
cagagcgugcugacccaacccccuuccgucucugccacaccgggccagaagguuacgaucagcugcuccgggaccagaucuaacauuggaaauaacuacgugagcugguaucggcaguuccccggcacagcuccuaaacuccugaucuacgaggacaauaagcgccccuccgggauuccugccagauuuucuggaagcaaauccggcaccagcgcgacacuugggaucaccggacugcagacaggcgaugaagcugacuauuacuguggcaccugggauacgucucucuccgccgggggaguguucggcaccgggacaaaggucaccgugcug

SEQ ID NO: 40867 - RNA, 333 nt, Artificial Sequence
  derived and/or modified sequence opt5 from anti-HIV_048-139893_VR-Chain
cagagcgugcugacccaacccccuuccgucucugccacaccgggccagaagguuacguucagcugcuccgggucuagcuccaccaucggcaaaaacuacgugucuugguaucaggugcuccccggaacagcuccuaagcugcuuauuuacaaaaauaacaagagacccagcgggaucccugaccgguuuuccggaagcaaaucuggcaccuccgccacacuggggauuaccggacuccagacaggcgaugaggcggacuauuacuguggcaccugggauagcucucuguccgcugggggagucuucggcacggggaccaaggugacaguucuu

SEQ ID NO: 40868 - RNA, 333 nt, Artificial Sequence
  derived and/or modified sequence opt5 from anti-HIV_048-138820_VR-Chain
cagagcgugcugacccaacccccuuccgucucuggcgccccggggcagaagguuacaaucagcugcuccggaucuggcagcaacauugggaauacguacguguccugguaucagcaccuccccggaaccgcuccuaaacugcuuaucuacgagaacaauaagagacccucuggcauuccugaccgguucagcggguccaaaagcgccacaucugcgacccugggaaucacaggccuccagaccggcgaugaagcugacuauuacugugggacaugggauaccucccugagcgccggaggcguguuugggacgggaaccaaggucacagugcuu

SEQ ID NO: 40869 - RNA, 333 nt, Artificial Sequence
  derived and/or modified sequence opt5 from anti-HIV_048-135858_VR-Chain
cagagcgugcugacccaacccccuuccgccucuggcacaccggggcagagagucacgaucagcugcuccggaucuagcuccaacauuggcucuagcuacguuuauugguaccagcaguuccccgggcgguccccucgccuccugaucuauagaaauaacgagcggcccagcggcauuccugaccgcuuuucuggauccaagagcgggaccucugcuacacuuggaaucaccggccugcaaacaggcgaugaagccgacuacuauugugggaccugggauacaucccucagcgcgggaggcguguucgggaccggaacgaaagugaccguccug

SEQ ID NO: 40870 - RNA, 333 nt, Artificial Sequence
  derived and/or modified sequence opt5 from anti-HIV_048-134968_VR-Chain
cagagcgugcugacccaacccccuuccgucucugccgcuccgggccagaagguuacaaucuucugcagcggguccucuagcaacauuggcaaaaauuacguguccugguaucagcagcuccccggaacggccccuaagcugcuuaucuacgagaacucuaaaagacccagcgggauuccugaccgguuuuccggaagcaagucuggcaccuccgcgacacuggggaucaccggacuccaaacaggcgaugaagcugacuauuacuguggcaccugggauacaagccugucugccgggggaguguucggcuccgggaccaaagucacggugcuu

SEQ ID NO: 40871 - RNA, 333 nt, Artificial Sequence
  derived and/or modified sequence opt5 from anti-HIV_048-134312_VR-Chain
cagagcgugcugacccaacccccuuccgccucuggcacaccggggcagagagucacgaucagcugcuccggaucuagcuccaacauuggcaauaacuacguuucuugguaucggcuccugcccgggaccgcuccuaaacuucugaucuacaagaaugacaaccgccccagcggcauuccugauagauucuccggaagcaagucugggacauccgccacccucggaaucagcggccugcagacaggcgacgaggcggauuauuacugugggaccugggacacaucucuuuccggaggcgggguguuuggaaccggcacgaaagugaccguccug

SEQ ID NO: 40872 - RNA, 330 nt, Artificial Sequence
  derived and/or modified sequence opt5 from anti-HIV_048-132253_VR-Chain
agcgcccugacccagcccgcuuccgugucuggcagcccugggcaauccaucgccauuucuugcacaggaacgagcuccgacgucggcuacgaucucguuucuugguaucagcagcacccggggaccgcgcccaagcugcuuaucuacgacaacaauaaaagaccuagcggcauucccgaucgguucuccggaagcaagucugggacauccgcuacccugggaaucacaggccuccagaccggcgacgaggccgauuauuacugugggacaugggacaccagccugucugccggaggcguguuuggguccggaacgaaagugaccguccuu

SEQ ID NO: 40873 - RNA, 333 nt, Artificial Sequence
  derived and/or modified sequence opt5 from anti-HIV_048-130710_VR-Chain
cagagcgugcugacccaacccccuuccgucgccggcgcuccggggcagagaguuacaaucucuugcacgggaaacaccagcaauauuggcggguacgacgugcacugguaucagcagcuccccggaacaccucccaagcugcuuaucuucaaaaacaaugagcggccuuccggcauucccgaucgcuuuucugggagcaaguccggaaccucugccacacugggcaucaccggccuccaaacaggggacgaagcggauuacuauuguggaaccugggacacgagccuguccgcuggcgggguguucggaaccggcacaaaagucaccgugcuu

SEQ ID NO: 40874 - RNA, 333 nt, Artificial Sequence
  derived and/or modified sequence opt5 from anti-HIV_048-128564_VR-Chain
cagagcgugcugacccaacccccuuccgccucuggcacaccggggcagagagucacgaucagcugcuccggaucuagcuccaacauuggcucuaauaccguuaacugguaccagcagcuccccgggacagcuccuaagcugcuuaucuauaaaaauaccgagcggcccagcggcauuccugaccgcuucuccggaagcaagucugggacauccgccacccuggauaucacaggacuccaaaccggcgacgaagcggauuacuauuguggcacgugggacaccagccugucugcugggggaguguuuggcacagggaccaaagugacaguccuu

SEQ ID NO: 40875 - RNA, 333 nt, Artificial Sequence
  derived and/or modified sequence opt5 from anti-HIV_048-126702_VR-Chain
cagagcgugcugacccaacccccuuccgccucugcugccccgggccagagagucacaaucagcugcuccgggucuaacagcaauauuggaaacaauuacguuuccugguaucagcagcuccccggcacggcgccuaagcugcuuaucuacgacaacucuaaacggcccagcgggauuccugaucgcuucuccgcuagcaagucuggaaccuccgccacacugggcaucaccgggcuccaaacaggagacgaggccgauuauuacuguggcaccugggacacaagccugucugcuggcgggguguuuggaaccggcacgaaagugaccguccuu

SEQ ID NO: 40876 - RNA, 333 nt, Artificial Sequence
  derived and/or modified sequence opt5 from anti-HIV_048-124521_VR-Chain
cagagcgugcugacccaacccccuuccgucucuggcgccccggggcagagaguuacaaucagcugcacgggauccucuagcaccuucggcggguacgacguguauugguaccagcagauucccggaacagcuccuaagcuccugaucuaugagaacaauaaacggcccuccggcauuccugaucgcuuuucugggagcaaguccggaaccagcgccacacuugcgaucaccggccugcaaacaggcgacgaagcugauuacuauugugggaccugggacggaucucucuccacgggcggggugauuggaaccggcacaaaagucaccgugcug

SEQ ID NO: 40877 - RNA, 333 nt, Artificial Sequence
  derived and/or modified sequence opt5 from anti-HIV_048-122740_VR-Chain
cagagcgugcugacccaacccccuuccaugucugccgcuccgggccagagcgucacaaucuccugcucugggagcacguucaauauugagaagcaccagguuaccuggcucagacaucugcccggaacagccccuaccuccgugaucauuaugaacucucagcggcccagcggcacaccugaccgcuuuuccgggagcaaaucuggaaccuccgcgacacuugcuaucaccggccugcaaacgggggaugaagccgacuacuauuguggaaccugggauggcagccucucuacaggcggggugauuggaaccggcacaaaggucaccgugcug

SEQ ID NO: 40878 - RNA, 327 nt, Artificial Sequence
  derived and/or modified sequence opt5 from anti-HIV_048-119536_VR-Chain
gagcugacccagagccccuccgugucugccgcuccuggcgaaaaggucacaaucagcugcuccgggacgaacucuaauauuggauacuauuacguuagcugguaucaacaguucccgggcaccgcccccaaaguggugaucuacgagaacacaaagagaccuuccgggauucccgaccgguuuucuggaagcaaauccggcaccagcgcgacacucgggaucaccggacugcagacaggcgaugaagcugacuauuacuguggcaccugggauacgucucuuuccgccgggggagucuucggcagcgggaccaaggugacaguucug

SEQ ID NO: 40879 - RNA, 333 nt, Artificial Sequence
  derived and/or modified sequence opt5 from anti-HIV_048-116929_VR-Chain
cagagcgugcugacccaacccccuuccgucucuggcgccccggggcagagaguuacaaucagcugcacgggauccucuagcaacauuggcgacuacgaugugcacugguaucagcagcuccccgggaccgcuccuaagcugcuuaucuaccggaauaaccaacgccccuccggagugccugacagauucucuggcagcaaauccgggacaagcgccacccugggaauuacaggccuccagaccggcgaugaggcggacuauuacugugggacaugggaugcuucucuguccgccggaggcgucuuugggaccggaacgaaggugaccguucuu

SEQ ID NO: 40880 - RNA, 333 nt, Artificial Sequence
  derived and/or modified sequence opt5 from anti-HIV_048-116577_VR-Chain
cagagcgugcugacccaacccccuuccgccucuggcacaccggggcagagagucacgaucagcugcuccggaucuagcuccaacauuggcucuaauuacguuagcugguaucaggugcuccccgggaccgcuccuaagcugcuuaucuacaaaaacaauaagcggcccuccggcauuccugaccgcuucagcggaucuaaauccgggacaagcgccacccugggaaucacaggccuccagaccggcgaugaggcggacuauuacugugcuacaugggauaccucucuguccgccgggggaguguuuggcacggggaccaaggucacagugcuu

SEQ ID NO: 40881 - RNA, 333 nt, Artificial Sequence
  derived and/or modified sequence opt5 from anti-HIV_048-116046_VR-Chain
cagagcgugcugacccaacccccuuccgucucuggcgccccggggcagagaguuacaaucagcugcacgggauccucuagcaacauuggcggguacgacgugcacugguaucagcaguuccccggaaccgcuccuaagcuccugaucuacgauaaugacaaacggcccuccggcauuccugaucgcuuuucugggagcaaguccggaacaagcgccacccuuggcaucacaggccugcaaaccggggacgaggcgaacuauuacuguggagcuugggauacaucucucuccgccggcgggguguucggaaccggcacgaaagucaccgugcug

SEQ ID NO: 40882 - RNA, 333 nt, Artificial Sequence
  derived and/or modified sequence opt5 from anti-HIV_048-115875_VR-Chain
cagagcgugcugacccaacccccuuccgucucugccgcuccgggccagagaguuacagugagcugcuccgggucuagcuccaacaucggaaauaacuucgugucuugguaccagcaccuccccggcacggccccuaagcugcuuauuuaugacaauagcaaccggcccuccgggaucccugaucgcuuuagcggaucuaaauccggcaccagcgcgacacuggggauuaccggacuccauacaggcgacgaggcugauuacuauuguggcaccugggacacaucucuguccgccgggggagucuucggcagcgggaccaaggugacgguucuu

SEQ ID NO: 40883 - RNA, 333 nt, Artificial Sequence
  derived and/or modified sequence opt5 from anti-HIV_048-115599_VR-Chain
cagagcgugcugacccaacccccuuccgucucugccgcuccgggccagaugguuacaaucagcugcuccgggucuagcuccaacauuggaucucacagcguguccugguaccagcauuuccccggcacggccccuaagcucgugaucgaggaaaaugaccagagacccagcgggauuccugaucgguuuucuggauccaaaagcggcaccucugcgacacuggggaucaccggacuucaaacaggcgacgagggcgauuauuacugugggaccugggacacaucccugagcggaggcggggucuucggaaccggcacgaaggugaccguucuc

SEQ ID NO: 40884 - RNA, 333 nt, Artificial Sequence
  derived and/or modified sequence opt5 from anti-HIV_048-113988_VR-Chain
cagagcgugcugacccaacccccuuccgucucugccgcuccgggccagaugguuacaaucagcugcuccgggucuagccacaacauuggagagaauuacguguccugguaucagcaucuccccggcacggccccuaagcugcuuaucuucaaaaacaaugaaagacccucugggauuccugaccgguuuagcggauccaagagcggcaccucugcgacacuggggaucaccggacuccagacaggcgaugaggcugacuacuauuguggcaccugggauacaucccugagcgccgggggaguguucggcaccgggacgaaagucaccgugcuu

SEQ ID NO: 40885 - RNA, 333 nt, Artificial Sequence
  derived and/or modified sequence opt5 from anti-HIV_048-112989_VR-Chain
cagagcgugcugacccaacccccuuccgccucuggcacaccggggcagagagucacgcucagcugcuccggaggcucuagcaacaucgggaaugacaacguuuacugguaucagcagcggcccggaaccacaccuaagcugcuuauuuacaaugauaaccgcagacccuccggcaccccugaccgguucucugggagcaaauccggaacaagcgcuacccuggccaucacaggccuccaaaccggcgaugaggcggacuauuacugugggacgugggauggaucucuguccaccggcggggugauuggaacaggcaccaaggugacaguccuu

SEQ ID NO: 40886 - RNA, 333 nt, Artificial Sequence
  derived and/or modified sequence opt5 from anti-HIV_048-112435_VR-Chain
cagagcgugcugacccaacccccuuccgucucugccgcuccgggccagaagguuagcaucuccugcucugggagcuccucuaacauuggcaaaaauuacgugagcugguaucagcagcuccccggaacagccccuaagcugcuuaucuucaaaaacaaugagagacccuccgggauuccugaccgguuuagcggaucuaaguccggcacgagcgcgacccuggggaucacaggacuccaaaccggcgaugaagcugacuacuauugugccacaugggauaccucucuguccgccggcgggguguucggaacaggcaccaaagucacggugcuu

SEQ ID NO: 40887 - RNA, 333 nt, Artificial Sequence
  derived and/or modified sequence opt5 from anti-HIV_048-111339_VR-Chain
cagagcgugcugacccaacccccuuccgucucugccgcuccgggccagaagguuacaaucagcugcacgggguccucuagcaacauuggaggcuacgccgugcacugguaucaacaggugcccgcgaccgcuccuaaacuccugaucuacgagaauaacgaaagacccuccgggauuccugaccgguucucuggaagcaaguccggcacaagcgccacccuugggaucacaggacugcagaccggcgaugaggccgacuauuacuguggcacaugggauaccucucucuccgcugggggagucuuuggcacggggaccaaagugacaguucug

SEQ ID NO: 40888 - RNA, 333 nt, Artificial Sequence
  derived and/or modified sequence opt5 from anti-HIV_048-111055_VR-Chain
cagagcgcccugacccaacccgcuuccgugucuggcagcccugggcaguccaucacaauuucuugcacgggaaccagaagcgacgucggcuacaacuauguuuccugguaccagcagcacccggggaaggcccccaaacuccugaucuaugagaauacaaagcggccuucuggcauucccgaucgcuucagcggauccaaaagcgggaccucugcgacacuuggaaucaccggccugcaaacaggcgacgaagcugauuacuauugugggaccugggacacgucccucagcgccggaggcguguuugggucuggaaccaaggugacaguccug

SEQ ID NO: 40889 - RNA, 333 nt, Artificial Sequence
  derived and/or modified sequence opt5 from anti-HIV_048-111027_VR-Chain
cagagcgugcugacccaacccccuuccgucucugccgcuccgggccagaagguuacaaucagcugcuccgggucuaacagcaaucucggaaacaauuacguguccugguaucagcaccuucccggcacggccccuagacugcugauuuacgaggacaaaaagcggcccucugggaucccugaucgcuucagcggauccaaaagcggcgcgucugcuacccucgacauuacagggcugcagaccggagaugaagccgacuauuacuguggcaucugggauacaucccuuagcgccggcgggguguuuggaaccggcacaaaggucaccgugcug

SEQ ID NO: 40890 - RNA, 333 nt, Artificial Sequence
  derived and/or modified sequence opt5 from anti-HIV_048-109721_VR-Chain
cagagcgugcugacccaacccccuuccgucucugccgcuccgggccagaagguuacaaucagcugcuccgggucuagcuccgacauuggaucuaacuucgugagcugguaccagcaccuccccggcacggccccuagacugcuuaucuaugagaauaaccggcgccccuccgggauuccugauagauuuagcggaucuaaauccggcaccagcgcgacacuggcuaucaccgggcuccagacaggagacgaagccgauuacuauuguggcaccugggacacaucucugaaucggggcgggguguucggaaccggcacgaaggucaccgugcuu

SEQ ID NO: 40891 - RNA, 333 nt, Artificial Sequence
  derived and/or modified sequence opt5 from anti-HIV_048-109666_VR-Chain
cagagcgugcugacccaacccccuuccaugucugccgcuccgggcgagagagucacaaucagcugcuccgggucuagcuccaacauuggaaaucaccauguuucuugguaccagcagcggcccggcacggccccuaagcuccugaucuaugaaaacaaugagcgccccagcgggauuccugacagauucuccggaagcaaaucuggcuccagcgcgacccuugcuaucacagggcugcagaccggagaugaagccgacuacuauuguggcacaugggauggccggcucaacauugggggagugaucggcaccgggacaaaggugaccguccug

SEQ ID NO: 40892 - RNA, 333 nt, Artificial Sequence
  derived and/or modified sequence opt5 from anti-HIV_048-109196_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgagaccaauaagagacccagcgggauuccugaccgguucuccggaagcaaaucuggcacauccgcgacccuggcuaucacagggcuccaaaccggagaugaagccgacuauuacuguggcacaugggauaccagccugucuggcgggggaguguuuggcacggggaccaaggucacagugcuu

SEQ ID NO: 40893 - RNA, 333 nt, Artificial Sequence
  derived and/or modified sequence opt5 from anti-HIV_048-109051_VR-Chain
cagagcgugcugacccaacccccuuccgucucugccgcuccgggccagaagguuacaaucagcugcuccgggaacaauucuaacauggugaauaacuacauuagcugguaucagcuccugcccggaacgccucccaaacuucugaucuucaagaauaacgagagaccuuccggcauucccgaccgguuuucugggagcaaauccggaaccagcgccacacucggcaucaccgggcugcagacaggagaugaagcggacuacuauuguggcaccugggauacaucucuuuccgcuggcgggguguucggaaccggcacgaaggucaccgugcug

SEQ ID NO: 40894 - RNA, 333 nt, Artificial Sequence
  derived and/or modified sequence opt5 from anti-HIV_048-108570_VR-Chain
cagagcgcccugacccaacccccuuccgugucugcugccccgggccagaaggucacaaucagcugcuccgggaaaucuagcaacauuggaacgaauuucguuuccugguaccagcaguuucccgaggcggcuccuaagcuccugaucuaugacaacaauaaaagacccucuggcauuccugaucgguucagcggguccaagagcggaaccucugccacacuuggcaucaccgggcugcaaacaggagacgaagccgauuacuauuguggcaccugggacggcucccucagcacagggggagugauuggcaccgggacgaaagugaccguccug

SEQ ID NO: 40895 - RNA, 327 nt, Artificial Sequence
  derived and/or modified sequence opt5 from anti-HIV_048-108033_VR-Chain
gagcugacccagagccccuccgugucugccgcuccuggccaaagagucacaaucagcugcuccgggaacucuagcaauauuggaaacaauuacguuuccugguaucagcuccugccgggcacggcccccaaacuucugaucuacaagaacgacaagcggccuucugggauucccgaucgcuucagcggauccaaaagcggcaccucugcgacacucgggaucaccggacugcagacaggcgacgaagcugauuauuacuguggcaccugggacacaucccuuagcaccgggggaguguuuggcacggggaccaaggugacaguccug

SEQ ID NO: 40896 - RNA, 333 nt, Artificial Sequence
  derived and/or modified sequence opt5 from anti-HIV_048-107279_VR-Chain
cagagcgugcugacccaacccccuuccgucucugccgcuccgggccagaagguuaucauuagcugcuccgggucuagcuccaacaucggcaaaaauuacgugucuugguaucagcaccuccccggaacagccccuaagcugcuuauuuacgagaacaauaaaagacccagcgggaucccugaccgguucuccggaagcaagucuggcacguccgcgacccuggggauuacaggacuccagaccggcgaugaagcugacuauuacuguggcacaugggaugccagccugucugccgggggagugcuuggcaccgggacaaaagucaccgugcug

SEQ ID NO: 40897 - RNA, 333 nt, Artificial Sequence
  derived and/or modified sequence opt5 from anti-HIV_048-106271_VR-Chain
cagagcgugcugacccaacccccuuccgucucugccgcuccgggccagaagguuacaaucagcugcuccgggucuagaagcaacauuggauccaauuacaucucuugguaucagcagcuccccggcacggccccuaaacugcuuauuuacaagaacgacaaacggcccagcgggaucccugaucgcuucuccggaagcaagucuggcaccuccgcgauucuggggaucacaggacuccaaaccggcgacgaggcugauuauuacuguggcgccugggacacaagccugucugccgggggaguguuuggcaccgggacaaaagugaccguccuu

SEQ ID NO: 40898 - RNA, 333 nt, Artificial Sequence
  derived and/or modified sequence opt5 from anti-HIV_048-106054_VR-Chain
cagagcgugcugacccaacccccuuccgucucugccgcuccgggccagcagguuacaaucagcugcuccgggucuacgagcaacauuggaaauaacuacguguccugguaucagcaagugcccggcaccgccccuaagcuccugaucuacgacaauaacaauagacccucugggauuccugaucgguucagcggauccaaaagcggcacaucugcgacccuugggaucuccggacugcagacaggcgacgaggcugauuauuacuguggcaccugggacacaagccucucugggggaggcgucuuugggaccggaacgaaggugaccguucug

SEQ ID NO: 40899 - RNA, 333 nt, Artificial Sequence
  derived and/or modified sequence opt5 from anti-HIV_048-104848_VR-Chain
cagagcgcccugacccaacccgcuuccgugucuggcagcccugggcaguccaucacaauuucuugcacgggaaccagcuccgacgucggcuacaacuauguuucuugguaccagcagcucccggggacagcccccaagcugcuuaucuucgauaaugacgauagaccuagcgagauucccgaccgguuuuccggaagcaaaucuggcaccuccgcgacacuggggaucaccggacuccaaccuggcgaugaagcugacuauuacuguggcacaugggauagcucucuguccgccgggggaguguucggcaccgggacgaaggugaccguccuu

SEQ ID NO: 40900 - RNA, 333 nt, Artificial Sequence
  derived and/or modified sequence opt5 from anti-HIV_048-104638_VR-Chain
cagagcgugcugacccagcccccuuccgccucuggcacaccggggcacagagucacgaucagcugcuccggaaacucuagcaauauuggcgggaaccauguuuacugguaucaacaggugcccggaaccacaccuaagcuccugaucuaccggaauaacgagcgccccuccggcauuccugacagauucucugggagcaaauccggaaccagcgcuacacuuggcaucaccggccugcagacaggggaugaagccgacuauuacuguggaaccugggauacgucucucuccgcgggcgggguguuuggaaccggcacaaaggucaccgugcug

SEQ ID NO: 40901 - RNA, 333 nt, Artificial Sequence
  derived and/or modified sequence opt5 from anti-HIV_048-104567_VR-Chain
cagagcgugcugacccaacccccuuccgccucuggcacaccggggcagagagucacgaucagcugcuccggaucuaacagcaauauuggcaccaacuucguuaauugguaccagcacgugcccgggcgggcuccuaagcuccugaucuauaaaaacacagagcgccccuccggcauuccugacagauuuucuggaagcaaguccgggaccagcgccacacuugauaucaccggacugcagacaggcgacgaagcggauuacuauuguggcaccugggacacgucucucuccgcugggggaguguucggcaccgggacaaaagucaccgugcug

SEQ ID NO: 40902 - RNA, 333 nt, Artificial Sequence
  derived and/or modified sequence opt5 from anti-HIV_048-102804_VR-Chain
cagagcgugcugacccaacccccuuccgucucuacagccccgggccagaagguuacgaucagcugcuccgggucuagcuccaacauuggauacucuuaugugagcugguuccagcaccuccccggcaccgcuccuaaacugcuuaucuacggaaauuccaacagacccagcggggugccugaccgguuuucuggcuccaagagcgggacaucugccucccuggcgauuaccggacuccagacaggcgaugaggcugacuauuacuguggcaccugggauagcucucuguccgccgggggagucuucggcacagggaccaaagugacgguucuu

SEQ ID NO: 40903 - RNA, 333 nt, Artificial Sequence
  derived and/or modified sequence opt5 from anti-HIV_048-101676_VR-Chain
cagagcgugcugacccaacccccuuccgucucuggcgccccggggcagagcguuacaaucuccugcacgggaaccucuagcaacauuggcgacuucgaugugcacugguaccagcagcuccccgggacagcuccuaagcugcuucuguaugagaauaacaaaagacccuccggaaucccugaccgguuuucuggcagcaaguccgggaccagcgccacacucgcgauuaccggacugcaaacaggcgaugaagcugacuacuauuguggcaccugggaugggucucuuuccacgggaggcgugaucgggaccggaacaaaagucaccgugcug

SEQ ID NO: 40904 - RNA, 333 nt, Artificial Sequence
  derived and/or modified sequence opt5 from anti-HIV_048-097603_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuuaucuacgacaccgugaagagacccagcgggauuccugaucgguucuccggaagcaaaucuggcacauccgcgacccuggggaucacaggacuccaaaccggcgacgaggcugauuauuacuguggcacaugggacagcucucuguccgggggaggcgucuuugggaccggaacgaaggugaccguucuu

SEQ ID NO: 40905 - RNA, 333 nt, Artificial Sequence
  derived and/or modified sequence opt5 from anti-HIV_048-097107_VR-Chain
cagagcgugcugacccaacccccuuccgucucugccgcuccgggccagaagguuacaaucagcugcuccgggucuagcuccaacauugagaauaacuacgugucuugguauagacaggugcccggaacggccccuaaacuccugaucuacaagaaugacaaccggcccagcggcauuccugaucgcuucuccgggagcaaaucuggaaccuccgcgacacuuggcaucaccgggcugcagacaggagacgaagcugauuauuacuguggcauuugggacaccagccucucugccggcggggucuuuggaacaggcaccaaggugacgguucug

SEQ ID NO: 40906 - RNA, 333 nt, Artificial Sequence
  derived and/or modified sequence opt5 from anti-HIV_048-096871_VR-Chain
cagcccgugcugacccaaccuccgagcgccuccggcacacccgggcagagagucacgaucucuugcagcggauccucuagcaacauuggcuccaauuacguuuauugguaccagcagcucccugggaccacacccaagcugcuuaucuaucggaacaaucaacgcccuucuggcauucccgacagauucagcggauccaaaagcgggaccucugcuacacugggaaucaccggccuccagacaggcgaugaggccgacuacuauugugggaccugggauacgucccugagcaccggaggcguguuugggacaggaaccaaggugacaguccuu

SEQ ID NO: 40907 - RNA, 333 nt, Artificial Sequence
  derived and/or modified sequence opt5 from anti-HIV_048-096668_VR-Chain
cagagcgugcugacccaacccccuuccgucucugccgcuccgggccagaagguuacaaucagcugcuccgggucuggaagcaacauuggcaauaacuacguguccugguaucagcagcuccccgggacggccccuaaacugcuuaucuacaagaauaccgagagacccucuggcauuccugaccgguucagcggauccaaaagcgggacaucugcgacccuggauaucacaggacuccaaaccggcgacgaagcugauuauuacuguggcacaugggacaccucccugagcgccgggggaguguuuggcacggggaccaaggucacagugcuu

SEQ ID NO: 40908 - RNA, 333 nt, Artificial Sequence
  derived and/or modified sequence opt5 from anti-HIV_048-095236_VR-Chain
cagagcgugcugacccaacccccuuccgucucugccccgcccggccagaagguuacaaucagcugcuccgggacgaccucuaacauuggaagcaauuacguggcuugguaucagcagcucccuggcacagcccccaaacuggugaucuacgagaacuccaagagaccuucugggauucccgaccgguucagcggauccaaaagcggcaccucugcgacacuugggaucaccggacugcaaacaggcgaugaagcugacuauuacuguggcaccugggauacgucccucagcgccgggggagucuuuggcucugggaccaaggugacaguucug

SEQ ID NO: 40909 - RNA, 333 nt, Artificial Sequence
  derived and/or modified sequence opt5 from anti-HIV_048-094155_VR-Chain
cagagcgugcugacccaacccccuuccgucucugccgcuccgggccagaagguuacagugagcugcuccgggucuagcuccgacaucggagagaacuacgugucuugguaucagcaguuccccgaaacggccccuaaacuccugauuuacgauaauaacaagagacccagcggcaucccugaccgguuuuccgggagcaaaucuggaaccuccgcgacacuugcuauuaccggccugcaaacaggggaugaggccgacuauuacuguggaaccugggauagcucucucuccgccggcggcgucuucgggacaggaaccaaggugacgguucug

SEQ ID NO: 40910 - RNA, 333 nt, Artificial Sequence
  derived and/or modified sequence opt5 from anti-HIV_048-093219_VR-Chain
cagccccugcucacccaaccuccggccgugagcgcuacacccggccagagagucacgaucuccugcaccgggucuagcuccaacauuggacggacauucguuaauugguaccagcagcugccuggcaccgcccccaaacuucugaucuaugagaacucuaagcgcccuagcgggauucccgacagauuuuccggaucuaagagcggcacauccgcgacccucgggaucacaggacugcaaaccggcgaugaagcugacuacuauuguggcacgugggauaccagccuuucugccgggggaguguucggcuccgggacaaaagugaccguccug

SEQ ID NO: 40911 - RNA, 333 nt, Artificial Sequence
  derived and/or modified sequence opt5 from anti-HIV_048-092976_VR-Chain
cagagcgugcugacccaacccccuuccgucucugccgcuagcggccagaagguuacaaucuccugcucugggagcuccucuaacauuggaaauaacuacgugagcugguaucagcaccucccgggcacggcccccaaacugcuuaucuacaagaaugacaaaagaccuuccgggauucccgaucgguucagcggaucuaaguccggcaccagcgcgacacuggggaucaccggacuccagacaggcgacgaggcugauuauuacuguggcaccugggacacaucucuguccgccgggggaguguuuggcaccgggacgaaagucaccgugcuu

SEQ ID NO: 40912 - RNA, 333 nt, Artificial Sequence
  derived and/or modified sequence opt5 from anti-HIV_048-090866_VR-Chain
cagagcgugcugacccaacccccuuccgucucugccgcuccgggccagaagguuacaaucagcugcuccgggucuagaagcaacauuggauccaauuacaucucuugguaucagcagcuccccggcacggccccuaaacugcuuauuuacgacaacaauaagcggcccagcgggaucccugaucgcuucuccggaagcaaaucuggcaccuccgcgacacuggggauuaccggacuccaaacaggcgacgaggcuuauuacuauuguggcaccugggauacaagccugucugccgggggaguguuuggcuccgggaccaaggugacgguccuu

SEQ ID NO: 40913 - RNA, 333 nt, Artificial Sequence
  derived and/or modified sequence opt5 from anti-HIV_048-090650_VR-Chain
cagagcgcccugacccaacccgcuuccgugucuggcagccucgggcaguccaucacaauuucuugcagcggauccucuagcacgaucggcaacaauuacgucuccugguaucagguucugccuggggccgcgccgaaacuucugauuuguaagaacaaugagagacccagcggaaucccugaccgguucucuggcuccaagagcgggaccucugcuacacucggaauuaccggccugcagacaggcgaugaagccgacuacuauugcgggaccugggauacaucccuuagcgccggaggcguguuugggaccggaacgaaagugaccguccug

SEQ ID NO: 40914 - RNA, 333 nt, Artificial Sequence
  derived and/or modified sequence opt5 from anti-HIV_048-089009_VR-Chain
cagagcgugcugacccaacccccuuccgucucugccgcuccgggccagaagguuacaaucagcugcuccgggggaucuagcaacauuggcaauaacuacguguccugguaucagcagcuccccgagacggccccuaaacugaucauuuacgacaauaacaagagacccucugggauccacgaucgguucagcggauccaaaagcggcaccucugcgacacuugacauuaccgcucugcaaacaggggaugaagccgacuauuacuguggaaccugggauacaucccucagcgccggcggcguguuugggaccggaacgaaggucaccgugcug

SEQ ID NO: 40915 - RNA, 333 nt, Artificial Sequence
  derived and/or modified sequence opt5 from anti-HIV_048-088654_VR-Chain
cagagcgcccugacccaacccagauccgugucugcugccccuggccagaaggucagcaucuccugcucugggcggagcacaaaccucggauacaauuauguuuccugguaccagcaccuuccgggcgcggcucccaaagugcugauuuaugagaacaauaagcgcccuucugggauccccgacagauucagcggauccaaaagcggcacgucugccacccuggggauuacaggacuccagaccggcgaugaagccgacuacuauuguggcacaugggauaccucccugagcgcugggggaguguuuggcucugggacaaaggucaccgugcuu

SEQ ID NO: 40916 - RNA, 333 nt, Artificial Sequence
  derived and/or modified sequence opt5 from anti-HIV_048-086513_VR-Chain
cagagcgcccugacccaacccccuuccgugucugcugccccgggccagaaggucacaaucagcugcuccgggucuacgagcaacauuggaaauaacuacguuuccugguaucagcagcuccccggcaccgcgccuaaacugcuuaucuacaagaaugacaacagacccucugggauuccugaucgguucagcuccagcaaaucuggaacauccgcuacccugggcaucacagggcuccaaaccggagacgaggccgauuauuacuguggcauuugggacacaagccugucugccggcgggguguuuggaaccggcacgaaggugaccguccuu

SEQ ID NO: 40917 - RNA, 324 nt, Artificial Sequence
  derived and/or modified sequence opt5 from anti-HIV_048-086024_VR-Chain
cuggcccagcccccuagcguguccggcaccccggggcaaagagucacaaucucuugcagcggauccucuagcaacauuggcuccaaugcuguuaacugguaccagcaguuccccgggacggccccuaagcuccugaucuaugacaccgauaaacggcccucuggcauuccugaccgcuuuagcggauccaagagcgggacaucugcgauccuuggaauuaccggccugcagacaggcgaugaggcugacuacuauuguggggccugggauaccucccucagcgccggaggcguguucgggacaggaaccaaagugacgguccug

SEQ ID NO: 40918 - RNA, 333 nt, Artificial Sequence
  derived and/or modified sequence opt5 from anti-HIV_048-085857_VR-Chain
cagagcgcccugacccaacccagauccgugucuggcagccucgggcaguccgucacaaucucuugcacgggaaccacaagcgacguuggcuucgauuacguguccugguaucaggugcugccugggaccgcuccgaaacuucugauuuacaagaacgacaagcggcccucuggaaucccugaucgcuuuagcggcuccaaaagcgggacaucugccacccucggaauuacaggccugcagaccggcgacgaggcggauuauuacugugggacgugggacaccucccuuagcacaggaggcgucuucgggaccggaacaaaggugaccguucug

SEQ ID NO: 40919 - RNA, 333 nt, Artificial Sequence
  derived and/or modified sequence opt5 from anti-HIV_048-084277_VR-Chain
cagagcgugcugagacaacccccuucccucucuggcgccccggggcagcgggucacccugagcugcacaggauccucuagcaacaucggcggguacgacguucacugguaucagcaugugcccggaacggcuccuaaacuucugauuuacgagaauaccaagcgccccuccggcaucccugauagauucucugggagcaaguccggaacaagcgccacccucggcauuacaggccugcagaccggggacgaagcggauuauuacuguggaacaugggacaccucucuuuccgcuggcgggguguuuggaagcggcacgaaagucaccgugcug

SEQ ID NO: 40920 - RNA, 333 nt, Artificial Sequence
  derived and/or modified sequence opt5 from anti-HIV_048-084245_VR-Chain
cagagcacccugacacaacccccuuccgugucugccgcuccgggccagaaggucacgaucagcugcuccgggucuaacagcaauauuggaaaacacuacguuuccugguaucagcaguuccccggcgccgugccuaagcuccugaucuacgagaacaaaaagagacccucugggauuccugaccgguuuagcggauccaaaagcgauaccucugcgacacuugacaucaccggccugcaaacaggggaugaagcugacuauuacuguggaaccugggauacaucccucagcgccggcggcguguucgggucuggaaccaaggucacggugcug

SEQ ID NO: 40921 - RNA, 333 nt, Artificial Sequence
  derived and/or modified sequence opt5 from anti-HIV_048-082487_VR-Chain
cagagccugcucacccaacccccuuccgugucugccgcuccgggccagaaggucacaaucagcugcuccgggucuagcuccacgauuggaaacaauuacguuucuugguaucaggugcugcccggcgccgcgccuaaacuucugaucuguaagaacaaugagagacccagcgggauuccugaccgguucuccggaagcaaaucuggcaccuccgcuacacucgggaucaccggacugcagacaggcgaugaagccgacuacuauugcggcaccugggauacaagccuuucugccgggggaguguuuggcuccgggaccaaggucacggugcug

SEQ ID NO: 40922 - RNA, 333 nt, Artificial Sequence
  derived and/or modified sequence opt5 from anti-HIV_048-081787_VR-Chain
cagagcgugcugacccaacccccuuccgucucuggcgccccggggcagagaguuacaaucagcugcacgggauccucuagcaacauuggcuccuacgacgugcacugguaucagcagcuccccgggaccgcuccuaagcugcuuaucuacgaaaauucuaaacggcccagcggcauuccugaucgcuucuccggaagcaagucugggacauccgccacccugggaaucacaggccuccaaaccggcgacgaggcggauuauuacugugggacaugggacaccagccugucuggaggcgggguguuuggaacgggcaccaaagucacagugcuu

SEQ ID NO: 40923 - RNA, 333 nt, Artificial Sequence
  derived and/or modified sequence opt5 from anti-HIV_048-081062_VR-Chain
cagagcgugcugacccaacccccuuccgucucugccgcuccgggccagaagguuacaaucagcugcuccgggacgucuagcaacauuggagccaauuacguguccugguaucaacaggugcccggcaccgcgccuaaacuccugaucuacgagaacaauaagagacccucugggacaccugaccgguucagcggauccaaaagcggcaccucugcuacacuugggauuaccggacugcagacaggcgaugaagccgacuauuacuguggcaccugggauacgucccucagcgccgggggagucuuuggcucugggaccaaggugacaguucug

SEQ ID NO: 40924 - RNA, 333 nt, Artificial Sequence
  derived and/or modified sequence opt5 from anti-HIV_048-079639_VR-Chain
cagagcgugcugacccaacccccuuccgucucugccgcuccgggccagaagguuacaaucagcugcuccgggucuagcuccaacauuggcaaaaauuacgugucuugguaucagcaccuccccggaacggccccuaagcugcuuaucuacgagaacaauaaaagacccagcgggauuccugaccgguucuccggaagcaagucuggcaccgcggcuacacuggggaucaccggacuccagacaggcgaugaagccggcuauuacugugggaccugggacacaucccugagcgccggaggcguguuugggaccggaacgaaagucaccgugcuu

SEQ ID NO: 40925 - RNA, 333 nt, Artificial Sequence
  derived and/or modified sequence opt5 from anti-HIV_048-079126_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacgccucccaaacugcuuaucuucaagaauaacgagagaccuagcgggauucccgaccgguuuuccggaagcaaaucuggcaccuccgccacacuggggaucaccggacuccagacaggcgaugaagcggacuacuauuguggcaccugggauacaagccugucugcugggggaguguucggcaccgggacgaaggucaccgugcuu

SEQ ID NO: 40926 - RNA, 333 nt, Artificial Sequence
  derived and/or modified sequence opt5 from anti-HIV_048-073118_VR-Chain
cagagcgugcugacccaacccccuuccgucucugccgcuccgagacacaacguuacaaucagcugcuccggcgggucuagcaauauuggaaacaauuucguguccugguaccaguaucuccccggcacggccccuaagcugcuuaucuacgacaacaauaaacggcccucugggauuccugaucgcuuuagcggauccaagagcggcaccucugcgacacuggggaucaccggacuccagacaggcgacgaggcugauuauuacugugccaccugggacacaucccugagcgccggcgggguguucggaaccggcacgaaagucaccgugcuu

SEQ ID NO: 40927 - RNA, 333 nt, Artificial Sequence
  derived and/or modified sequence opt5 from anti-HIV_048-070264_VR-Chain
cagagcgugcugacccaaucccccucugucagcgccgcuccuggccagaagguuacaaucuccugcucugggacgagcuccaacauuggaaauaccuacgugucuugguaucagcagcucccgggcacagcccccaaacugcuuaucuacaagaacgacaaaagaccuagcgggauucccgaucgguucuccggaagcaagucuggcaccuccgcgacacuggggaucaccggacuccaaacaggcgacgaggcugauuauuacuguggcaccugggacagcucucuguccgccgggggaguguuuggcacggggaccaaagucacagugcuu

SEQ ID NO: 40928 - RNA, 333 nt, Artificial Sequence
  derived and/or modified sequence opt5 from anti-HIV_048-069426_VR-Chain
cagagcgugcugacccaacccccuuccgucucugccgcuccgggccagaagguuacaaucagcugcuccgggucuagcuccacgauuggaaacaauuacgugucuugguaucagcagcuccccggcaccgccccuaaacugcuuaucuacaagaacaauaaaagacccagcggggugccugaccgguucuccggaagcaagucuggcacauccgcgacccccgggauuacaggacugcaaaccggcgaugaggcugacuauuacuguggcacaugggauaccagccucucugccgggggagucuuuggcacggggaccaaagugacaguucug

SEQ ID NO: 40929 - RNA, 333 nt, Artificial Sequence
  derived and/or modified sequence opt5 from anti-HIV_048-068564_VR-Chain
cagagcgcccugacccaacccagauccgugucuggcagcccugggcaguccgucgcuaucucuugcacaggaacgagcuccgacguuggcuacaacuaugugucuugguaccaggugcucccggggaccgcccccaagcugcuuauuuauaaaaauaacgagcggccuagcggaauccccgaucgcuucuccggcagcaagucugggacauccgcgacccugggaauuacaggccuccagaccggcgacgaagcugauuacuauugugggacaugggacaccagccugucugccggaggcgucuuugggacgggaaccaaagugacaguucuu

SEQ ID NO: 40930 - RNA, 333 nt, Artificial Sequence
  derived and/or modified sequence opt5 from anti-HIV_048-068345_VR-Chain
cagagcgugcugacccaaacacccuccgucucugccgcuccuggccagagaguuacgaucagcugcuccgggucuaccagcaacauuggaaauaacuacguguccugguaucagcagcucccgggcacagcccccaagcugcuuaucuacgagaauaacaaacggccuucugggauucgcgacagauucagcgcguccaagagcggaaccucugcuacacugggcaucaccgggcuccaaacaggagaugaagccgacuauuacuguggcaccugggauacgucccugagcgccggcgggguguuuggaaccggcacaaaagucaccgugcuu

SEQ ID NO: 40931 - RNA, 333 nt, Artificial Sequence
  derived and/or modified sequence opt5 from anti-HIV_048-067337_VR-Chain
cagagcgugcugacccaacccccuuccgucucugccgcuccgggccagaagguuacaaucagcugcuccggggccucuuacaacauuggcaaaaauagcguguccugguaucagcagcuccccggaacggcgccuaagcugcuuaucuacaaaaacgacaagagacccucugggauuccugaucgguucagcggauccaaaagcggcgcuucugccacccuggacaucacagggcuccaaaccggagaugaggccgacuauuacuguggcauuugggauacaucccugagcgcuggcgggguguuuggaaccggcacaaaggucaccgugcuu

SEQ ID NO: 40932 - RNA, 333 nt, Artificial Sequence
  derived and/or modified sequence opt5 from anti-HIV_048-067180_VR-Chain
cagagcgugcugacccaacccccuuccgucucugccgcuccgggccagaagguuacaaucagcugcuccgggucuagccccaacauuggaaauaacuacguguccugguaucagagacucccuggcacggcccccaaacugcuuaucuacgagaaugaccagcggccuucugggauucccgaucgcaucagcggauccaagagcggcaccucugcgacacuggggauuaccggacuccaaacaggcgacgaagcugauuauuacuguggcaccugggacacaucccugagcaccgggggaguguucggcacggggaccaaagucacagugcuu

SEQ ID NO: 40933 - RNA, 333 nt, Artificial Sequence
  derived and/or modified sequence opt5 from anti-HIV_048-063017_VR-Chain
cagagcgugcugacccaacccccuuccgucucugccgcuccgggccagaagguuacaaucagcugcuccgggucuagcuccaacauuggaaauaacuacgugucuugguaucagcaccaucccggcaaagccccuaagcucaugaucuacgaggugagcaaaagacccuccgggauuccugaccgguucagcggaucuaaguccggcacgagcgcgacccuggggaucacaggacuucagaccggcgaugaagcugacuauuacuguggcacaugggauaccucucugaaucgcgggggagucuuuggcacagggaccaaagugacgguucuc

SEQ ID NO: 40934 - RNA, 333 nt, Artificial Sequence
  derived and/or modified sequence opt5 from anti-HIV_048-061885_VR-Chain
cagagcgugcugacccaacccccuuccgucucugccgcuccgggccagaagguuacaaucagcugcuccgggucuagcuccaacauuggaucucacuacaucagcugguaucagcaguuccccggcgccgcgccuaaacuccugauuuacgagaaugacaagagacccuccgggaucccugaucgguuuagcgcuucuaaauccggaacgagcgccacccuuggcauuacagggcugcaaaccggagacgaagccgauuauuacuguggcacaugggacaccucucucuccgcuggcgggguguucggaacaggcaccaaggugacgguccug

SEQ ID NO: 40935 - RNA, 333 nt, Artificial Sequence
  derived and/or modified sequence opt5 from anti-HIV_048-061671_VR-Chain
cagagcgugcugacccaacccccuuccgccucuggcacaccggggcagagagucacgaucagcugcuccggaucucggagcaacauuggcuccaauuacguuuauugguaccagcaguuccccgggaccgcuccuaagcuccugaucuaugagaacaauaaacgccccucuggcauuccugacagauuuagcggauccaagagcgggacaucugccacccuuggaaucacaggccugcaaaccggcgaugaagcggacuacuauugugcuacaugggauaccucccucagcgccgggggaguguucggcacggggaccaaagugacaguccug

SEQ ID NO: 40936 - RNA, 333 nt, Artificial Sequence
  derived and/or modified sequence opt5 from anti-HIV_048-060700_VR-Chain
cagagcgugcugacccaacuccccucccugucugccgcuccuggccagaaggucacaaucagcugcuccgggucuagcuccaacauuggaaauaacuacguuucuugguaucagcagcuuccgggcacggcccccaaacugcucaucuacgagaauaacaagagaccuagcgggauucccgaccgguucuccggaagcaaaucuggcaccuccgcgacacuggggaucaccggacuucaaacaggcgaugaagcugaguauuacugugccaccugggacgccagccugucuggcgggggaguguuuggcacagggaccaaggugacgguccuc

SEQ ID NO: 40937 - RNA, 333 nt, Artificial Sequence
  derived and/or modified sequence opt5 from anti-HIV_048-060592_VR-Chain
cagagcgugcugacccaacccccuuccgucucugccgcuccgggccagaagguuacaaucagcugcuccgggucuagcuccaacauuggcaaaaauuacgugucuugguaucagcaguuccccggaacggccccuaagcuccugaucuacgagaacaauaaaagacccagcgggauuccugaccgguuuuccgcgagcaagucugcuaccuccgccacacuugugaucaccggacugcaaacaggcgaugaagccgucuauuacugugggaccugggacacaagccucucugcuggaggcguguucggcuccgggaccaaaguuacggugcug

SEQ ID NO: 40938 - RNA, 333 nt, Artificial Sequence
  derived and/or modified sequence opt5 from anti-HIV_048-060300_VR-Chain
cagcccgugcugacccaaccuccgagcgccuccggcacacccgggcagagagucacgaucucuugcagcggauccucuagcaacauuggcaccaauacaguuaacugguaccagcaguucccugggaccgcucccaagcuccugaucuauaaaaauaacgagcggccuuccggcauucccgaccgcuuuucuggaagcaaguccgggacaagcgccacccuuggaaucacaggccugcaaaccggcgaugaagcggacuacuauugugggacgugggauaccucucucuccggaggcgggguguucggaacaggcaccaaagugacaguccug

SEQ ID NO: 40939 - RNA, 333 nt, Artificial Sequence
  derived and/or modified sequence opt5 from anti-HIV_048-059141_VR-Chain
cagcccgugcugacccaaccuccgagcgccuccggcacacccgggcagagagucucuaucagcugcuccggaaacuucucuaauauuggcagcaaguacguuuauugguaccagcagaucccugggacggcucccaacgugauuaucuaucggaccaaucuccgcccuuccggcauucccgacagauuuucugccagcaaauccggaacaagcgcgacccuggggaucacaggacuucaaaccggcgaugaggcugacuacuauuguggcacaugggauaccucucuguccgccgggggaguguucggcacggggaccaaggucacagugcuc

SEQ ID NO: 40940 - RNA, 333 nt, Artificial Sequence
  derived and/or modified sequence opt5 from anti-HIV_048-057777_VR-Chain
cagagcgugcugacccaacccccuucccucucugccgcuccgggccagagagucacaaucagcugcuccgggucuagcuccaacauuggaaauaacuacguuucuugguaucagcaguuccccggcacggccccuacccugcuuaucuacgagaaugacaagcggcccagcgggauuccugaucgcuuuuccgcgagcaaaucuggaacauccgcuacccugggcaucacagggcuccaagccggagacgaagccgauuauuacuguggcaccugggacacaagccugucugcuggcgggguguucggaaccggcacgaaggugaccguccuu

SEQ ID NO: 40941 - RNA, 333 nt, Artificial Sequence
  derived and/or modified sequence opt5 from anti-HIV_048-056928_VR-Chain
cagagcgugcugacccaacccccuuccgucucugccgcuccgggccagaagguuacaaucagcugcuccgggucuagcuccacgauuggaaacaauuacgugucuugguaucagcuccugcccggcaccgccccuaaacuucugaucuacgacaacgauaauagacccagcgacauuccugaucgguucuccgggagcaagucuggaacauccgcgacccucggcaucacagggcugcagaccggagacgaggcugauuauuacuguggcgccugggacacaagccuuucugccggcgggguguuuggaaccggcacgaaagucaccgugcug

SEQ ID NO: 40942 - RNA, 333 nt, Artificial Sequence
  derived and/or modified sequence opt5 from anti-HIV_048-056131_VR-Chain
caguucgugcugacccaacccgccagcgucuccggcucuccugggcagagcaucacaauuuccugcucuggaacgagcuccgacguuggcuacaacuaugugucuugguaccagcagcucccggggaccgcucccaagcugcuuaucuaugagaauacaaaaagaccuagcggcauucccgaucgguuuuccggaagcaagucugggaccuccgccacacugggaaucaccggccuccaaacaggcgacgaagcggauuacuauugugggaccugggacacgagccugucugcuggaggcguguucggguccggaaccaaagucacagugcuu

SEQ ID NO: 40943 - RNA, 333 nt, Artificial Sequence
  derived and/or modified sequence opt5 from anti-HIV_048-055864_VR-Chain
cagagcgugcugacccaacccccuuccgucucuguugccccgggccagaaggugacaaucuacugcagcggguccucuagcaacauuggcaaaaauuccgugucuugguauguccaggugcccggaacggcuccuaaguuccucaucuacgagaacaaucagagacccagcgggauuuccgaccgguuuagcggaucuaaauccggcaccagcgccacacuggggaucucuggacuucaaaccggcgaugaagcggacuauuacuguggcacaugggauaccucccugagcgggggaggcguuuucgggacaggaaccaaggugacgguccuc

SEQ ID NO: 40944 - RNA, 333 nt, Artificial Sequence
  derived and/or modified sequence opt5 from anti-HIV_048-055094_VR-Chain
cagagcgugcugacccaacccccuuccgucucuggcgccccggggcagagaguuacaaucagcugcuccgcuucuagcuccucuauuggaaacgacuucgugagcugguaccagcagcuccccggcacggccccuaagcugcuuaucuccgagaauaacaaacggcccagcgggauuccugaucgcuuuucuggauccaagagcggcaccucugcgacacuggggaucaccggacuccaaacaggcgacgaagcugauuauuacuguggcaccugggacuccagccugucugccgggggaguguucggcacagggaccaaagucacggugcuu

SEQ ID NO: 40945 - RNA, 333 nt, Artificial Sequence
  derived and/or modified sequence opt5 from anti-HIV_048-054343_VR-Chain
cagagcgugcugacccaacccccuuccgucucuggcgccccggggcagagaguuacaaucagcugcacgggauccucuagcaacauuggcggguacgacgugaauugguaucagcagcuccccggaaccgcuccuaagcugcuuaucuucaaaaacaaugagcggcccuccggcauuccugaucgcuuuucugggagcaaguccggaacaagcgccacccugggcaucacaggccuccaaaccggggacgaagcggauuacuauuguggaacaugggacaccucucuguccgcuggcgggguguucggaacgggcaccaaagucacagugcuu

SEQ ID NO: 40946 - RNA, 333 nt, Artificial Sequence
  derived and/or modified sequence opt5 from anti-HIV_048-054193_VR-Chain
cagagcgugcugacccaacccccuuccgucucugccgcuccgggccagaagguuacaaucagcugcuccgggggaucuagcaacauuggcaauaacuacguguccugguaucaccaggugcccgggacggccccuaaacuccugaucuucgagaauaacaagagacccucuggcauuccugaccgguuuagcggauccaaaagcgggaccucugcgacacuuggaaucaccggccugcagacaggcgaugaagcugacuacuauugugggaccugggauacaucccucagcggaggcggggucuucggaaccggcacgaaggugaccguucug

SEQ ID NO: 40947 - RNA, 333 nt, Artificial Sequence
  derived and/or modified sequence opt5 from anti-HIV_048-052521_VR-Chain
cagagcgugcugacccaacccccuuccgucucugccgcuccgggccagaagguuacaaucagcugcuccgggucuagcuccaacauuggaagacacucugugagcugguaccagcagcuccccggcacggccccuaaacugcuuaucuaugacaccgauaagcggcccuccgggauuccugaccgcuucagcggaucuaaauccggcacaagcgcgacccuggggaucacaggacuccaaaccggcgaugaggcugacuacuauuguggcacaugggauaccucucuguccgggggaggcguguuugggacgggaaccaaggucacagugcuu

SEQ ID NO: 40948 - RNA, 333 nt, Artificial Sequence
  derived and/or modified sequence opt5 from anti-HIV_048-049037_VR-Chain
cagagcgugcugacccaacccccuuccgucucugccgcuccgggccagaagguuacaaucagcugcuccgggucuagcuucaacauuggaaauaacuacguguccugguaucagcaccuccccggcacggccccuaaacugcuuaucuacgcggcugugaccagacccucugggauuccugaccgguuuagcggauccaagagcggcacaucugccacccuggauaucacagggcuccagaccggagacgaggccgauuauuacuguggcacaugggacaccucccugagcgcuggcggggucuucggaacgggcaccaaagugacaguucuu

SEQ ID NO: 40949 - RNA, 333 nt, Artificial Sequence
  derived and/or modified sequence opt5 from anti-HIV_048-048720_VR-Chain
cagagcgugcugacccaacccccugccgucuccgcugccccgggccagagaguugcgaucucuugcagcgggacauccucuaacauuggaagcaaucucguguccugguaccagcagcugcccggcaaggcuccucggcuucugaucuaugacaacuacaaacgccccucugggauuccugauagauucagcggauccaagagcggcacgucugccacccucgggaucacaggacugcaaaccggcgacgaggccgauuauuacuguggcacaugggacaccucccuuagcacagggggaguguuuggcaccgggacgaaagucaccgugcug

SEQ ID NO: 40950 - RNA, 333 nt, Artificial Sequence
  derived and/or modified sequence opt5 from anti-HIV_048-048542_VR-Chain
cagagcgugcugacccaacccccuuccgucucugccgcuccgggccagaagguuacaaucagcugcuccgggucuagcuccaacauuggaaauaacuucgugucuugguaccagcagcuccccggcacggccccuaaacugcuuaucuauaauaacgacagacggcccagcggggugccugaucgcuuuuccgcgagcaaguucggaaccgcugccacacugggcauuaccgggcuccaaacaggagacgaggccgauuacuauuguggcaccugggacucuucccugagcgcuggcggggucuuuggaacaggcaccaaagugacgguucuu

SEQ ID NO: 40951 - RNA, 333 nt, Artificial Sequence
  derived and/or modified sequence opt5 from anti-HIV_048-047777_VR-Chain
cagagcgugcugacccaacccccuuccgccucuggcacaccggggcagagagucacgaucagcugcuccggaucuagcgcuaacauuggcaccaauuacguuuucugguaucagcaccuccccgggacagccccuaagcugcuuaucuacgagaacaauaaacggcccuccggcauuccugaccgcuuuucuggaagcaaguccgggaccagcgcgacacugggaaucaccggccuccagacaggcgaugaagcugacuauuacugugggaccugggauucuucccugagcgccggaggcguguucgggacgggaaccaaagugacaguccuu

SEQ ID NO: 40952 - RNA, 333 nt, Artificial Sequence
  derived and/or modified sequence opt5 from anti-HIV_048-046841_VR-Chain
cagagcgugcugacccaacccccuuccgucucugccgcucucggccagaagguuacaaucacgugcagcggggacaacggaaauauuggcuaccacuauguguccugguaccaacagguggggagagccgcgccgaaacugcuuaucuaugcuaacaauaagcggcccucuggcauuccugaucgcuucagcggauccaaaucugggaccagcgccacacugggaaucaccggccuccagacaggcgacgaggccgauuacuauugugggaccugggacacaucccugagcgcuggaggcgucuuugggucuggaaccaaggugacgguucuu

SEQ ID NO: 40953 - RNA, 333 nt, Artificial Sequence
  derived and/or modified sequence opt5 from anti-HIV_048-046202_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacggccccuaaacugcuuaucuacgacaccuauaagagacauagcggggugcccgaucgguucuccaauagcaaaucuggaacauccgcgacccuggcuauuacaggccuccagaccggggacgagggagauuacuauuguggcgccugggacacaagccugucugccggcggggucuuuggaaccggcacgaaggugaccguucuu

SEQ ID NO: 40954 - RNA, 333 nt, Artificial Sequence
  derived and/or modified sequence opt5 from anti-HIV_048-046059_VR-Chain
cagagcgugcugacccaacccccuuccgucucugccgcuccgggccagaacguuacaaucagcugcuccgggacgucuagcaauauugagaacaauuacguguccugguaucagacccuccccggaacagccccuaagcugcuuaucuacgacaacaauaaaagacccucuggcauuccugaucgguucagcggguccaagagcggaaccucugcgacacugggcaucaccgggcuccagacaggagacgaagcugauuauuacuguggcaccugggacuccagccugucugccggcgggguguuuggaacgggcaccaaagucacagugcuu

SEQ ID NO: 40955 - RNA, 333 nt, Artificial Sequence
  derived and/or modified sequence opt5 from anti-HIV_048-043568_VR-Chain
cagagcgugcugacccaacccccuuccgucucugccgcuccgggccagaagguuacaaucagcugcuccgggucugacagcaacauuggauccaauuacgugucuugguaucagcagcuccccggcgccgcgccuaaacugcuuaucuacaagaacaauaacagacccagcgggauuccugaucgguucuccggaagcaaaucuggcacguccgcuacccuggggaucagcggacuccaaacaggcgacgaggccgauuauuacuguggcaccugggacacaucucuguccgggggaggcguguuugggaccggaacaaaggucaccgugcuu

SEQ ID NO: 40956 - RNA, 333 nt, Artificial Sequence
  derived and/or modified sequence opt5 from anti-HIV_048-042713_VR-Chain
cagagcgugcugacccaacccccuuccgucucugccgcuccgggccagaagguuacaaucagcugcuccgggucuagcuccaacauuggaagacacuacgugucuugguaucagcagcuccccggcacggccccuaaacugcuuaucuacgacaauaacagccggcccuccgggauuccugaucgcuucagcggaucuaaguccggcaccagcgcgacacuggggaucaccggacuccaaacaggcgacgaggcugauuauuacuguggcaccugggacacaucucugaauagagggggaguguuuggcaccgggacgaaagucaccgugcuu

SEQ ID NO: 40957 - RNA, 333 nt, Artificial Sequence
  derived and/or modified sequence opt5 from anti-HIV_048-042440_VR-Chain
cagagcgugcugacccaacccccuuccgccucuggcacaccggggcagagagucacgaucagcugcuccggaucuagcuccaacauuggcaccaauacaguuaacugguaccagcagcuccccgggaccgcuccuaagcugcuuaucuaugaaaauucuaaacggcccagcggcauuccugaccgcuucuccggaagcaagucugggacauccgccacccugggaaucacaggccuccaaaccggcgaugaggcggacuacuauugugggacgugggauaccagccugucugcuggaggcguguuuggguccggaacaaaagugaccguccuu

SEQ ID NO: 40958 - RNA, 333 nt, Artificial Sequence
  derived and/or modified sequence opt5 from anti-HIV_048-040511_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacggccccuaaacugcuuaucuacgagaauaacaagagaagcuccgggauucccgaacgguucagcggaucucaguccggcaccagcgcgacacuggggaucaccggacuccaaacaggcgacgaggcugauuauuacuguggcaccugggacacaucucuguccaccgggggaguguuuggcacggggaccaaagucacagugcuu

SEQ ID NO: 40959 - RNA, 333 nt, Artificial Sequence
  derived and/or modified sequence opt5 from anti-HIV_048-039195_VR-Chain
cagagcgugcugacccaacccccuuccgucucugccgcuccgggccagagaguuacaaucagcugcuccgggucuacgagcaacauuggaaaucacuacguguccugguaucagcagcuccccggcaccgccccuaagcugcuuaucuacgacaacgggaaucggcccucuggcauuccugaucgcuucagcggauccaaaagcgggacaucugcgacccuggacaucacaggacuccaaaccggcgaugaggcugacuauuacuguggcacaugggauaccucccugaacagagggggaguguuuggcacggggaccaaggucacagugcuu

SEQ ID NO: 40960 - RNA, 333 nt, Artificial Sequence
  derived and/or modified sequence opt5 from anti-HIV_048-036935_VR-Chain
cagagcgugcugacccaacccccuuccaugucugccgcuccgggcgagagagucacaaucagcugcacgggguccucuagcaacauuggaggcuacgacguucacugguaucagcagcuccccgggaucgccccuaagauucugaucuaccgcaauuccauucggcccucuggaaucccugauagauucagcggcuccaaaagcgggaccucugcgacacuuggaaucaccggccugcagacaggcgacgaagcugauuauuacugugggaccugggacacaucccucagcaccggaggcguguuugggacgggaaccaaggugacaguccug

SEQ ID NO: 40961 - RNA, 333 nt, Artificial Sequence
  derived and/or modified sequence opt5 from anti-HIV_048-034478_VR-Chain
cagagcgugcugacccaacccccuuccgucucugccgcuccgggccagaagguuacaaucagcugcacgggguccggaucuaacauuggcaauaacgacgugagcugguaccagcagcuccccgggaccgccccuagacugcuuaucuauggagauaauaaacggcccuccggcauuccugaccgcuucucugggagcaaguccggaacaagcgcgacccugggcaucacaggccuccaaaccggggaugaggcugacuacuauuguggaacaugggauaccucucuguccgccggcgggguguuuggaacgggcaccaaagucacagugcuu

SEQ ID NO: 40962 - RNA, 333 nt, Artificial Sequence
  derived and/or modified sequence opt5 from anti-HIV_048-031641_VR-Chain
cagagcgugcugacccaacccccuuccgucucugccgcuccgggccagaagguuacaaucagcugcuccgggaacaauucuaacauuggaaauaacuacgugagcugguaucagcagcuccccggcacggccccuaaacugcuuaucuacgaaaauuccaagagacccucugggauuccugaccgguucagcggauccaaaagcggcaccucugcgacacuggggaucaccggacuccaaacaggcgaugaggcugacuauuacuguggcaccugggauacaucccugagcgccgggggaguguuuggcucugggaccaaggucacggugcuu

SEQ ID NO: 40963 - RNA, 333 nt, Artificial Sequence
  derived and/or modified sequence opt5 from anti-HIV_048-029760_VR-Chain
cagagcgcccugacccaacccgcuuccgugucuggcagcuccgggcagucuaucacaauuagcugcacgggaaccaacuccgacgucggcuacgauuauguuuguugguaccagcagcucccugggacagccccgaagcugcuuaucuaugagaauaacaaaagacccucuggcauuccugaccgguucagcggauccaagagcgggaccucugcgacacugggaaucaccggccuccaaacaggcgaugaagcugacuacuauugcgggaccugggauacgucccugagcgccggaggcguguuugggaccggaacaaaagugaccguccuu

SEQ ID NO: 40964 - RNA, 333 nt, Artificial Sequence
  derived and/or modified sequence opt5 from anti-HIV_048-027970_VR-Chain
cagagcgugcugacccaacccccuuccgucucugccccgcccggccagaagguuacaaucagcugcuccgggacgaccucuaacauuggaagcaauuacguggcuugguaucagcaguucccuggcacagcccccaaacuccugaucuacgagaacaauaagagaccuuccgggauucccgaccgguuuucuggaagcaaauccggcaccagcgcgacacuugggaucaccggacugcaaacaggcgaugaagcugacuauuacugugccaccugggauacgucucucuccgccggcgggguguucggaaccggcacaaaggucaccgugcug

SEQ ID NO: 40965 - RNA, 333 nt, Artificial Sequence
  derived and/or modified sequence opt5 from anti-HIV_048-027337_VR-Chain
cagagcgugcugacccaacccccuuccgucucugccgcuccgggccagaagguuacaaucagcugcuccgggucuuacagcaacauuggaaauaacuaucucuccugguaccagcagcugcccggcacggccccuaaacuucugaucuauaagaauaacaaaagacccucuggggugccugaccgguucagcggauccaagagcggcgcgucugcuacccucgauauuacagggcugcaaaccggagacgaggccgauuacuauuguggcaucugggacacaucccuuagcgccggcgggguguuuggaaccggcacaaaagucaccgugcug

SEQ ID NO: 40966 - RNA, 333 nt, Artificial Sequence
  derived and/or modified sequence opt5 from anti-HIV_048-027217_VR-Chain
cagagcgugcugacccaacccccuuccgucucugccgcuccgggccagaagguuacaaucagcugcuccgggucuagcuccauuaucggaaacaauuacgugucuugguaucagcagcuccccggcacggccccuaaacugcuuauuuacgagaacaauaagagacccagcgggaucccugaccgguucuccggaagcaaaucuggcaccuccgcgacacuggcuauugccgggcuccaaaccggagaugaagccgacuauuacugugcuacaugggauaccagccugucugccggcggcguguuugggacaggaaccaaggucacggugcuu

SEQ ID NO: 40967 - RNA, 333 nt, Artificial Sequence
  derived and/or modified sequence opt5 from anti-HIV_048-026760_VR-Chain
cagagcgugcugacccaacccccuuccgucucugccgcuccgggccagaagguuacaaucagcugcuccgggucuagcuccaacauuggaaauaacuacgugucuugguaucagcaccuccccggcacggccccuaaacugcuuaucuacgacaccgugaagagacauagcgggguccccgaucgguucuccggaagcaaaucuggcacauccgcgacccuggggauuagcggacuccagacaggcgacgaggcugauuauuacuguggcaccugggacacaucucuguccgccgggggaguguuuggcagcgggaccaagguuacggugcuu

SEQ ID NO: 40968 - RNA, 333 nt, Artificial Sequence
  derived and/or modified sequence opt5 from anti-HIV_048-024800_VR-Chain
cagagcgugcugacccaacccccuuccgucucugccgcuccgggccagaagguuacaaucagcugcuccgggucuuacagcaacauuggaaauaacuauguguccugguaccaggugcuccccggcacggccccuaaacugcuuaucuauaagaauaacgagagacccucugggauuccugaccgguucagcggauccaaaagcggcaccucugcgacacuggggaucaccggacuccagacaggcgaugaagcugacuacuauuguggcaccugggauacaucccugagcgccgggggagucuuuggcaccgggacgaaggugaccguucuu

SEQ ID NO: 40969 - RNA, 333 nt, Artificial Sequence
  derived and/or modified sequence opt5 from anti-HIV_048-024313_VR-Chain
cagagcgugcugacccaacccccuuccgucucugccgcuccgggccagaagguuacaaucagcugcuccgggucuagcuccacgauuggaaacucucacgugagcugguaccagauccuccccggcaccgccccuaaacugcuuauuuauaaggacgauaaaagacccuccgggaucccugaccgguucagcggaucuaaguccggcacaagcgcgacccuggggauuacaggacuccagaccggcgaugaggcugacuacuauuguggcacaugggauaccucucugaaucgcgggggaguguuuggcacggggaccaaagucacagugcuu

SEQ ID NO: 40970 - RNA, 333 nt, Artificial Sequence
  derived and/or modified sequence opt5 from anti-HIV_048-021748_VR-Chain
cagagcgugcugacccaacccccuuccgucucugccgcuccgggccagagaguuacaaucagcugcuccgggucuacgagcaacauuggaaauaacuacguguccugguaucagcagcuccccggcaccgccccuaagcugcuuaucuacgagaauaacaaacggcccucugggauuccugaccgcuucagcggauccaagagcggcacaucugcgacccuggggaucuccggacuccaaacaggcgaugaagcugacuauuacuguggcaccugggauagcucucuguccgggggaggcguguuugggacaggaaccaaagucacggugcuu

SEQ ID NO: 40971 - RNA, 333 nt, Artificial Sequence
  derived and/or modified sequence opt5 from anti-HIV_048-020991_VR-Chain
cagagcgugcugacccaacccccuuccgccucuggcacaccggggcagaaggucacgaucagcugcuccggaucuagcuccaccauuggcaacaauuacguuucuugguaucaggugcuccccgggacagcuccuaaacugcuuaucuacaagaacgacaaaagacccagcggcauuccugaucgguucuccggaagcaagucugggaccuccgccacacugggaaucaccggccuccagacaggcgacgaggcggauuauuacugugggaccugggacacgagccugucuaccggaggcguguuugggacaggaaccaaagucacagugcuu

SEQ ID NO: 40972 - RNA, 333 nt, Artificial Sequence
  derived and/or modified sequence opt5 from anti-HIV_048-020340_VR-Chain
cagagcgugcugacccaacccccuuccgucucugccgcuccgggccagagaguuacaaucagcugcuccgggucuagcuccaacgugggaaauaacuacgugucuugguaucagcagcuccccggcacggccccuaagcugcuuauuuacgagaauaacaaacggcccagcgggaucccugaccgcuucuccggaagcaagucuggcaccuccgcgacacuggggauuaccggacuccaaacaggcgaugaagcugacuauuacuguggcaccugggaugccagccugucugccgggggagucuuuggcacagggaccaaagugacgguucuu

SEQ ID NO: 40973 - RNA, 333 nt, Artificial Sequence
  derived and/or modified sequence opt5 from anti-HIV_048-019993_VR-Chain
cagagcgugcugacccaacccccuuccgucucuggcgccccggggcagagaguuacaaucagcugcacgggauccucuagcuccauuggcggguucgacgugcacugguaccagcggcuccccggaaccgcuccucgccugcuuaucuaugagaacaauaagagacccucuggcauuccugaucgguuuagcggguccaaaagcggaacaucugccacccugggcaucacaggccuccagaccggggacgaagcggauuacuauuguggaacaugggacuccagccugucugcuggcgggguguucggaaccggcacgaaggucaccgugcuu

SEQ ID NO: 40974 - RNA, 333 nt, Artificial Sequence
  derived and/or modified sequence opt5 from anti-HIV_048-019947_VR-Chain
cagagcgugcugacccaacccccuuccgucucugccgcuccgggccagagaguuacaaucagcugcuccgggucuagcuccaacauuggaucuaaguacgugagcugguaucagcagcuccccggcacggccccuaaacugcuuaucuacgaaaauuccaagcggcccagcgggauuccugaccgcuucucuggauccaaaagcggcaccucugcgacacuggggaucaccggacuccaaacaggcgaugaggcugacuauuacuguggcaccugggauacaucccugagcaccgggggaguguuuggcacggggaccaaggucacagugcuu

SEQ ID NO: 40975 - RNA, 333 nt, Artificial Sequence
  derived and/or modified sequence opt5 from anti-HIV_048-017871_VR-Chain
cagagcgugcugacccaacccccuuccgucucugccgcuccgggccagaagguuacaaucagcugcuccgggucuagcuccaacauuggaaauagauacgugucuugguaucagcagcuccccggcacggccccuaaacugcuuaucuacaagaacaauaaacggcccagcgggauuccugaccgcuucuccggaagcaagucuggcaccuccgcgacacuggggaucaccggacuccaaacaggcgaugaggcugacuauuacuguggcaccugggaugggagccugucuacaggaggcgugauugggaccggaacgaaagucaccgugcuu

SEQ ID NO: 40976 - RNA, 333 nt, Artificial Sequence
  derived and/or modified sequence opt5 from anti-HIV_048-015931_VR-Chain
cagagcgugcugacccaacccccuuccgucucugccgcuccgggccagaagguuacaaucagcugcuccgggggaucuagcaacauuggcuccacguacgugucuugguaucaacaggugcccgggaccgccccuaaacuccugaucuacgagaauaacaagagacccagcggcauuccugaccgguucuccggaagcaaaucugggacauccgcgacccuugauaucacaggacugcagaccggcgacgaagcugauuauuacuguggcacaugggacaccagccucucugggggaggcgucuuugggacgggaaccaaggugacaguucug

SEQ ID NO: 40977 - RNA, 333 nt, Artificial Sequence
  derived and/or modified sequence opt5 from anti-HIV_048-015920_VR-Chain
cagagccugcucacccaacccccuuccgugucugccgcuccgggccagaaggucacaaucagcugcuccgggucuagcuccacgauuggaaacaauuacguuucuugguaucaggugcugcccggcaccgccccuaaacuucugaucuacaagaacaaugagagacccagcgggauuccugaccgguucuccggaagcaaaucuggcacauccgcgacccucgggaucacaggacugcagaccggcgaugaagcugaguauuacugugccacaugggacgccagccuuucuggcgggggaguguuuggcaccgggacgaaggucaccgugcug

SEQ ID NO: 40978 - RNA, 333 nt, Artificial Sequence
  derived and/or modified sequence opt5 from anti-HIV_048-013898_VR-Chain
cagagcgugcugacccaacccccuuccgucucugccgcuccgggccagaagguuacaaucagcugcuccgggucuagcuccaacauuggaaaacacucugugagcugguaccagcagcuccccggcacggccccugagcugcuuaucuaugacaauaacaauagacccuccgggauuccugaucgguucagcggaucuaaguccggcaccagcgcgacacuggggaucaccggacuccaaacaggcgacgaagcugauuacuauuguggcaccugggacacaucucuguccgccgggggaguguuuggcaccgggacgaaagucaccgugcuu

SEQ ID NO: 40979 - RNA, 333 nt, Artificial Sequence
  derived and/or modified sequence opt5 from anti-HIV_048-013429_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuacccugcuuaucuacgagaaugacaaaagacccagcgggauuccugaucgguucuccggaagcaagucuggcacauccgcgacccuggggaucacaggacuccaaaccggcgacgaagcugauuauuacuguggcacaugggacagcucucuguccgccgggggaguguuuggcaccgggacgaaagucaccgugcuu

SEQ ID NO: 40980 - RNA, 333 nt, Artificial Sequence
  derived and/or modified sequence opt5 from anti-HIV_048-012358_VR-Chain
cagagcgugcugacccaacccccuuccgucucugccgcuccgggccagaagguuacaaucagcugcuccgggucuaacagcgccauuggaaauaacuacguguccugguaucaggugcuccccggcacggcgccuaaacugcuuaucuacaagaauaacgagagacccucugggauuccugaccgguucagcggauccaaaagcggcaccucugcuacacuggauaucaccgggcuccagacaggagacgaagccgauuauuacuguggcaccugggacacaucccugagcgccggcggggucuuuggaaccggcacgaaggugaccguucuu

SEQ ID NO: 40981 - RNA, 333 nt, Artificial Sequence
  derived and/or modified sequence opt5 from anti-HIV_048-011158_VR-Chain
cagagcgugcugacccaacccccuuccgucucugccgcuccgggccagaagguuacaaucagcugcuccgggauuucuagcaacaucggaaauaacgacguguccugguaccagcagcuccccggcacggccccuaaacugcuuauuuaugauaaugacaagagacccucugggaucccugaucgguucagcggauccaaaagcggcaccucugcgacacuggggauuaccggacuccaaacaggcgacgaggcugauuacuauuguggcaccugggacuccagccugucugccgggggaguguuuggcacagggaccaaggucacggugcuu

SEQ ID NO: 40982 - RNA, 333 nt, Artificial Sequence
  derived and/or modified sequence opt5 from anti-HIV_048-010720_VR-Chain
cagagcgugcugacccaacccccuuccgucucugccgcuccgggccagaagguuacaaucagcugcuccgggucuagcuccaacauuggaucucacuacgugagcugguaucaacaggugcccggcacggccccuagacucgucaucuacgaaaauuccaaacggcccagcgggauuccugaccgcuucucuggauccaagagcggcaccucugcgacacuggggaucaccggacuucagacaggcgaugaggcugacuauuacuguggcaccugggauacaucccugagcgccgggggaguguuuggcucugggaccaaaguuacggugcuc

SEQ ID NO: 40983 - RNA, 333 nt, Artificial Sequence
  derived and/or modified sequence opt5 from anti-HIV_048-009445_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggugccuaaacugcuuaucuacgacaccuauacaagacccagcgggaccccugaucgguucuccggaagcaagucuggcacauccgccacccuggcgauuacagggcuccaaaccggagacgaggcugauuacuauuguggcacgugggacggcagccugucuaccgggggagucaucggcacagggaccaaagugacaguucuu

SEQ ID NO: 40984 - RNA, 324 nt, Artificial Sequence
  derived and/or modified sequence opt5 from anti-HIV_048-006126_VR-Chain
cagagcgugcugacccaacccccuuccgucucuggcgccccggggcagaagguuacaaucagcugcuccggaauuucuagcaacuucggcaucuccugguaccaacaggugcccgggacggcuccuaaacuccugauuuaugagaaugacaagagacccucuggaaucccugaucgguuuagcggcuccaaaagcgggaccucugccacacuuggaauuaccggccugcagacaggcgacgaagcggauuacuauugugggaccugggacacaucccucagcgcuggaggcguguucgggaccggaacgaaggucaccgugcug

SEQ ID NO: 40985 - RNA, 333 nt, Artificial Sequence
  derived and/or modified sequence opt5 from anti-HIV_048-005652_VR-Chain
cagagcgugcugacccaacccccuuccgucucugccgcuccgggccagaagguuacaaucagcugcuccgggucuaacagcgccauuggaaauaacuacguguccugguaucaggugcuccccggcacggcgccuaaacugcuuaucuacgacaccuauaagagagcuucugggauucccgaucgguucagcggauccaaaagcggcacaucugccacccuggggaucacaggacuccagaccggcgacgaggccgauuacuauuguggcacaugggacaccucccugagcgggggaggcgucuuugggacgggaaccaaggugacaguucuu

SEQ ID NO: 40986 - RNA, 333 nt, Artificial Sequence
  derived and/or modified sequence opt5 from anti-HIV_048-005532_VR-Chain
cagagcgugcugacccaacccccuuccgucucugccgcuccgggccagaagguuacaaucagcugcuccgggacgucuagcaacauuggaaauaccuacguguccugguaucagcagcuccccggcacagccccuaacuaccugaucuauaaaauugacaagagacccucugggaucccugaucgguucagcggauccaaaagcggcaccucugcgacacuugggauuaccggacugcaaacaggcgacgaggcugauuacuauuguggcaccugggacacgucccucagcgccgggggaguguuuggcaccgggacaaaggucaccgugcug

SEQ ID NO: 40987 - RNA, 333 nt, Artificial Sequence
  derived and/or modified sequence opt5 from anti-HIV_048-005189_VR-Chain
cagagcgugcugacccaacccccuuccgucucugccgcuccgggccagaagguuacaaucagcugcuccgggucuggaagcacgauuggcaacaaugacguguccugguaccagcagcuccccggggccgcgccuaaacugcuuaucuaugaggauaacaagagacccucuggcauuccugcucgguucagcggauccaaaagcgggaccucugccacacugcgcaucaccggacuccaaacaggcgacgaagccgauuacuauuguggcaccugggacuccagccugucugcugggggaguguuuggcacagggaccagagucuccgugcuu

SEQ ID NO: 40988 - RNA, 333 nt, Artificial Sequence
  derived and/or modified sequence opt5 from anti-HIV_048-005088_VR-Chain
cagagcgugcugacccaacccccuuccgucucugccgcuccgggccagaagguuacaaucagcugcuccgggucuagcuccaacauuggcaaaaauuacgugucuugguaucagcagcuccccggaacggccccuaagcugcuuaucuacgacaacaauaacagacccagcgggauuccugaucgguucuccggaagcaaaucuggcaccuccgcgacacuggggaucaccggacuccaaacaggcgacgaggcugauuauuacuguggcgccugggacaccagccugucugccgggggaguguuuggcacagggaccaaggucacggugcuu

SEQ ID NO: 40989 - RNA, 333 nt, Artificial Sequence
  derived and/or modified sequence opt5 from anti-HIV_048-004023_VR-Chain
cagagcgugcugacccaacccccuuccgucucugccacaccgggccagaagguuacgaucagcugcuccgggggaucuagcaacauuggcaaaaaugacguguccugguaccagcagcuccccgggaccgcuccuaagcugcuuaucuaugauacaaacaaaagacccucuggcauuccugaccgguucagcgccgcgcgcuccggaaccagcgcuacacuggauaucaccgggcuccaaacaggagacgaggccgauuacuauuguggcaccugggacacgucucuguccgccggcgggguguuuggaaccggcacaaaggucaccgugcuu

SEQ ID NO: 40990 - RNA, 333 nt, Artificial Sequence
  derived and/or modified sequence opt5 from anti-HIV_048-001580_VR-Chain
cagagcgugcugacccaacccccuuccgucucugccgcuccgggccagaagguuacaaucagcugcuccgggucuagcuccaacauuggaaauaacuacgugucuugguaucagcagcuccccggcacggccccuaaacugcuucuguacgagaauaacaagagacccagcgggaucccugaccgguucuccggaagcaaaucuggcaccuccgcgacacucgcuauuaccgggcugcaaacaggagaugaagccgccuauuacuguggcaccugggacggcagccuuucuacagggggagugaucggcaccgggacgaaggucaccgugcug

SEQ ID NO: 40991 - RNA, 333 nt, Artificial Sequence
  derived and/or modified sequence opt5 from anti-HIV_038-221120_VR-Chain
cagagcgugcugacccaacccccuuccgucucugccgcuccgggccagaagguuacaaucagcugcuccgggucuacgagcaacauuggcaaaaauuacguguccugguaucagcagcuccccggaaccgccccuaagcugcuuaucuacgacaacaaugagagacccucugggauuccugaucgguucagcggauccaaaagcggcacaucugcgacccuggggaucacaggacuccaaaccggcgacgaagcugauuauuacugugccacaugggacuccagccugucuggcgggggaguguuuggcaccgggacgcgcgucaccgugcuu

SEQ ID NO: 40992 - RNA, 333 nt, Artificial Sequence
  derived and/or modified sequence opt5 from anti-HIV_038-197677_VR-Chain
cagagcgugcugacccaacccccuuccgucucugccgcuccgggccagaagguuacagugagcugcuccgggucuaacagcaauaucggaaaccacuacguguccugguaucagcagcuccccggcacggccccuaaacugcuuauuuacgacaauaacaagagacccucugggaucccugaucgguucagcggauccaaaagcggcaccucugcgacacuggggauuaccggacuccaaacaggcgacgaggcugauuauuacuguggcaccugggacuccagccugucugccgggggagucuuuggcacagggaccaaggugacgguucuu

SEQ ID NO: 40993 - RNA, 333 nt, Artificial Sequence
  derived and/or modified sequence opt5 from anti-HIV_038-196765_VR-Chain
cagagcgcccugacccaacccgcuuccgugucuggcagcccugggcaguccaucacaauuucuugcacgggaaccagcggcgacgucggguacaaccucguuuccugguaucagcagcugccgggaacagcccccaaggugcuuaucuacgagaauaacaaaagaccuucuggcauucccgaucgguucagcggguccaagagcggaaccucugcgacacugggcaucaccggccuccaaacaggggacgaagcugauuauuacuguggaaccugggacuccagccugucugccggcgggguguuuggaacgggcaccaaagucacagugcuu

SEQ ID NO: 40994 - RNA, 333 nt, Artificial Sequence
  derived and/or modified sequence opt5 from anti-HIV_038-186200_VR-Chain
cagagcgugcugacccaacccccuuccgccucuggcacaccggggcagagaaucacgauuagcugcuccggaaccucuagcaacaucggcuccaauauugucucuugguaccagcaccuccccgggacaaccccuaagcugguuaucuuccggaacaaucagcgccccagcggcauuccugacagauuuuccggaagcaaaucugggacauccgcuacccuuggaaucacaggccugcaaaccggcgaugaggccgacuauuacugugggacgugggauagcucucucuccgcgggaggcguguucgggaccggaacaaaggugaccguccug

SEQ ID NO: 40995 - RNA, 333 nt, Artificial Sequence
  derived and/or modified sequence opt5 from anti-HIV_038-126170_VR-Chain
cagagcgugcugacccaacccccuuccgucucugccccgcccggccagaagguuacaaucagcugcuccgggacgaccucuaacauuggaagcaauuacguggcuugguaucagcagcucccuggcacagcccccaaacugcuuaucuacgacaacgugaagagaccuaccaauauucccgaucgguucuccgggucuaaaagcggaacauccgcgacccugggcaucacagggcuccaaaccggagacgaggcugauuauuacuguggcacgugggacagcucucuguccgccggcggggucuuuggaaccggcacaaaggugaccguucuu

SEQ ID NO: 40996 - RNA, 333 nt, Artificial Sequence
  derived and/or modified sequence opt5 from anti-HIV_038-108545_VR-Chain
cagagcgugcugacccaacccccuuccgccucuggcacaccggggcagagagucacgaucagcugcuccggaucuagcuccaacauuggcuacaauaccguuucuugguaucagcagcuccccgggacagcuccuaagcugcuuaucuacgagaacaauaaacggcccagcggcauuccugaccgcuucuccggaagcaagucugggaccuccgccacacugggaaucaccggccuccaaacaggcgaugaagcggacuauuacugugggaccugggauagcucucuguccgcuggaggcguguuugggacgggaaccaaagugacaguccuu

SEQ ID NO: 40997 - RNA, 333 nt, Artificial Sequence
  derived and/or modified sequence opt5 from anti-HIV_038-107263_VR-Chain
cagagcgugcugacccaacccccuuccgccucuggcacaccggggcagagagucacgaucagcugcuccggaucuagcuccaacauuggcucuaauaccguuaacugguaccaacaggugcccgggacagcuccuaaucuccugaucuauagcaacgaccagcggcccuccggcauuccugaucgcuucagcggaucuaaguccgggaccagcgccacacuuggaaucaccggccugcagacaggcgacgaggcggauuacuauugugggaccugggacucuucccucagcgcuggaggcguguuugggacgggaaccaaagucacagugcug

SEQ ID NO: 40998 - RNA, 333 nt, Artificial Sequence
  derived and/or modified sequence opt5 from anti-HIV_038-104530_VR-Chain
cagagcgugcugacccaacccccuuccgucucugccgcuccgggccagaagguuacaaucagcugcuccgggucuagcuccaacauuggaucuaauuacgugagcugguaucagcaccuccccggcaaagccccuaagcugcuuaucuacgacaacaauaaaagacccuccgggauuccugaucgguucagcggaucuaaguccggcacgagcgcgacccuggggaucacaggacuccagaccggcgacgaggcugauuauuacuguggcacaugggacucuucccugagcgccgggggaguguuuggcaccgggacaaaagucaccgugcuu

SEQ ID NO: 40999 - RNA, 333 nt, Artificial Sequence
  derived and/or modified sequence opt5 from anti-HIV_038-099169_VR-Chain
cagagcgugcugacccaacccccuuccgccucuggcacaccggggcagagagucagcaucuccugcucuggaauuacgagcucccucggcucuaaccacaugagcugguaccagcagcugcccgggaccgcuccuaaacuucugaucuaugagaauaacaagcggcccuccggcauuccugaccgcuucagcggaucuaaguccgggacaagcgccacccucggaaucacaggccugcaaaccggcgaugaagcggacuacuauugugggacaugggauucuucccuuagcgcuggaggcguuuuugggaccggaacgaaagugaccgugcug

SEQ ID NO: 41000 - RNA, 333 nt, Artificial Sequence
  derived and/or modified sequence opt5 from anti-HIV_038-075067_VR-Chain
cagagcgugcugacccaacccccuuccgucucuggcgccccggggcagagaguuacaaucagcugcuccggaucuagcuccacgauuggcaacaauuacgugucuugguaucagcuccugcccgggaccgcuccuaaacuucugaucuacaagaacaauaagcggcccagcggcauuccugaccgcuucuccggaagcaaaucugggacauccgccacccucggaaucacaggccugcagaccggcgaugaggcggacuauuacugugggacaugggauaccagccuuucugcuggaggcguguuugggacgggaaccaaggucacagugcug

SEQ ID NO: 41001 - RNA, 333 nt, Artificial Sequence
  derived and/or modified sequence opt5 from anti-HIV_038-072368_VR-Chain
cagagcgugcugacccaaucccccucugccagcggcacaccugggcagagagucacgaucuccugcucuggaagcuccucuaacauuggcaauaacuacguuagcugguaucagcagcucccggggaccgcucccaagcugcuuaucuacgagaauaacaaacggccuuccggcauucccgaccgcuucagcggaucuaaguccgggacaagcgccacccugggaaucacaggccuccaaaccggcgaugaagcggacuauuacugugggacaugggauucuucccugagcgcuggaggcguguuugggaccggaacgaaagugaccguccuu

SEQ ID NO: 41002 - RNA, 333 nt, Artificial Sequence
  derived and/or modified sequence opt5 from anti-HIV_038-068503_VR-Chain
cagagcgugcugacccaacccccuuccgucucugccgcuccgggccagaugguuacaaucagcugcuccgggucuagaagcaacauugagaaucacuacguguccugguaucagcaucuccccggagccgcgccuaagcugcuuaucuacgacaacggcaaacggcccucugggauuccugaucgcuucagcggauccaagagcggcacgucugcuacccuggggaucacaggacuccagaccggcgacgaagccgauuauuacuguggcacaugggacuccagccugucugccgggggaguguuuggcaccgggacaaaagucaccgugcuu

SEQ ID NO: 41003 - RNA, 333 nt, Artificial Sequence
  derived and/or modified sequence opt5 from anti-HIV_038-068016_VR-Chain
cagagcgugcugacccaacccccuuccgccucuggcacaccggggcagagagucacgaucagcugcuccggaucuagcuccaacauugagucuaauuucguuuacugguaucagcaguuucccggcaccacaccuaagcuccugaucuaccgggacgggcaacgccccagcggcauuccugauagauucuccggaagcaaaucugggaccuccgcuacacuuggaaucaccggccugcagacaggcgacgaagccgauuauuacugugggaccugggacagcucucucuccgcgggaggcguguuugggacgggaaccaaggugacaguccug

SEQ ID NO: 41004 - RNA, 333 nt, Artificial Sequence
  derived and/or modified sequence opt5 from anti-HIV_038-063958_VR-Chain
cagagcgugcugacccaacccccuuccgucucuggcgccccggggcagagaguuacaaucagcugcacgggauccucuagcaacauuggcaauuccggggugcacugguaccagcagcuccccggaaccgcuccuaagcugcuuaucuaugagaacaauaaacggcccucuggcauuccugaccgcuucagcggguccaagagcggaacaucugccacccugggcaucacaggccuccaaaccggggaugaagcggacuacuauuguggaacaugggauuccagccugucugcuggcgggguguuuggaaccggcacgaaagucaccgugcuu

SEQ ID NO: 41005 - RNA, 333 nt, Artificial Sequence
  derived and/or modified sequence opt5 from anti-HIV_038-033733_VR-Chain
cagagcgugcugacccaacccccuuccgccucuggcacaccggggcagagagucacgaucagcugcuccggaucuagcuccaacauuggcucuaaguacguuuauugguaccagcagcuccccgggaccgcuccuaaacugcuuaucuaugacaaugauaagcggcccagcggcauuccugaccgcaucuccgccagcaaaucuggaacauccgcgacccuggauauuacaagacuccaaaccggggacgaggcugauuacuauuguggaacaugggacagcucucuguccgccggcggcguguucgggaccggaacgaaggugaccguccuu

SEQ ID NO: 41006 - RNA, 333 nt, Artificial Sequence
  derived and/or modified sequence opt5 from anti-HIV_038-030557_VR-Chain
cagagcgugcugacccaacccccuuccgucucugccgcuccgggccagaagguuacaaucagcugcuccgggucuagcuccacgauuggaaacaauuacgugucuugguaucagcuccugcccggcaccgccccuaaacuucugaucuacaagaacaauaaaagacccagcgggauuccugaccgguucuccggaagcaagucuggcacauccgcgacccucgggaucacaggacugcagaccggcgauggcgcugacuauuacugugggacaugggauaccagccuuucugccggaggcguguuugggacgggaaccauugucacagugcug

SEQ ID NO: 41007 - RNA, 333 nt, Artificial Sequence
  derived and/or modified sequence opt5 from anti-HIV_038-024298_VR-Chain
cagagcgugcugacccaacccccuuccgucucugccgcuccgggccagaagguuacaaucagcugcuccgggucuagcuccaacauuggaaauucucacgugagcugguaccagcaguuccccggcacggggccuaaacuccugaucuaugagaacgccaagagacccuccggcauuccugaccggaucagcggaucuaaauccgauaccagcgcgacacuugggauuaccggacugcaaacaggcgacgaagcugauuacuauuguggcaccugggacucuucccucagcgccgggggaguguuuggcacagggaccaaggucacggugcug

SEQ ID NO: 41008 - RNA, 333 nt, Artificial Sequence
  derived and/or modified sequence opt5 from anti-HIV_038-011154_VR-Chain
cagagcgugcugacccaacccccuuccgucucugccgcuccgggccagagaaucacaauuagcugcuccgggucuagcuccaacaucggaaauaacuacguuucuugguaucagcagcuccccggcacggccccuaagcugcuuauuuacaaaaauaacaagcggcccagcgggaucccugaccgcuucuccggaagcaaaucuggcaccuccgcgacacuggggauuaccggacuccaaacaggcgaugaggcugacuauuacuguggcaccugggauacaagccugucugccgggggaguguuuggcaccgggacgaaggugaccguccuu

SEQ ID NO: 41009 - RNA, 318 nt, Artificial Sequence
  derived and/or modified sequence opt5 from anti-HIV-1_LightChain
gagaucgugcugacccagagccccggcacacucucccugucuccuggggaaagagccacgcuuagcugccgggcuucccaaucugucagcaacaauuuccuggccugguaccaguauaagccgggacagcccccucgcguucucauuuacggcaccuccagacgggcgucugggauccccgaccgcuuuagcggauccggcagcgggacagauggaucucugaccauuuccagacuugaggcugaagacuucgccguguauuacugucagcaauaugaguuuuucggccagggcacacggcuggaaaugaaacgcacc

SEQ ID NO: 41010 - RNA, 318 nt, Artificial Sequence
  derived and/or modified sequence opt5 from anti-HIV-1_LightChain
gaggugguccugacccagagccccggcacacucucccugucuccuggggaaagagccacgcuuagcugccgggcuucccaaucuguuagccgcaacuaccuggccugguaucagcagaagcucggacacggcccgagacugcuuguguacgcgaccucccggcgcgcuacagggauccccgacagauucauuggaucucagagcggcaccgaguauaaucugacaaucacccggcucgauccuggggacuuugcccaauacuucugucagcaguaugaauuuuucggacccggcacacgccuggauauuaaaagaacc

SEQ ID NO: 41011 - RNA, 309 nt, Artificial Sequence
  derived and/or modified sequence opt5 from anti-HIV-1_LightChain
gaagugguccugacccagagccccggcacacucucccugucuccuggggaaagagccagcuucuccugcaagucuagccaauacggacacacggcuugguaucagcagaaacuuggccaugggccgcggcugcucaucuacgccaccucccgcagagcgacaggcauucccgaccgguuuaucggaucucagagcgggaccgaguauaaccugacaauuacccgccuugauccuggagacuucgcucacuacuuuugucaacagaaugaguucuuuggccccggcacaagacuggauaugaagcggacc

SEQ ID NO: 41012 - RNA, 306 nt, Artificial Sequence
  derived and/or modified sequence opt5 from anti-HIV-1_LightChain
gagaucgugcugacccagagccccuccucucucagccuguccccuggcgaaagagccucucuuagcugccgggggucccacggacaugucgcuugguaccaacacaagccgggccagauuccccgccugcucaucuaugccacaucuaaaagagcgagcgggauuuccgaccgguucagcggaucuggcuccgggacggaugcuacccugagcaucucucgccuugagccugaagacuuugccguuuacuucugucagcaguaugaguuuuucggacaaggcacaagacuggaaauuaagcggacc

SEQ ID NO: 41013 - RNA, 306 nt, Artificial Sequence
  derived and/or modified sequence opt5 from anti-HIV-1_LightChain
gagaucaugcugacccagagccccggcacacucucccugucuccuggggaaagagccacgcuuagcugccggggaucccacggccauguggcuugguaccaacagaagccggggcgcauucccagacugcucaucuauggaaccucuaaacgggccagcggcauuccugaccgcuucuccgggucuggaagcggcacagaugcgacccugacaaucuccagacuugagagcgaagacuuugcugucuacuucugucagcaguaugaguuuuucggccaagggacccggcuggauauuaaccgcaca

SEQ ID NO: 41014 - RNA, 309 nt, Artificial Sequence
  derived and/or modified sequence opt5 from anti-HIV-1_LightChain
gagagcgugcugacccagucccccggcacacucucucugagcccuggggaaacggccucccuuucuugcaccgcugcccuguacggacacaugacaugguaucaaaagaaaccgggccagcccccuaagcuccugcuuuacgcgagcuccaaaagagcuucugggauccccgaccgguucagcggaucccaguuuggcaagcaguauacccugauuaucacaaaaauggagccugaagauuucgccgaguacuauugucaacaguuugaagucuucgggcagggaacccgccucgacaugagacggaca

SEQ ID NO: 41015 - RNA, 306 nt, Artificial Sequence
  derived and/or modified sequence opt5 from anti-HIV-1_LightChain
gaggugguccugacccagagccccggcacacucucccugucuccuggggaaagagccacgcuuagcugccggggaucccacggccaucugucuugguaccaauauaagccggggcagcccccucgcguucucaucuacggaaccagcagacgggcuuccggcauucccgaccgcuucucugggagcggauccggcacagauggcagccugaccaucucuagacuugaggccgaagacuuugcgguguauuacugucagcaguaugaguucuuugggcaaggaacacggcuggaaaugaaacgcacc

SEQ ID NO: 41016 - RNA, 309 nt, Artificial Sequence
  derived and/or modified sequence opt5 from anti-HIV-1_LightChain
gaggugguccugacccagagccccggcacacucucccugucuccuggggaaagagccagccuuuccugcaagucuagccaauacggacacacggcuugguaucagcagaaacugggccaggggccgcggcuccugaucuacgccaccucccgcagagcgacaggcauucccgaccgguucucuggaagccaauccgggaccgaguauaaccuuacaaucacccgccuggauccuggagacuuugcucaguacuucugucagcaguaugaauuuuucggccccggcacaagacucgauauuaagcggacc

SEQ ID NO: 41017 - RNA, 306 nt, Artificial Sequence
  derived and/or modified sequence opt5 from anti-HIV-1_LightChain
gagaucaugcugacccagagccccggcacacucucccugucuccuggggaaagagccacgcuuagcugccggggaucccacggccauguggcuugguaccaacagaagccggggcgcauucccagacugcucaucuauggaaccucuaaacgggccagcggcauuccugaccgcuucuccgggucuggaagcggcacagaugcgacccugacaaucuccagacuugagagcgaagacuuugcugucuacuauugucagcaguacgaguucuuuggccaagggacccggcuggauauuaagcgcaca

SEQ ID NO: 41018 - RNA, 309 nt, Artificial Sequence
  derived and/or modified sequence opt5 from anti-HIV-1_LightChain
gagagcgugcugacccagucccccggcacacucucucugagcccuggggaaacggccucccuuucuugcaccgcugccagcuacggacacaugacaugguaucaaaagaaaccgggccagcccccuaagcugcucaucuucgcgaccuccaaaagagcuucugggauucccgaccgguuuagcggaucccaguucggcaagcaguacacacugaccaucacacgcauggagccugaagauuuugccggguauuacugucaacaggucgaguucuuuggacagggcaccagacuugaaauucggcgcacg

SEQ ID NO: 41019 - RNA, 309 nt, Artificial Sequence
  derived and/or modified sequence opt5 from anti-HIV-1_LightChain
gacauccagaugacccaaagccccuccucucugagcgccuccgugggcgauagagucacaauuacgugccaggcuucucaggacaucagcaacuaccucaauugguaucagcaaaagccugggaaagccccgaagcugcuuauuuacgaugcguccaaccuggagaccggaguucccucucgguucagcggcuccggguuucacacaaccuucagccucacaaucucuggacugcagcgcgacgauuuugcuaccuauuucugugccgugcuugaauuuuucggcccugggacaaaaguggacuuuaau

SEQ ID NO: 41020 - RNA, 309 nt, Artificial Sequence
  derived and/or modified sequence opt5 from anti-HIV-1_LightChain
gacauccagaugacccaaagccccuccucucugagcgccuccgugggcgauagagucacaauuacgugccaggcuucucaggacaucaccaacuaccucaauugguaucagcaaaagccugggcgggccccgaaacugcuuguucacggagcgagcaaccugcagcgcggcgugcccuccagauucucugggagcggauuucauacaaccuucacacucaccauuuccagccugcagccugaugacguggcuacauacuuuugugaggucuuccagugguuuggccccgggacccggguggauuucaau

SEQ ID NO: 41021 - RNA, 309 nt, Artificial Sequence
  derived and/or modified sequence opt5 from anti-HIV-1_LightChain
ggcuuccagcugacccaaagccccuccucucucagcgccuccgugggggacagagucucuaucaacugccaggcuggagagggcauugggagcucccugaauugguaccagcagaagccuggacgggccccgaaacuucugguucacggcgcgucuaaccuccaacgcggggugcccagcagauuuuccggaagcggcuuccauacaacguuuacccugacaaucucuucccuucagccugaugacguggcuaccuauuucugugaagucuuucagugguucggccccgggacacggguggauuuuaau

SEQ ID NO: 41022 - RNA, 309 nt, Artificial Sequence
  derived and/or modified sequence opt5 from anti-HIV-1_LightChain
ggcauccagcugacccaaagccccuccucucucagcguguccgucggggacagaguuacaauuacgugccgggccucucagggaaucggcaacagccugaauugguaccagcagaagccugggaaagcuccgaaccuuaugguguucggaaccacaaagcugaaucgcggcgugcccuccagauuuucugggagcggauccggcaccacagccacccucacaauuaacagccugcaaccugaagauaucgcgaccuauuucugucaggucuuugaguuccuuggccccgggacgaaacuggacaugaag

SEQ ID NO: 41023 - RNA, 309 nt, Artificial Sequence
  derived and/or modified sequence opt5 from anti-HIV-1_LightChain
gacauccagaugacccaaagccccuccucucugagcgccuccgugggcgauagagucacaauuacgugccaggcugggcagggaaucggcucuagccucaagugguaccagcaaaaaccugggcgggccccgcgccugcuuguucacggagcguccaaccugcauagaggcgugcccucucgguucagcggguccggauuucacaccacauucagccucaccauuucuggccugcagcgcgacgauuuugcuacauauuucugugccgugcuugaguuuuucggcccugggaccaaggucgacuuuaau

SEQ ID NO: 41024 - RNA, 309 nt, Artificial Sequence
  derived and/or modified sequence opt5 from anti-HIV-1_LightChain
ggcauccagcugacccaaagccccuccucucucagcgccuccgugggggacagagucacaauuacgugccaggcuucucagggaaucggcagcucccugcagugguaccaacagaagccugggcgggccccgaaccuucugguucacggagcgucuaaucuccaucgcggcgugcccagcagauucuccgggagcggauuucacaccacauucucucugaccauuuccggccuucagcgggaugacuuugcuacauauuucugugccgugcuggaguuuuucggcccugggaccaaagucgaaaucaag

SEQ ID NO: 41025 - RNA, 309 nt, Artificial Sequence
  derived and/or modified sequence opt5 from anti-HIV-1_LightChain
ggcgugcagcugacccaaagccccuccucucucagcgccuccgucggggacagaguuucuaucaacugccaggcuggacagggcauugggagcucccugaauugguaccagcaaaagcggggaaaggccccuaaacuucuggugcacggcgcgucuacacuccagcgcggggugccgagcagauucuccggaagcggcuuucauacgaccuucacacugaccaucucuucccuucagcccgaugacgucgcuacauauuuuugugagguguuccagugguuuggcccugggacccggguugauuucaac

SEQ ID NO: 41026 - RNA, 306 nt, Artificial Sequence
  derived and/or modified sequence opt5 from anti-HIV-1_LightChain
uacauccagcugacccaaagccccuccucucucagcgccuccauuggcgacagagugacaaucgcuugccgggccucucaggggauuggauauguccacugguaccagcagaagcgcggcaaaccuccgaagcugcuuauccauggggcgagcauucuggagagaggaguucccucccgguucucuggcagcggguccggaacgcucuuuaaccugaccgugagcggccuucaaccugaagauuucgcuacauauaugugucagguguuugagucuuucggccccgggaccaaaguccagaugaag

SEQ ID NO: 41027 - RNA, 309 nt, Artificial Sequence
  derived and/or modified sequence opt5 from anti-HIV-1_LightChain
ggcauccagcugacccaaagccccuccucucucagcgccucccugggggacagagugacaauuacgugccaggcuucucagggaaucggcagcucccuucagugguaccaacagaagccugggaaagccccgaagcugcucguccacggagcgucuaaacugcaucggggcguucccagccgcuucuccgggagcggauuucacaccacauucucucuuaccauuuccagccugcagccugaagauuuugcuacauaucucugucaggugcuggaguucuuuggccccggcaccaagguggacuucaac

SEQ ID NO: 41028 - RNA, 309 nt, Artificial Sequence
  derived and/or modified sequence opt5 from anti-HIV-1_LightChain
ggcauccagcugacccaaagccccuccucucucagcgccuccgugggggacacagucacgauuaccugccaggcuucucagggaaucggcagcucccugcagugguaccaacagaagagagggcgggccccuaaacuucugguucacggagcgucuaaccuccagggcggggugccgagccgcuucuccggaagcggcuuucauacaaccuucacacuggcuauuagaggccuucagcccgaugacuuugccaccuauuucugucaaucucuggaguuuuucgggccuggaacaaagguggauaugaaa

SEQ ID NO: 41029 - RNA, 306 nt, Artificial Sequence
  derived and/or modified sequence opt5 from anti-HIV-1_LightChain
uacauccagcugacccaaagccccuccucucucagcgccuccgugggcgacagagucacaauuacgugccgggcuucucaggauaucggguauguuagcugguacgcccagaagcgcggcagagcgccuaaacugcuuauucacggagcuuccgggcuggagcggggagugccgucucgcuucagcggcuccgggagcggaacccucuuuacacugaccaucgaaucucuucagcccgaggacuucgccacauauaugugucaaguguuugaauccuucggcccuggcaccaaggucgagaugaaa

SEQ ID NO: 41030 - RNA, 309 nt, Artificial Sequence
  derived and/or modified sequence opt5 from anti-HIV-1_LightChain
ggcauccagcugacccaaagccccuccucucucagcgccuccgugggggacagagucucuauuaacugccaggcuggacagggcaucgggagcucccugaauugguaccagcaaaagccuggacgggccccgaaacuucugguucacggcgcgucuaaccuccagcgcggggugcccagcagauucuccggaagcggcuuucauacaacguucacccugacaauuucuucccuucagccugaugacguggcuaccuauuuuugugccgucuuccagugguuuggccccgggacacggguggauuucaau

SEQ ID NO: 41031 - RNA, 366 nt, Artificial Sequence
  derived and/or modified sequence opt5 from anti-HIV-1_HeavyChain
agccagcaacuggugcaguccggcacccaggucaagaaacccggggccucuguuagaaucagcugccaggcuuccggauacacauucacggacuaugugcuccacugguggcggcaagccccuggccaggggcuggaguggaugggauggauuaagccgguguacggcgcgcgcaacuaugcuagacgguuucaggggcgcaucgauuucucuagagacauuuaccgggaaaucgccuauauggaucuuagcggacugcgcuccgacgauaccgcccucuacuuuugugcuagagacggcucuggcgaugacacaagcuggcaucuggaucccugggggcagggaacccuugucauuguguccgcc

SEQ ID NO: 41032 - RNA, 366 nt, Artificial Sequence
  derived and/or modified sequence opt5 from anti-HIV-1_HeavyChain
agccagcaacuggugcaguccggcacccaggucaagaaacccggggccucuguuagaaucagcugccaggcuuccggauacacauucacggacuaucuccugcacugguggcggcaagccccuggccagcgccuugaguggaugggguggauuaagccgguguacggagcgagaaacuaugcucaucgguuucagggccgcaucaauuucgauagagacauuuaccgggaaaucgccuuuauggaucugucugggcuccgcagcgacgauaccgccguguauuucugugcuagagacggaggcggcgaugaccggacauggcugcuugauaccugggggcagggaacacuggucgugguuuccucu

SEQ ID NO: 41033 - RNA, 366 nt, Artificial Sequence
  derived and/or modified sequence opt5 from anti-HIV-1_HeavyChain
caggugcaccuggagcaacccggcagcgucguuagauggccuggggccucccucacccugucuugcacagcuagcggauacaucuucgugaacuaucauauucacuggcuucggcaggccccgggccagcgccuggaacuccuggggacgaucaaucccgugggaggcgcgaccuccuacgcucagaaguuuagagggcggcuuguccugacacgcgacauuggaucuagcaccgugacacuccugcugaaccaucucagacgggaugacuccgccguuuauuucugugcccgcgagucuaaugcuagcggcagaggccgguccauggaucacugggggcgcggaagcagagugaucgucucucaa

SEQ ID NO: 41034 - RNA, 366 nt, Artificial Sequence
  derived and/or modified sequence opt5 from anti-HIV-1_HeavyChain
caggugcaacugguccagagcggcgccgagguuaagaaacccggggcuuccgugagagugucuugccaggccagcggauacaccuucacaaacuauauccuccacugguggcggcaggcgccuggccaagggcuggaauggaugggacuuauuaagccggucuacggcgcugugaauuaugcccgccaguuucaggggagaauccagcugacgcgggacauuuaccgcgagaucgccuuccucgaucuguccggacuuagaucugacgauaccgcuguuuauuacugugcccgggacgaaagcggcgaugaccugaaauggcaucuccaccccuggggccaagggacacaggugauugucuccccu

SEQ ID NO: 41035 - RNA, 366 nt, Artificial Sequence
  derived and/or modified sequence opt5 from anti-HIV-1_HeavyChain
caggugcaacugguccagagcggcgccgagguuaagaaacccggggcuuccgugagaaucucuugccaggccagcggauacaccuucacagacuaugugcuccacugguggcggcaggcgccuggccaagggcuggaauggaugggauggauuaagccggucuacggcgcucgcaacuaugccagacgguuucaggggcgcaucaauuucgauagagacauuuaccgggagaucgccuauauggaucuuuccggacugcgcucugacgauacggcuagauacuuuugugcccgggacggcagcggcgaugacaccuccuggcaucuccaccccugggggcagggaacacuggugauuguuucugcu

SEQ ID NO: 41036 - RNA, 366 nt, Artificial Sequence
  derived and/or modified sequence opt5 from anti-HIV-1_HeavyChain
agccagcaacuggugcaguccggcacccaggucaagaaacccggggccucuguuagagugagcugccaggcuuccggauacacauucacgaacuauauccuccacugguggcggcaagccccuggccaggggcuggaguggaugggacuuauuaagccgguguacggcgcggucaauuaugcucgccaguuucaggggagaauccaacugacccgggacauuuaccgcgaaaucgccuuccucgaucugucuggacuuagaacagacgauaccgccguguauuacugugcucgggacgagagcggcgaugaccugaaauggcaucuccaccccuggggccaggggacacagguuauuguguccccu

SEQ ID NO: 41037 - RNA, 366 nt, Artificial Sequence
  derived and/or modified sequence opt5 from anti-HIV-1_HeavyChain
caggugcaccuggagcaaagcggcuccgucguuagauggcccggggccucucucacccugagcugcacagcuuccggauacaucuucgugaacuaucauauucacuggcuucggcaggccccuggccagcgccuggaacucauggggacgaucaauccggugggaggcgcgaccucuuacacacagagauuucgggggcgccugguccuuaccagagacauuggaagcaacacagugacccugcuccugaaucaucugcgguccgaugacucugcuguuuauuucugugcccgcgagagcaacgccuccggcagaggccggagcauggaucacugggggcgcggaucucaugugaucgucuccccc

SEQ ID NO: 41038 - RNA, 366 nt, Artificial Sequence
  derived and/or modified sequence opt5 from anti-HIV-1_HeavyChain
agccagcaccuggugcaauccggcacccaggucaagaaacccggggccucuguuagagugagcugccaggcuuccggauacacauucacgaacuauauccuccauugguggcggcaggccccuggccaagggcuggaguggaugggacuuauuaagccgguguacggcgcggucaauuaugcucgccaguuucaggggagaauccagcugacccgggacauuuaccgcgauaucgccuuccucgaccugucuggacuuagaagcgaugacacagccguguauuacugugcucgggaugaauccggcgacgaucugaaauggcaccuccaucccuggggccaagggacccagguuauugugucuccu

SEQ ID NO: 41039 - RNA, 366 nt, Artificial Sequence
  derived and/or modified sequence opt5 from anti-HIV-1_HeavyChain
agccagcaacuggugcaguccggcacccaggucaagaaacccggggccucuguuagaaucagcugccaggcuuccggauacacauucacggacuaugugcuccacugguggcggcaagccccuggccaggggcuggaguggaugggauggauuaagccgguguacggcgcgcgcaacuaugcuagacgguuucaggggcgcaucaauuucgauagagacauuuaccgggaaaucgccuauauggaucuuucuggacugcgcagcgacgauaccgccagauacuuuugugcucgggacggcuccggcgaugacacaucuuggcaucuccaccccugggggcagggaacccuggucauugugagcgcc

SEQ ID NO: 41040 - RNA, 366 nt, Artificial Sequence
  derived and/or modified sequence opt5 from anti-HIV-1_HeavyChain
caggugcaccuggagcaacccggcagcgucguuagauggccuggggccucccucacccugucuugcacagcuagcggauacaucuucgugaacuaucauauucacuggcuucggcaggccccgggccagcgccuggaacuccuggggacgaucaaucccgugggaggcgcgaccuccuacgcucagaaguuuagagggcggcuuguccugacacgcgacauuggaucuagcaccgugacacuccugcugaaccaucucagacgggaugacuccgccguuuauuucugugcccgcgagucuaaugcuagcggcagaggccgguccauggaucacugggggcgcggaaaaccugugaucgucagcccc

SEQ ID NO: 41041 - RNA, 321 nt, Artificial Sequence
  derived and/or modified sequence opt5 from anti-HIV-1_HeavyChain
gagaucgugaugacccagagccccgccauucuguccgucucuccuggcgacagagcuacauucagcugccgggccucccaaucuguuaagaacaaucucgcgugguaccagaaacgcccggggcaggcucccagacugcuuaucuuugaugccagcucccgggccucuggcauuccugcucgcuucagcggagggggauccggcacggaauuuacccugacagugaacagcaugcagucugaggacuucgccaccuauuacugucaacaguaugaagaguggcccagaacauuugggcagggaaccaagguggaaaucaug

SEQ ID NO: 41042 - RNA, 321 nt, Artificial Sequence
  derived and/or modified sequence opt5 from anti-HIV-1_HeavyChain
cagaucgugcugacccaaagcccucccacacucucccugucuccgggcgagagagccacgcuuagcugccgggcuucccagucugucaagaacaaucuggccugguaccagaaacgccccgggcaggcgccuagacuccugauuuucgacaccagcucccgggcuucuaacauccccgcccgcuuuagcggaggcggguccggaacagaguucacccuuacaguuaauagcaugcaaucugaagauuuugccaccuauuacugucagcaguaugaagaguggccuagaacauucggccaggggaccaagguggaaauuauc

SEQ ID NO: 41043 - RNA, 321 nt, Artificial Sequence
  derived and/or modified sequence opt5 from anti-HIV-1_HeavyChain
gagaucgugaugacccagagccccgccguccuguccguuucuccuggcgacagagcuacacucagcugccgggccucccaaucugugaagaacaaucuggcgugguaccagaaacgcccggggcaggcucccagacuucugauuuucgauacgagcucccgggccucuaacaucccugcccgcuuuagcggaggcggguccggaaccgaguucacacucaccgugaauagcaugcagucugaagacuuugcuacauauuacugucaacaguaugaagaguggcccagaaccuucggccaggggacaaaggucgaaauuaac

SEQ ID NO: 41044 - RNA, 321 nt, Artificial Sequence
  derived and/or modified sequence opt5 from anti-HIV-1_HeavyChain
gagaucgugcugacccagagcccucccacacucuccgucucuccgggcgaagccgcuacgcugagcugcagagccucccaaucuguuaagaacaaucuugcgugguaccaccugaaagcugggcaggcuccccggcuccugauuuucgacgccagcucccgcgccggagaugccccugcuagagugucuggcagcggguauggaaccgaguuuacacuuaccgugaacuccguccagagcgaagacuucggcgauuacuauugucagcaauacgaggaauggccccggacauuugggcagggaaccaagguggaccugcgc

SEQ ID NO: 41045 - RNA, 321 nt, Artificial Sequence
  derived and/or modified sequence opt5 from anti-HIV-1_HeavyChain
gagaucgugaugacccagagcccucccacacuguccgucucuccgggcgaaacggccacccucagcugcagagcuucccaaaacguuaagaauaaccuggccugguaccagcuuaaacccgggcaggcgccucggcugcucauuuucgacgcuucuagccgcgccggaggcauccccgauagauuuuccgggucuggauauggcacagacuucacccugacagugaauagcgugcaguccgaggauuuuggggacuacuucugucaacaguaugaagaguggccucggaccuuuggacagggcacaaaggucgaucuucgc

SEQ ID NO: 41046 - RNA, 321 nt, Artificial Sequence
  derived and/or modified sequence opt5 from anti-HIV-1_HeavyChain
gagaucgugaugacccagagccccgccguccuguccguuucuccuggcgacagagcuacacucagcugccgggccucccaaucugugaagaacaaucuggcgugguaccagaaacgcccggggcaggcucccagacuucugauuuucgauacgagcucccgggccucuaacaucccugcccgcuuuagcggaggcggguccggaaccgaguucacacucaccgugaauagcaugcagucugaagacuuugcuacauauuacugucaacaguaugaagaguggcccagaaccuucggccaggggacaaaggucgaaauuauc

SEQ ID NO: 41047 - RNA, 399 nt, Artificial Sequence
  derived and/or modified sequence opt5 from anti-HIV-1_HeavyChain
gaggugcaucugcaggaaagcggccccgggcucgucagaccucuggagacccuuucccugacaugcacggccucuggagcuagcauccggggcggggaauggggagacaacgauuaccacuggggcuggguucgccacuccccggagaaggggcucgaauggauuggaucuauccauuggagaggcaccacacacuauaaugcccccuuccggggccgcgcgacccugagcauugacacauccagaaaccaauuuuuccuucggcugaccucuaugacagcugaugacaccgccguguacuauugugugaaacauaaguaccacgauaucgucauggugguuccuauugccgggugguuugaccccuggggacagggccuccaggugacggucagcgcu

SEQ ID NO: 41048 - RNA, 399 nt, Artificial Sequence
  derived and/or modified sequence opt5 from anti-HIV-1_HeavyChain
gaggugcaucugcaggaaagcggccccgggcucgucagaccucuggagacccuuucccugacaugcacggccucuggagcuagcauccggggcggggaauggggagacaacgauuaccacuggggcuggguucgccacuccccggagaaggggcucgaauggauuggaucuauccauuggagaggcaccacacacuauaaugcccccuuccggggccgcgcgacccugagcauugacacauccagaaaccaauuuuuccuucggcugaccucuaugacagcugaugacaccgccguguacuauugugugaaacauaaguaccacgauaucgucauggugguuccuauugccgggugguuuaaucccuggggacagggccuccaggcuacggugccuagc

SEQ ID NO: 41049 - RNA, 399 nt, Artificial Sequence
  derived and/or modified sequence opt5 from anti-HIV-1_HeavyChain
caggugcaacugaaggagagcggccccgggcucgucaaaccuuccgaaacccugucucuuacaugcacgguuagcggaggcuccaugagagggaccgacuggggagagaacgauuuccacuacggcuggauccggcauucuagcgccgaagggcuggaguggauuggauccauccacuggcgcggcacaacccauuauaagaugucuuuuagaagccgggcuacaauuuccaucgacaccagcaauaaccgcuucucucucauguuuuccuucgugacagccgaagauaccgcgguguacuauugugcuagacacaaauaccaugacauuuuucgggucgugccgguugccggcugguucgaucccugggggcagggacugcuugugacggucagcucu

SEQ ID NO: 41050 - RNA, 399 nt, Artificial Sequence
  derived and/or modified sequence opt5 from anti-HIV-1_HeavyChain
gaggugcaucugcaggaaagcggccccgggcucgucagaccucuggagacccuuucccugacaugcacggccucuggagcuagcauccggggcggggaauggggagacaacgauuaccacuggggcuggguucgccacuccccggagaaggggcucgaauggauuggaucuauccauuggagaggcaccacacacuauaaugcccccuuccggggccgcgcgacccugagcauugacacauccaaaaaccaauuuucucuuagacugaccagcaugacagcugaugacaccgccguguacuauugugugaagcauaaauaccacgauaucgucauggugguuccuuucgccgggugguuugaccccuggggacagggccuccgggugacggucuccgcu

SEQ ID NO: 41051 - RNA, 399 nt, Artificial Sequence
  derived and/or modified sequence opt5 from anti-HIV-1_HeavyChain
gaggugcaucugcaggaaagcggccccgggcucgucagaccucuggagacccuuucccugacaugcacggccucuggagcuagcauccggggcggggaauggggagacaacgauuaccacuggggcuggguucgccacuccccggagaaggggcucgaauggauuggaucuauccauuggagaggcaccacacacuauaaugcccccuuccggggccgcgcgacccugagcauugacacauccaaaaaccaauuuuuccuuagacugaccucuaugacagcugaugacaccgccguguacuauugugugaagcauaaauaccacgauaucugcauggucgugccuauugccgggugguuugaccccuggggacagggccuccagguuacggugagccag

SEQ ID NO: 41052 - RNA, 399 nt, Artificial Sequence
  derived and/or modified sequence opt5 from anti-HIV-1_HeavyChain
caggugcaucugcaagagagcggccccgggcucgucagaccucuggaaacccuuucccugacaugcacggccucuggagcuagcauccggggcggggaguggggagacaacgauuaccacuggggcuggguucgccacuccccggaaaaggggcucgaguggauuggaucuauccauuggagaggcaccacacacuauaaugcccccuuccggggccgcgcgacccugagcauugacacauccagaaaccaguuuuuccuucggcugaccucuaugacagcugaugacaccgccguguacuauugugugaaacauaaguaccacgauaucgucauggugguuccuauugccgggugguuugaccccuggggacagggccuccaggugacggucagcucc

SEQ ID NO: 41053 - RNA, 399 nt, Artificial Sequence
  derived and/or modified sequence opt5 from anti-HIV-1_HeavyChain
caggugcaucugcaagagagcggccccgggcucgucagaccucuggaaacccuuucccugacaugcacggccucuggagcuagcauccggggcggggaguggggagacaacgauuaccacuggggcuggguucgccacuccccggaaaaggggcucgaguggauuggaucuauccauuggagaggcaccacacacuauaaugcccccuuccggggccgcgcgacccugagcauugacacauccagaaaccaguuuuuccuucggcugaccucuaugacagcugaugacaccgccguguacuauugugugaaacauaaguaccacgauaucgucauggugguuccuauugccgggugguuugaccccuggggacagggccuccgcgugacggucagccag

SEQ ID NO: 41054 - RNA, 399 nt, Artificial Sequence
  derived and/or modified sequence opt5 from anti-HIV-1_HeavyChain
caggugcaucugcaagagagcggccccgggcucgucagaccucuggaaacccuuucccugacaugcacggccucuggagcuagcauccggggcggggaguggggagacaacgauuaccacuggggcuggguucgccacuccccggggaagggacucgaauggauuggcucuauccauuggagaggcaccacacacuauaaugcccccuuccgggggcgcgcgacccugagcauugacacauuuagaaaccaguucuuucuucggcugaccuccaugacagcugaugacaccgccguguacuauugugugaaacauaaguaccacgauaucgucauggugguuccuauugccggaugguucgaccccuggggccaggggcuccaggugacggucucucaa

SEQ ID NO: 41055 - RNA, 399 nt, Artificial Sequence
  derived and/or modified sequence opt5 from anti-HIV-1_HeavyChain
gaggugcaucugcaggaaagcggccccgggcucgucagaccucuggagacccuuucccugacaugcacggccucuggagcuagcauccggggcggggaauggggagacaacgauuaccacuggggcuggguucgccacuccccggagaaggggcucgaauggauuggaucuauccauuggagaggcaccacacacuauaaugcccccuuccggggccgcgcgacccugagcauugacacauccagaaaccaauuuuuccuucggcugaccucuaugacagcugaugacaccgccguguacuauugugugaaacauaaguaccacgauaucgucauggugguuccuauugccgggugguuugaccccuggggacagggccuccgcgggacggugagcgcu

SEQ ID NO: 41056 - RNA, 393 nt, Artificial Sequence
  derived and/or modified sequence opt5 from anti-HIV-1_HeavyChain
caggugcaacugguccagagcggcgccguuaucaagacccccggguccucugugaaaauuagcugcagagcuuccggauacaacuuccgggacuauucuauccacugggugcgccucauuccugauaagggcuuugaguggaucggguggauuaaaccgcuguggggagccgucagcuacgcgagacagcuucagggccggguguccaugacacgccaacugucuagagaccccgaugacccugauuggggaguugcuuauauggaguucagcgggcucacgcccgccgacaccgccgaauacuuuugugugcggcgcggcuccugcgauuauuguggcgacuucccuuggcaguacugggggcagggaacagucgugguugugagcucugcu

SEQ ID NO: 41057 - RNA, 393 nt, Artificial Sequence
  derived and/or modified sequence opt5 from anti-HIV-1_HeavyChain
caggugcaacugguccagagcggcgccguuaucaagacccccggguccucugugaaacucagcugcagagcuuccggauacaacuuccgggacuauucuauucacugggugcgccugaucccugauaagggcuuugaguggauuggguggaucaaaccgcuuuggggagccgucagcuacgcgagacagcugcagggccggguguccaugacacgccaacucucucaggaccccgaugacccugauuggggaguugcuuauauggaguucagcgggcugacgcccgccgacaccgccgaauacuuuugugugagacggggcuccugcgauuauuguggcgacuucccuuggcaguacugggggcagggaacagucgugguugugagcucugcu

SEQ ID NO: 41058 - RNA, 303 nt, Artificial Sequence
  derived and/or modified sequence opt5 from anti-HIV-1_LightChain
accgccggccugacacagagccccgggacgcucucccugucuccuggagagagagcuauccuuagcugccggaccucccaauacggcucucuggccugguaucagcagcgcccggggcaggcgcccagacucgugauuuacgcuggacugacacgggccaccggcaucccugaccgcuucagcggguccagauggggagccgaauauaaccuuacaauuucuaaucuggagagcgaagauuuuggcgucuacuauugucaacaguacgacuucuuuggccaggggaccaagguucagguggau

SEQ ID NO: 41059 - RNA, 378 nt, Artificial Sequence
  derived and/or modified sequence opt5 from anti-HIV-1_HeavyChain
caggugcaacugguccagagcggcuccgggguuaagaaacucggagccucugugagagugagcugcuggaccuccgaggacaucuucgaacggacagagcugauucacuggguccgccaggcucccggccaggggcuugaauggaucggaugggugaaggccguuucuggcgcggugaacuacgggagccuggauuuuagacaucgggucucccucacgcgcgacagagaucugucuaccgcucacauggacauucggggacuuacacaagaugacaccgccacauauuucugugcccgccagaaauuugcuagaggcgaucagggcugguucuuugaccugugggggcggggaacccucaucgugguuagcuccgcc

SEQ ID NO: 41060 - RNA, 384 nt, Artificial Sequence
  derived and/or modified sequence opt5 from anti-HIV-1_HeavyChain
caggugcaacugguccagagcggcuccgggguuaagaaacucggagccucugugagagugagcugcuggaccuccgaggacaucuucgaacggacagagcugauucacuggguccgccaggcucccggccaggggcuugaauggaucggaugggugaaggccguuacgggcaccgugaacuuugggucucugaauuucagacaacgggucagccucacacgcgauagagaccuguuuaccgcgcauauggauauucggggacuuacacagggcgacaccgcuacauacuucugugcccgccagaaauuugagaaguauaccggcgggcagggaugguacuucgaucuguggggcagagggacgcucaucgugguuuccucugcc

SEQ ID NO: 41061 - RNA, 378 nt, Artificial Sequence
  derived and/or modified sequence opt5 from anti-HIV-1_HeavyChain
caggugcaacugguccagagcggcuccgccaugaagaaacccggggcuucuguuagagugagcugcuggaccuccgaggacaucuucgauacaacggaacucauuuacugggugcggcaggccccuggacagggccuggaguggaucgggugggucaagauugugucuggaaccguuaacuuugcgagccuugacuuccgcaauagaaucucccugucucgggaucgcgaccucuuuacagcucacauggauauuagaggccugacccaaggggacacagccaccuauuucugugcccggcagaaauuuuacgcuggaggccagggcugguauuucgaucuuugggggcgcggaacacugaucguggucagcuccgcc

SEQ ID NO: 41062 - RNA, 387 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcucacauggauauuagaggccugacccaagacgauacagccaccuauuuuugugcccggcagaaauucgagagccgcuacacagggggacagggcugguauuuugaccuuuggggcagagggacccauaucgucguguccagcgcu

SEQ ID NO: 41063 - RNA, 387 nt, Artificial Sequence
  derived and/or modified sequence opt5 from anti-HIV-1_HeavyChain
caggugcaacugguccagagcggcuccgccaugaagaaacccggggcuucuguuagagugagcugcuggaccuccgaggacaucuucgaacggacagagcucauuuacugggugcgccaggccccuggaagaggccuggaauggaucgggugggucaagacggugucuggaaccguuaacuuuggcagcuccgauuuccggaaucgcauuucucuuacaagagaccgggaucugagcaccgcgcacauggacauccgcgggcucacacaggaugacaccgcuacauauuuuugugccagacaaaaauucgagucccuguacagcgaugaccagggaucuuauuuugaucuuuggggccggggcacccugauuaucguguccagcgcc

SEQ ID NO: 41064 - RNA, 387 nt, Artificial Sequence
  derived and/or modified sequence opt5 from anti-HIV-1_HeavyChain
caggugcaacugguccagagcggccucgagguuaagaaacccggggccuccgugagagugucuugcuggaccagcgaagacaucuucgauacaacggagcugauuuacuggguccggcaggcuccuggacagggccuugaauggaucgggugggugaagauuguuuccggaaccgugaacuuugccucucuggacuuccgcaauagaaucagccucucccgggaucgcgaccugucuacagcgcacauggauauuagaggccuuacccaagacgauacagcuaccuauuuuugugcccggcagaaauucgccagccgcuacuccggggaccagggaagcuauuuugaucuguggggcagaggcacacucaucaucgucucuuccgcu

SEQ ID NO: 41065 - RNA, 387 nt, Artificial Sequence
  derived and/or modified sequence opt5 from anti-HIV-1_HeavyChain
caggugcaacugguccagagcgccuccggcguuagacggcccggggcuucugugcgcgugagcugcuggaccuccgaggacaucuucgaaagaucugagcucauuuacuggguccggcaggccccuggacgcggccuggaauggaucggguggauuaaacuugugagcggagcgguuaacuuuggcuccguggauuucagagaccgggucucucugacacgcgauagagaccucuuuacggcucacauggauauccgggggcugacccaggacgauacagccaccuauuucugugcccgccaaaaguuugcuagcagauacuccggagaccagggcagcuauuucgaucuuuggggccgggggacacugauuaucgugucuuccgcc

SEQ ID NO: 41066 - RNA, 375 nt, Artificial Sequence
  derived and/or modified sequence opt5 from anti-HIV-1_HeavyChain
caggugcaacugguccagagcggcuccgggguuaagaaacccggagccucugugagagugagcugcuggaccuccgagggcaucuucgaaaagucugagcucauucacuggguccggcaggcuccugggcagggacuggaauggaucggcugggugaaaacaguuacgggggccgugaacuuuggacaucaaauuagcgaccgcgucucccuuaccagagaucgggaccuguucacagcgcacauggauauccgcggccucacccagggcgacacagcuaccuacuuuugugccagacagaaguucgagcgcgggggacagggcuggauuuuugaucugugggggcggggaacacuuaucgccgugucuagcgcu

SEQ ID NO: 41067 - RNA, 378 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagaaguccgaacucauucacuggguccggcaggccccuggacagggccuggaguggaucgggugggugaaaacaguuacgggagcggugaacuuuggcucuagcgauuuccgccaaagagucucccuuacccgggaccgcgaucuguuuacagcucauauggacauuagagggcucacccagggagauacagccaccuacuucugugcccggcagaaguuugaacgcggcggccaggggugguauuucgaccuguggggaagaggcacacuuaucgugguuucuagcgcu

SEQ ID NO: 41068 - RNA, 378 nt, Artificial Sequence
  derived and/or modified sequence opt5 from anti-HIV-1_HeavyChain
caggugcaacugguccagagcggcgccgagguuaagagacccggggcuuccgugaaagugucuugcuggaccagcgaagacaucuucgagcggacagaacucauucacuggguccgccaggccccuggacagggccuggaguggaucgggugggugaagacgguuuccggagcggugaacuuuggcucuccgaauuucagacaucgggucagccuuacccgcgauagagaccuguuuacagcucacauggauauucgggggcucacccaaggagacacagccaccuacuucugugcccgccagaaauuugaaagaggcggccaggggugguauuucgaucuguggggacggggcacacuuaucgugguuuccucugcu

SEQ ID NO: 41069 - RNA, 378 nt, Artificial Sequence
  derived and/or modified sequence opt5 from anti-HIV-1_HeavyChain
caggugcaacugguccagagcggcuccgggguuaagaaacccggagccucugugagagugagcugcuggaccuccgaggacaucuucgaaggcucugagcucauucacuggguccggcaggcuccugggcagggacuggaauggaucggcugggugaagacaguuacgggggccgugaacuuuggaagcgcguacuuccgccauagagucucccuuacccgggaucgcgaccuguuuacagcucacauggauauuagaggccucacccaaggcgacacagccaccuauuucugugcccggcagaaauuuaugucugggggacagggcugguacuucgaucugugggggcgcggaacagugaucguugugagcuccgcu

SEQ ID NO: 41070 - RNA, 387 nt, Artificial Sequence
  derived and/or modified sequence opt5 from anti-HIV-1_HeavyChain
caggugcaacugguccccagcggcuccgggguuaagaaaccuggagccucugugagagugagcugcuggaccuccgaggacaucuucgaacggacagagcucauucacuggguccgccaggcuccgggccaggggcuggaauggaucggaugggugaagacgguuaccggcgccgugaacuuugggucucuugauuucagacaucggauuagccugacacgcgacagagaucucuuuaccgcgcacauggacauccggggacugacacagggcgauaccgcuacauacuucugugcccgccaaaaauuugaguccagauauaccggcgggcagggaugguacuucgaccuuuggggccgggggacgcauauugucgugucuagcgcc

SEQ ID NO: 41071 - RNA, 378 nt, Artificial Sequence
  derived and/or modified sequence opt5 from anti-HIV-1_HeavyChain
caggugcaacugguccagagcggcuccgggguuaagaaagugggagccucugugagagucagcugcuggaccuccgaggacaucuucgaacggacagagcucauucacugggugcgccaggcucccggccaggggcuggaauggaucggauggguuaaggccgugucuggcgcggucaacuacgggagccuugauuuuagacaucgggugucccugacgcgcgacagagaucucuucaccgcucacauggacauucggggacugacacaagaugacaccgccaucuauuuuugugcccgccagaaauucuacgcuggcggccaggggugguauuuugaucuuuggggaagaggcacacugauuguugugucuagcgcc

SEQ ID NO: 41072 - RNA, 387 nt, Artificial Sequence
  derived and/or modified sequence opt5 from anti-HIV-1_HeavyChain
caggugcaacugguccagagcggcgccgagguuaagaaacccggguccucugugagagugagcugcuggaccuccgaagacaucuucgagcggacagaacucauucacuggguccgccaggcuccuggacagggccuggaguggaucgggugggugaagacgguuaccggagccgugaacuuuggcucuccgaauuucagacaucgggucagccuuacacgcgauagagaccuguuuaccgcgcacauggauauucgggggcucacacaaggagacaccgcuacauacuucugugcccgccagaaauuugaauccagauauucuggcgaucagggcagcuacuucgaccugugggggcggggaacccuuaucauuguguccagcgcc

SEQ ID NO: 41073 - RNA, 375 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaucggaugggugaagccgguuacgggcgcugugaacuuugggucucccaauuuccggcaucgcgucagccugaccagagaccgggaucuuuuuacagcccacauggacauucgcggacugacccaaggcgauacagccaccuauuucugugcuagacagaaauacuaugccggcgggcagggaugguacuuugaccucuggggccgggggacacugaucgugguuuccucugcu

SEQ ID NO: 41074 - RNA, 375 nt, Artificial Sequence
  derived and/or modified sequence opt5 from anti-HIV-1_HeavyChain
caggugcaacugguccagagcggcgccgagguuaagaaacccggggcuuccguccaggugucuugcaaggccagcggauacccuuucaccaaauauuacaugcacugggugagacaggcgccgggccaagggcucgaauggaucggaugggugaaggcuguuuccggcgccgugaacuaugggucucuggacuuucggcaucgcgucagccuuacaagagaucgggaccuguccacggcccacauggauauucgcggacucacccaggacgauacagcuaccuacuucugugccagacagaaauuugcucggggcgaccagggcugguucuuugaucugugggggcgcggaacacuuaucgugguuucuagcgcc

SEQ ID NO: 41075 - RNA, 375 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacaggcuauuacaugcacugggucagacaggcgccugggcagggacucgaauggaucggcugggugaagacgguuuccggggcugugaacuuuggaucucugaauuuccggcaucgcgucagccuuaccagagaccgggaucuguuuacagcccacauggacauucgcggccucacccaaggcgauacagccaccuauuucugugcuagacagaaauuugcccgcggggaccagggaugguucuuugaucuguggggccgggggacacuuaucgugguuuccucugcu

SEQ ID NO: 41076 - RNA, 402 nt, Artificial Sequence
  derived and/or modified sequence opt5 from anti-HIV-1_HeavyChain
caggugcaacugguccagagcggcuccgggguuaagaaacccggagccucugugagagugagcugccgggcuuccgaggaccucuucggcgaugaaaucauuuacgacgaugaggucauccacuggcugcgccaggugccugggcagagaccggaauggaugggauggauucggcccaagaccggcgcccgcaaccaagcgagacaguuucagccucggaucucucuuacacgcgacagagcucugagcacggccuaucucgaucuuaauucccugaccucugccgacagcgggacauacuucugugcucggcagaccuuuaaacccgauuucuauuuugccgaccaaggaugguccuucaaccuguggggccgcggcgcucauuuuauuguuagcucugcc

SEQ ID NO: 41077 - RNA, 381 nt, Artificial Sequence
  derived and/or modified sequence opt5 from anti-HIV-1_HeavyChain
caggugcaacugguccagagcggcgggggaguuaagaaacccggcgccuccgcuucuuucagcugcagaaccuccgaggacccuuuugauaacgaauuuuucgacucugaguucaugcacugggugcggcucacaccggggcagcgccccgaauggaugggauggaugaauccuagaagcggcggggugaacuacgccggacaguuucggccccgcauguccauguggagagaucgggagcugucuacggcguauauggaacuucgcgaccugaccuucgcugauacaggccucuacuuuugugccagacggaaggaggacgauuaugacugguacuaugaucuguggggccgcggggcccauaucauugucagcgcugcc

SEQ ID NO: 41078 - RNA, 384 nt, Artificial Sequence
  derived and/or modified sequence opt5 from anti-HIV-1_HeavyChain
caggugcaacugguccaggccggcgggggaguuaagaaacccggcgcuagcgugacccucuccugcaagacagccgacgaggauguguucgacgcggcuuacaugcacugggucagacaggccccugggcagacguuugaauggcugggauggaugaaaccggugaccggcgccguuaacuaugcucggaaguuccaagggcgcgugucuuuuuacagaacacgggagcuuggaaucgccuauauggaucugcgcaaucucagauucgacgauaccgcugucuacuuuugugcccggaaaacagcgggcgacgugagcggcgauaagcgcggguucuuuuucgaccuguggggaagaggcucccggguuauugugucuagcgcc

SEQ ID NO: 41079 - RNA, 384 nt, Artificial Sequence
  derived and/or modified sequence opt5 from anti-HIV-1_HeavyChain
caggugcaacugguccagagcggcgccgagguuaagaaacccggggcuuccgugacccucucuugcaagacagccgacgaagauguguucgacgcggcuuacaugcacugggucagacaggccccuggacagacguuugaguggcugggcuggaugaaaccggugaccggggccguuagcuaugcucggaaguuccaaggacgcguguccuuuuacaugacaagagaacuuggcauggccuauauggaucugcggaaccuccgcuucgacgauaccgcugucuacuuuugugccagaaaaacagcgggggacgugucuggagauaaucggggcuauuucuuugaccuguggggccgcgggagcagaguuaucguguccucugcc

SEQ ID NO: 41080 - RNA, 384 nt, Artificial Sequence
  derived and/or modified sequence opt5 from anti-HIV-1_HeavyChain
caggugcaacugguccagagcgaggccgaaguuaagaaacccggcgcuuccaugaccgugucuugcgagacagccgacgaagauaucuucgacgcggcuuacaugcacugggugagacaggccccugggcagacguuugaguggcucggauggaugaagccggucaccggcgccgugaacuaugcucggaaauuccaagggcgcauuagcuuuuacagaacacgggaacuggccaucgcuuauauggaucuucgcgaccugagauucgaugacaccgccguuuacuuuugugcgcggaagacagccggagauguguccggcgacaaucgcggguauuucuuugaucucuggggaagaggcucucgggucauugugagcuccgcu

SEQ ID NO: 41081 - RNA, 420 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcuccuguggguucggcaggccccuggacagggccuugaauggauugggugggugaagaucgugagcggaaccgucaacuuugcgucccuggacuuccgcaauagaauuucucucagccgggaucgcgaccuguccacagcucauauggauaucagaggccuuacccaggacgauacagccaccuacuauugugcccggcaaaaauuugcuagccgcuacucuggggaccagggauccuauuucgaucuguggggcagaggcacacucauuaucgugagcucugccuccaccaaggggccgagcguuuuuccccacgaccug

SEQ ID NO: 41082 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguuuaccgcgcauauggacauccgcgggcucacacagggagauaccgcuacauauuucugugccagacagaaauuugaacggggcggccaagggugguacuucgaccuguggggacgcggcacccuuauugugguuuccagcgccucuacgaacgggccgaucggacugcccccuagauccgcu

SEQ ID NO: 41083 - RNA, 423 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccuguauuccgacgaucagggcagcuacuucgaccuuugggggcgcggaacacugaucauugugucuuccgcuagcaccaaaggcccgucuuccagccccacgaucugc

SEQ ID NO: 41084 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagcgcuuccaccaagggacccagcguguuuccucacgaccugcgc

SEQ ID NO: 41085 - RNA, 411 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagcucccugcaccagggacccagcggccucccucaugac

SEQ ID NO: 41086 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuuccccaugaucugaga

SEQ ID NO: 41087 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuauugugcccgccaaaaauucgaaucucuguacagcgaugaccagggcuccuauuuugaucuuugggggagaggaacacugaucauugugagcucugcuuccaccaagggccccagcgucuucccucacgaccuccgg

SEQ ID NO: 41088 - RNA, 384 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagaagucugaacucauucauugggugcggcaggcuccuggccaggggcuggaguggaucggaugggucaaaacagugacgggcgccguuaacuuugggagcuccgauuuccgccagagagugucucuuacccgggaccgcgaucuguuuacagcgcacauggacauuagaggacucacccaaggcgauacagcuaccuacuucugugcccggcagaaguuugaaagccgcuauacaggcgggcagggaugguacuucgaccuguggggcagagggacccauaucgucguguccagc

SEQ ID NO: 41089 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugaacuacgcccggaaguuccagggccgcguuucuuuuuauagaacacgggaacuggggaucgcuuacauggaucuucgcaaucugagauucgacgauaccgccguguauuuuugugcgcggaaaacagccggagacgucagcggcgauaagcgcggcuucuuuuucgaccucugggggagaggaucccgggugauuguuucuagcgcuuccaccaagggccccucuguguuuccucaugaucugcgc

SEQ ID NO: 41090 - RNA, 414 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugccagaggcgaucaggggugguucuuugaccuguggggacggggcacgcuuaucguggucuccucugcuagcaccaaggggcccuccguguucccuacaauuugc

SEQ ID NO: 41091 - RNA, 411 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaucggaugggugaagccgguuacgggcgcugugaacuuugggucucccaauuuccggcaucgcgucagccugaccagagaccgggaucuuuuuacagcccacauggacauucgcggacugacccaaggcgauacagccaccuauuucugugcuagacagaaauacuaugccggcgggcagggaugguacuuugaccucuggggccgggggacacugaucgugguuuccucugcuagcaccaagggaccuguggucuuccccacgauuugc

SEQ ID NO: 41092 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccgggugauuguuucuagc

SEQ ID NO: 41093 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggauggauuaagacggugaccggcgcggucaacuuugggucucuugauuucagacaccggaucagccugacacgcgacagagaucucuuuaccgcucauauggacauucggggacugacacagggcgauaccgccacauacuucugugcccgccaaaaauuugaauccagauauaccggcgggcagggaugguacuucgaccuuuggggccgggggacgcacaucgugguuucuagc

SEQ ID NO: 41094 - RNA, 420 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaacggggaggccaaggcugguacuuugaucugugggggcgcggaacccuuauugugguuagcucugccuccacggagggcccgagcagaucuuucccccagauccugcgg

SEQ ID NO: 41095 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucugcgugagcuccgccagcccgagagcucaucggucuagcccccgcuccgcc

SEQ ID NO: 41096 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccgcggcgauacagccaccuacuauugugccagacagaaauucgaaucucgguacacaggcgggcaaggaugguauuuugaccuuuggggccgcgggacccacauuguugugagcucc

SEQ ID NO: 41097 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuaucguuagcucc

SEQ ID NO: 41098 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacgagcauuuuuaucggaugugaccggccucucgauaaggacugguccggccuugggggaucuaaacugagccuggccccguccauuuucgcgagccucgauuuucgcaacagaaucucucugucccgggaccgcgaucuuagcaccgcuuacauggacauuagaggccugacacaggaugacaccgccacauauuucugcgcccggcagaaguuugcuucucgcuacuccggggaucagggaagcuauuucgaccucuggggcagaggcacccugaucguugugucuuccgccagcacaaaagggcccuccguguuuccucaugaucug

SEQ ID NO: 41099 - RNA, 399 nt, Artificial Sequence
  derived and/or modified sequence opt5 from anti-HIV-1_HeavyChain
agagaguaccuggaacagagcggcgggggagugaagaaacucggcgccuccguccggguuucuugccgcgcuagcgaggaccuguucggggaugaagugaucuaugacgaugagcuuauucacuggcugagacaagugcccggacagcggccugaauggaugggcuggauccgcccgaagaccggggccagaaaccaggcgcggcaguuucaaccccgcauuaaucucuccagagaccgggcucugaacacagccuaccuugaucugucuagccucacguccgccgacucugcuaccuauuucugugcccgccagacauuuaaaccugauuucuacuuugcugaccagggauggagcuucaaucuguggggcagaggcgcccgggucaucguguccagc

SEQ ID NO: 41100 - RNA, 384 nt, Artificial Sequence
  derived and/or modified sequence opt5 from anti-HIV-1_HeavyChain
caggugcaccugguccaaagcggcgccgagguuaagaaacccggguccucugugagagugagcugcuggaccuccgaagacaucuucgagcggacagaacucauucauuggguccgccaggcuccuggacagggccuggaguggaucgggugggugaagacgguuaccggagccgugaacuuuggcucuccgaauuucagacaccgggucagccuuacacgcgauagagaccuguuuaccgcgcauauggauauucgggggcucacacagggagacaccgcuacauacuucugugcccgccaaaaauuugaauccagauauucuggcgaucagggcagcuacuucgaccugugggggcggggaacccuuaucauuguguccagc

SEQ ID NO: 41101 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccuccacaaagggacccagcgucuuuccuaccaucugc

SEQ ID NO: 41102 - RNA, 441 nt, Artificial Sequence
  derived and/or modified sequence opt5 from anti-HIV-1_HeavyChain
agagaguuccuggaacagagcggcgggggagugaagaaacucggcgccucccugcgggucucuugccgcgcuagcgaggaccuuuuuggggaugaguucaucuacgacgaugaaguuauucacuggcugagacaagugcccggacagcggccugaauggaugggcuggauccgcccgaagaccggggccagaaaccaggcgacacaguuucaaccccggauuucccucacgcgcgacagagcucugucuaccgccuaucuugaucugaauagccucacauccgccgacucuggaaccuacuucugugcucggcagacauuuaaaccugauuucuauuuugccgaccagggcuggagcuucaaccuguggggccgcggggcucauuuuaucguguccagcgccucuaccaagggacccuccgucuucccucacgauagcgcg

SEQ ID NO: 41103 - RNA, 399 nt, Artificial Sequence
  derived and/or modified sequence opt5 from anti-HIV-1_HeavyChain
agagaguaccuggaacagagcggcgggggagugaagaaacucggcgccucccugcgggucucuugccgcgcuagcgaggaccuuuucggggaugaaaucauuuaugacgaugagguuauccacuggcugagacaagugcccggacagcggccugaauggaugggcuggauucgcccgaagaccggggccagaaaccaggcgcggcaguuucaaccccgcaucucccucacaagagaccgggcucugucuacggccuaccuugaucugaauagccucaccuccgccgacucuggaacauauuucugugcucgccagaccuuuaaaccugauuucuacuuugccgaccagggcuggagcuucaaccuguggggcagaggggcucauuuuauuguguccagc

SEQ ID NO: 41104 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcucc

SEQ ID NO: 41105 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuagagugaucguuagcucc

SEQ ID NO: 41106 - RNA, 414 nt, Artificial Sequence
  derived and/or modified sequence opt5 from anti-HIV-1_HeavyChain
caggcccaccuggagcaaagcggcaccggggugaagaaacccggagcuuccgucagaguuucuugcuggacaagcgaagacaucuucgagaaguccgaacucauucauugggugcggcaggccccuggccaggggcuggaguggaucggaugggugaaaauugucucuggcgcggugaacuuugggagcccgaauuuccgccagagaguuucccuuacgcgggaucgcgaccuguuuaccgcucaaauggauaucagaggacucacacagggcgacaccgccacauacuucugugcccggcagaaguuugaacgcggcgggcagggauggauuuucgaucuguggggcagagggacccuuaucgcugugucuagcgccuccacaaaaggacccagcgucuuuccucacgaccug

SEQ ID NO: 41107 - RNA, 399 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuggg

SEQ ID NO: 41108 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacaugaucgcgaccuguuuaccgcucacauggauauuagaggacucacacagggcgacaccgccacauacuucugugcccggcaaaaauuuuaugcuggcgggcagggaugguacuucgaucuguggggccgcgggacccuuaucugcguguccucugccagcacgaagggacccuccggccugccucccagaagc

SEQ ID NO: 41109 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagccuguacuccgaugaccagggcagcuauuucgaucucuggggcagagggacccugaucauugugucuuccgccagcacaaagggaccuucugucuuuccgcacgaccugcgg

SEQ ID NO: 41110 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuauugugcccgccaaaaauucgaaagaggcgggcagggaugguacuuugaucuguggggccgggggacacuuaucguggucucuagcgcuuccaccaagggacccagcguguucccuacgauuuau

SEQ ID NO: 41111 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuauugugcccgccaaaaauucgaaucuagauacacaggcgggcagggaugguauuuugaccuuuggggccgggggacccacauuguugugagcucc

SEQ ID NO: 41112 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuacugugcucggcaaaaauucuauaaagggggacagggcugguacuuugaucugugggggcgcggaacacuuaucguggucucuagcgccuccaccaagggcccgagcguguuccccacgauuugc

SEQ ID NO: 41113 - RNA, 399 nt, Artificial Sequence
  derived and/or modified sequence opt5 from anti-HIV-1_HeavyChain
agagaguaccuggaacagagcggcgggggagugaagaaacccggcgccuccguccggguuucuugccgcgcuagcgaggaccucuucggggaugaaaucauuuaugacgaugaggugauccacuggcugagacaagugccuggacagcggccggaauggaugggcuggauucgccccaagaacgggggaagaaaucaggcccggcaguuucaaccucgcaucucccuuaccagagaccgggcgcugaacacagcuuaccucgaucuuaauucucugacgagcgccgacuccggcaccuauuucugugcccgccagacauuuaaacccgauuucuacuuugcugaccagggcuggucuuucaaccugugggggagaggagcccgggucauugugagcucc

SEQ ID NO: 41114 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcucc

SEQ ID NO: 41115 - RNA, 420 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuagagugaucguuagcuccgccucuaccaaggggcccagcguguucccuacaauuugc

SEQ ID NO: 41116 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagucugacacagccaccuauuucugugcucggcaaaaauuuuacgccggcgggcagggaugguauuucgaucuguggggccgcgggacacuuaucguggucagcuccgcuagcaccaagggaccgucuguguuuccccacgaccugaga

SEQ ID NO: 41117 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgugagcucugccuccccgaaggggcccagcggacucccuccccgcucugcu

SEQ ID NO: 41118 - RNA, 411 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacaacguauggcaucuccugggucagacaggcgccugggcagggacucgaauggauuggcugggugaagaccguuacaggggcugugaacuuuggacaccaaaucucugaccgggucagccugacccgcgauagagaccuuuucacagcccauauggauauucggggccugacccagggcgacacagccaccuacuuuugugcucgccagaaauucuaugccgggggacagggcugguacuuugaucucugggggagaggaacgcugaucgugguuuccucugcuagcaccaagggcccguccguguucccccacgaccuucgg

SEQ ID NO: 41119 - RNA, 417 nt, Artificial Sequence
  derived and/or modified sequence opt5 from anti-HIV-1_HeavyChain
caggcccaacuggagcagagcggcuccggggugaagaaacccggagcuucugucagaguuagcugcuggaccuccgaagacaucuucgagcggacagaacucauucacugggugcgccaggccccuggccaggggcuggaguggaucggaugggugaagacggucaccggcgcggugaacuuugggucuagcgauuucagacaacggguuucccuuacacgcgacagagaucuguuuaccgcucauauggacauucggggacucacacagggcgauaccgccacauacuucugugcccgccagaaauuuuaugcuggcgggcagggaugguacuucgaccuguggggcagagggacccuuaucguggucucuagcgccuccacgaagggaccgagcguguuuccccacgaucugcgg

SEQ ID NO: 41120 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuauugugcccgccaaaaauucgaaagaggcgggcagggaugguacuuugaucuguggggccgggggacccuuaucguggucuccucu

SEQ ID NO: 41121 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuauugugcccggcagaaguucgaaagccgcuacacaggcgggcagggaugguauuuugaccuguggggcagagggacccauaucguggucuccagc

SEQ ID NO: 41122 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucugcuagcacgaagggacccuccguguuuccuaccauuugc

SEQ ID NO: 41123 - RNA, 381 nt, Artificial Sequence
  derived and/or modified sequence opt5 from anti-HIV-1_HeavyChain
caggugcaacugguccagagcggcgccgagguucagaagcccggggcuuccgugaccgugucuugcaaagccagcggauacacacucaucuccuauggcauuucuugggucagacaggcgccugggcaaggaccggaauggaugggcuggauccggcccaagacgggggcucgcaaccaggccagacaguuccagccucggauuagccugacccgcgacagagcccuuuccacagcuuaccuggaucucaauucucugaccagcgccgacuccggaacauauuuuugugcucggcaaaccuucaaacccgauuuuuacuucgccgaccagggcuggagcuuuaaccuuuggggccgcggggcgcacuucaucgugucuucc

SEQ ID NO: 41124 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacauccuccggaagaaagagcugauucauugggugcgccaggccccuggccaggggcuugaauggaucggaugggugaagacagucacgggcaccgugaacuucgggucuagcgauuuuagacagcggguuucccugacacgcgacagagaucucuucaccgcgcacauggacauucggggacugacacaaggcgauaccgcuacauaccuuugugcccgccagaaauuugagagaggcgggcagggauggaucuucgaccuguggggccgggggacccucauugccgugucuagcgcuuccacgaagggaccgagcgucuuuccccaugaucug

SEQ ID NO: 41125 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaauggaccgaucggccugccccaucgcucugcc

SEQ ID NO: 41126 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucggcaagucugagcucauucauugggugcggcaggccccugggcagggacuggaauggaucggcugggugaaaacagucacgggggcggugaacuuuggaagcuccgauuuccgccagagaguuucucuuacccgggaccgcgaucuguuuacagcucacauggacauuagaggccucacccaaggcgauacagccaccuacuucugugcccggcagaaguuugagagccuguauuccgacgaucaggggagcuacuucgaccuuuggggacgcggcacacugaucauugugucuucc

SEQ ID NO: 41127 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggaugguauuucgaucuguggggccgggggacccuuauuguggucucuagcgcuuccacaaagggacccagcggccugccucaugggucugcc

SEQ ID NO: 41128 - RNA, 423 nt, Artificial Sequence
  derived and/or modified sequence opt5 from anti-HIV-1_HeavyChain
caggugcaauacggcagagaggccggggcuggaaugaagaaacccggcgccagcaugaccgucuccugcaagacagcggacgaagauaucuucgacgcugccuauaugcaccggguucgccaggccccugggcagacguuugaguggcugggauggaugaaaccggugaccggcgcugugaacuacgccagacaguuccaagggcgggucucuuuuuaucgcacaagagaacucggaauugcuuacauggaucugcgggaccuuaaguucgaugacaccgccguguauuuuugugcgcgcaaaacaaagggcgauguuagcggcgacgauagaggguucuuuuucgaccuguggggacggggcacccgcgugaucgucuccucugccagcacaaaggggcccuccguguuuccuaccauuuac

SEQ ID NO: 41129 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcacauuguugugucuagcgcuuccaccaagggaccgagcgucuuuccccaugaucugcgc

SEQ ID NO: 41130 - RNA, 423 nt, Artificial Sequence
  derived and/or modified sequence opt5 from anti-HIV-1_HeavyChain
caggugcaacugguccagagcgaggccgaacucaagaaacccggcgcuuccguuucugugagcugcaaggccuccggguacucuuucaccagcuauggaaucuccugggugagacaggucccuggccaggggcuggaguggauugcguggauccggccgaaaacaggagcucgcaaccaagccagacaguuucagccccggauuucucuuacgcgcgacagagcccugagcaccgcuuaccucgaucuuaauucccugacaagcgccgacucuggcaccuauuucugugcucggcagacauuuaagccugauuucuacuuugccgaccaagggugguccuucaaccuguggggacgcggcgcgcacuuuaucgugagcucugccuccaccaaaggccccagcguuuucccucaugaucucaga

SEQ ID NO: 41131 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuauugugcccgccaaaaauucgaaagaggcgggcagggaugguacuuugaucuguggggccgggggacccuuaucguggucuccucugcuagcacgaagggacccuccguguucccucacgaccug

SEQ ID NO: 41132 - RNA, 381 nt, Artificial Sequence
  derived and/or modified sequence opt5 from anti-HIV-1_HeavyChain
caggugcaacugguccagagcggcgccgagguucagaagcccggggcuuccgugaccgugucuugcaaagccagcggauacacacucaucuccuauggcauuucuugggucagacaggcgccugggcaaggaccggaauggaugggcuggauccggcccaagacgggggcucgcaaccaggccagacaguuccagccucggauuagccugacccgcgacagagcccuuuccacagcuuaccuggaucucaauucucugaccagcgccgacuccggaacauauuacugugcucggcaaaccuuuaaacccgauuucuauuuugccgaccagggcuggagcuucaaccuuuggggccgcggggcgcacuuuaucgugucuucc

SEQ ID NO: 41133 - RNA, 414 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcguguuuccgcagauuugc

SEQ ID NO: 41134 - RNA, 378 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucugcguguccucugcu

SEQ ID NO: 41135 - RNA, 438 nt, Artificial Sequence
  derived and/or modified sequence opt5 from anti-HIV-1_HeavyChain
cagggcuaccuggcccaaagcgggggaggcgugaagaaacccgggaccuccgcuucuuucagcugcagaacauccgacgauaucuaugacaacgaguuuuucgauucugccuuuaugcacuggguccggcucauuccuggacagcgcccggaauggaugggcuggaugaaucccagaagcggggcgguuaacuacgcucggcagcugcagccucgcguguccauguauagagaccgggaucuuucuacggccuaccuggaccucaauagccugaccuccgccgauagcggaacauauuucugugcucgccaaaccuuuaagcccgacuucuacuuugccgaucagggcuggucuuucaaccuuuggggcagaggggcucauuuuaucguguccagcgccucuacaaaaggaccuuccguccugccccacgaccuccgg

SEQ ID NO: 41136 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucacgcauugggugcgccaggccccuggccaggggcuggaguggauuggaugggugaagaucgucucuggcgcggugaacuuugggagcccgaauuucagacagcggguuucccuuacccgcgauagagaccuguuuacagcucacauggauauucggggacucacccaaggcgacacagccaccuacuucugugcccgccagaaauuugaaagaggcgggcagggauggaucuucgaucuguggggccgggggacacuuauugcugugucuagcgccuccaccaagggacccagcgucuuuccucgcucugcu

SEQ ID NO: 41137 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagaaagaacucauucauugggugcggcaggccccuggccaggggcuggaguggaucggaugggugaagacagucacgggcgcggugaacuuugggucuagcgauuuccgccagagaguuucccuuacccgggaccgcgaucuguuuacagcucacauggacauuagaggacucacccaaggcgauacagccaccuacuucugugcccggcagaaauuuuaugcuggcgggcagggaugguacuucgaccuguggggccgcgggacacuuaucguggucucuagcgccuccaccaagggaccgagcguguuuccccaugaucug

SEQ ID NO: 41138 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagccuugauuuccgccacagaauuucccugacccgggaccgcgaucucuuuacagcucauauggacaucagaggacugacccagggcgauacagccaccuacuauugugcccggcaaaaguucgaaucucgcuacacaggcgggcagggaugguauuuugaccuuuggggcagagggacccacauuguugugagcucc

SEQ ID NO: 41139 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuauugugcccggcagaaguucuacgcuggcgggcagggaugguauuuugaccuguggggccgcgggacacuuaucguggucagcuccgccagcaccaaaggaccgucuguguuccccacgauuugc

SEQ ID NO: 41140 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagccuguacuccgaugaccagggcagcuauuucgaucucuggggcagagggacccugaucauugugucuucc

SEQ ID NO: 41141 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauuugaaucucgcuacacagggggacagggcugguauuucgaucugugggggagaggaacccacaucguggucagcuccgccagcacgaagggcccgucuguguuuccccaugaccuucgg

SEQ ID NO: 41142 - RNA, 408 nt, Artificial Sequence
  derived and/or modified sequence opt5 from anti-HIV-1_HeavyChain
caggugcaacugguccacagcggcgccgagguuaagaaacccggggcuuccaugaaggugucuugcaaaaccagcggauacuccuucacaggcuauuacaugcauugggugagacaggccccugggcagggacucgaauggaugggcuggaucaacccgucuagcaaugacacgaacuaugcgcagaaguuucaagggcgggucaccaugacacgcgauaccuccauuaauacagcuuacauggagcugucuagacuucggagcggagacaccgccaucuauuucugugcccgccagaaauuuuacgcuggcggccaggggugguauuucgaucuguggggaagaggcacacucauugugguuuccagcgccucuaccaaggggcccuccguguuuccuacgaucugc

SEQ ID NO: 41143 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggcgcuuccaggggagaguuagcuuuuauaugacacgggaacugggaauggccuacauggaucuucgcaaccugagauucgacgauaccgcuguguauuuuugugcccggaagacagcgggcgacgucuccggcgauaaucgcggguacuucuuugaccucuggggaagaggcucucgggugaucguuagcucc

SEQ ID NO: 41144 - RNA, 414 nt, Artificial Sequence
  derived and/or modified sequence opt5 from anti-HIV-1_HeavyChain
cagggcacccuggagcaaagcugguccgaagugaagaaacucggggccucugucagaguuagcugcuggacauccgaggacaucuucaagacggaacugauucacugggugcggcaggcucccggacagggccuugaguggaucgggggaaugaaagccgugucuggcgcggucaacuacgggagccuggauuuucgccauagagugucccucaccccugaccgggaucugucuacagcucacauggacauucgcggacuuacccaggaugacacagccaccuauuucugugccagacaaaaguuugcucggggcgaucagggcugguucuuugaccugugggggcgcggaacacucaucguugugagcuccgccagcaccaaaggcccgucugucuucccccaugaucugaga

SEQ ID NO: 41145 - RNA, 423 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugcuagccuugauuuccgcaauagaauuucccugucucgggaccgcgaucucagcaccgccuacauggacaucagagggcugacacaggaugacaccgccacauauuuuugugcucggcaaaaguucgccucccgcuacagcggagaucagggcucuuauuuugaccuuuggggcagagggacccugauuugcguuuccagcgcuucuacacgggcccaccgccucccgcccagauccgcg

SEQ ID NO: 41146 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugcuagaggcgaucaggggugguucuuugaccuguggggacggggcacccuuaucguggucuccucugccagcccccgcgcucacagauccagcccucggucugcc

SEQ ID NO: 41147 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuuccccaugauuccgcu

SEQ ID NO: 41148 - RNA, 414 nt, Artificial Sequence
  derived and/or modified sequence opt5 from anti-HIV-1_HeavyChain
caggcccaccuggugcaaagcggcuccggggucaagaaacccggagcuucuguuagagugagcugcuggaccuccgaggacaucuucaagucugaacucauucauugggugcggcaggccccuggccaggggcuggaguggaucggaugggucaaaacagugacgggcgcgguuaacuuugggagcuccgauuuccgccagagagugucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucgucgugagcuccgccagcaccaaaggaccgucuguuuuuccccaugaucugaga

SEQ ID NO: 41149 - RNA, 414 nt, Artificial Sequence
  derived and/or modified sequence opt5 from anti-HIV-1_HeavyChain
caggcccaacuggagcagagcggcuccggggugaagaaacccggagcuucugucagaguuagcugcuggaccuccgaagacaucuucaagacagagcucauucacugggugcggcaggccccuggccaggggcuggaauggaucggaugggugaaaacggucaccggcgcggugaacuuugggucuccgaauuuccgccauagaguuagccuuacacgggaucgcgaccuguuuaccgcucacauggauauuagaggacucacacaaggcgacaccgccacauacuucugugcccggcagaaguuugagcgcggcgggcagggaugguauuucgaucuguggggcagagggacccuuaucguggucuccucugcuagcacgaaaggacccuccguguuuccucaugaccugcgg

SEQ ID NO: 41150 - RNA, 417 nt, Artificial Sequence
  derived and/or modified sequence opt5 from anti-HIV-1_HeavyChain
caggcccaccuggagcaaagcggcagagaagugaagaaacccggggcuuccguccggguuucuugcuggaccagcgaggacaucuucgaaaaguccgagcucauucauugggugcgccaggccccuggacagggccuggaauggaucgggugggugaaaacagucacgggagcggugaacuuuggcucuagcgauuucagacagcggguuucccuuacccgcgacagagaucuguuuacagcucacauggacauucgggggcucacccaaggagauacagccaccuacuucugugcccgccagaaguuuuaugcuggcggccaggggugguacuucgaccuguggggaagaggcacacuuaucguggucucuagcgccuccaccaaagggccgagcguguuuccccaugaucugcgg

SEQ ID NO: 41151 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggauuucccuuacccgcgauagagaccuguuuacagcucauauggauauccggggacucacccagggcgacacagccaccuacuauugugcccgccaaaaauucgaaucuagauacacaggcgggcagggaugguauuuugaucuguggggccgggggacccacauuguugugagcucc

SEQ ID NO: 41152 - RNA, 375 nt, Artificial Sequence
  derived and/or modified sequence opt5 from anti-HIV-1_HeavyChain
caggcccaccuggagcaaagcggcuccggggugaagaagcccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuacugugcucggcaaaaauucuauaaagggggacagggcugguacuuugaucugugggggcgcggaacacuuaucguggucucuagc

SEQ ID NO: 41153 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacagacuauuaccuccacugggucagacaggcgccuggccaggggcuggauugggugggauggaucaaccccaauuccggcgggacgaacuaugcucaaaaguuucagggacggguugccaugacccgcgacacaucucuuagcuccguguaccuggaucucaauucucugaccagcgccgacuccggcacauauuucugugcuagacagaccuuuaaaccggauuucuacuuugccgaccagggcuggagcuucaaccuuugggggcggggagcucauuuuauugucucuucc

SEQ ID NO: 41154 - RNA, 414 nt, Artificial Sequence
  derived and/or modified sequence opt5 from anti-HIV-1_HeavyChain
caggccgaccuggagcaaagcggcuccggggugaagaaacccggagcuucugucagaguuagcugcuggaccuccgaagauaucuucgagcggacaaacuacgugcacugggugcgccaggccccuggcagagggcucgaauggauuggauggucuaagacggucaccggcgcggugaauuuugggagcccgaacuuccggcaucgcguuucccugacaagagaccgggaucuuuuuaccgcucacauggacauccgcggacugacacagggcgauaccgccacauauuucugugccagacagaaauuugagcggggcgggcaaggaugguacuucgaccucuggggccgcgggacccugauuguggucucuagcgcuuccacgaagggacccagcguguuuccucaugaucuu

SEQ ID NO: 41155 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcaguuccaagggcgcgucucuuuuuauagaacacgggaacucggaauugccuacauggaucugcgcgaccuuaaguucgaugacaccgcuguguauuuuugugccagaaaaacaaagggcgauguuagcggcgacgaucggggguucuuuuucgaccuguggggacgcggcaccagagugaucgucuccucu

SEQ ID NO: 41156 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgugagcucu

SEQ ID NO: 41157 - RNA, 414 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacaaaccugauucauugggugcgccaggcccccggccaggggcuugaauggaucggaugggugaaggcggucucuggcgcugugaauuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuguguucccgcacgaucug

SEQ ID NO: 41158 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccggggaagacguguucgaugcggcuuauaugcacugggugagacaggccccuggacagacguuugaguggcucggcuggaugaaaccggucaccggggccgugaacuacgcucggaaguuccagggacgcguuucuuuuuauagaacacgggaacugggcaucgccuacauggaccuucgcaaucugagauucgaugacaccgcuguguauuuuugugcccggaaaacagcgggcgaugucagcggggacaagcgcggauucuuuuucgaucucuggggcagagggucccgggugauuguuucuagc

SEQ ID NO: 41159 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuacggugagcucu

SEQ ID NO: 41160 - RNA, 429 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucuggccugcccccuaccaucugccgc

SEQ ID NO: 41161 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugcucgcggcgaccaggggugguucuuugaucuguggggaagaggcacacuuaucguggucagcuccgccagcaccaaagggccgucuguguucccccaugaccugcgg

SEQ ID NO: 41162 - RNA, 417 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugaaagaggcgggcagggaugguauuucgaucuguggggccgggggacgcuuaucguggucuccucugccagcaccaagggacccuccguguuuccucacgaccugcgc

SEQ ID NO: 41163 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcggaagagaucuguuuaccgcucauauggacauucggggccucacacagggcgauaccgccacauacuauugugcccgccaaaaauucgaaagagggggacagggcugguacuuugaccugugggggcggggaacccuuaucguggucuccucugcuagcacgaagggccccuccguguucccucacgaucugcgc

SEQ ID NO: 41164 - RNA, 411 nt, Artificial Sequence
  derived and/or modified sequence opt5 from anti-HIV-1_HeavyChain
caggcccaccugggcgcuaacuggagcggggugaagaaacucggagccuccgucagaguuucuugcuggaccagcgaggacaucuucgaacggacagagcugauucauugggugcgccaagcgcccggccaggggcuugaauggaucggaugggugaaggcugucuccggcgccgugaauuacgggucucuggauuuuagacaccggguuagccucacgcgcgacagagaucuguccaccgcccauauggacauucggggacuuacacaggaugacaccgcuacauauuucugugcccgccagaaauuugcuagaggcgaucaaggcugguucuuugaccugugggggcggggaacccucaucguggucucuagcgccuccacaaagggcccuagcguguucccgcagauu

SEQ ID NO: 41165 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcucc

SEQ ID NO: 41166 - RNA, 423 nt, Artificial Sequence
  derived and/or modified sequence opt5 from anti-HIV-1_HeavyChain
caggcccaacuggagcagagcggcgugggggucaagaaacccggagcuuccguuagagugucuugccucgccagcgaagacaucuucaagaccgagcugauucacugggugcggcaggcgccuggccaggggcuugaauggaucggaugggucaaaacagugacgggcgcuguuaacuuugggucccaaauuuuccgccauagaaucucucugacccgggaucgcgaccucuuuacagcccacauggauauuagaggacugacccagggcgacacagccaccuacuucugugcucggcagaaguuugagagccgcuauacaggcgggcagggaugguacuucgaucuuuggggcagagggacccauaucguggucuccucugccagcacgaaaggaccguccguguuuccccacgaccugcgg

SEQ ID NO: 41167 - RNA, 411 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugcucaccagauuagcgaucgcguuucccuuaccagagaccgggaucuguucacagcccauauggacauccgcgggcucacccaaggagauacagccaccuacuuuugugcuagacagaaguucuaugccggcggccaggggugguacuuugaccuguggggacggggcacacuuauuguggucucuagcgcuuccaccaaagggccgagcguguuccccacgaucugc

SEQ ID NO: 41168 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauauuacgcuggcgggcagggaugguauuuugaucuguggggcagagggacacuuaucugcgugucuagc

SEQ ID NO: 41169 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagc

SEQ ID NO: 41170 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuuuugugcuagacagaaauucgcccggggcgaucaaggcugguuuuucgaccugugggggcgcggaacccucaucguggucucuagc

SEQ ID NO: 41171 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagggguguucgaugcggcuuauaugcacugggugagacaggccccuggacagacguuugaguggcucggcuggaugaaaccggucaccggggccgugaacuacgcucggaaguuccagggacgcguuucuuuuuauagaacacgggaacugggcaucgccuacauggaccuucgcaaucugagauucgaugacaccgcuguguauuuuugugcccggaaaacagcgggcgaugucagcggggacaagcgcggauucuuuuucgaucucuggggcagagggucccgggugauuguuucuagc

SEQ ID NO: 41172 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauacuaugccgggggacagggcugguacuuugaucugugggggcgcggaacacuuaucguggucucuagc

SEQ ID NO: 41173 - RNA, 378 nt, Artificial Sequence
  derived and/or modified sequence opt5 from anti-HIV-1_HeavyChain
cagguguacauggagcaacccggcgucgaaguuaccaagccuggggccagcgugacacuguccugcaaaacggcugaggacguguucgaugccgcguauaugcacugggucagacaggcuccgggacagaccuuugaauggcucggcuggaucaagcccgugacaggggccguuaacuacgcccggaaauuccagggacgcgugucuuuuuauagaacccgggagcugggcauugcuuacauggaccuucgcaaucugagauucgaugacacagccgucuauuuuugugcucggaagaccgccggggaugugagcggagacaaacgcggcuucuuuuucgaucucuggggcagagggucccggguuaucgugucuagc

SEQ ID NO: 41174 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaacgcggcgggcagggauggaucuucgaccuguggggcagagggacacuuauuaucgugagcucc

SEQ ID NO: 41175 - RNA, 384 nt, Artificial Sequence
  derived and/or modified sequence opt5 from anti-HIV-1_HeavyChain
caggcccaccuggugcaaagcggcuccgaggucaagaaacccggggcuuucguuagagugucuugcuggaccagcgaagacaucuuugaggaaacagagcucauucauugggugcggcaggccccuggacagggccuggaauggaucgggugggucaagacggugaccggagcgguuaacuucggcucccuugauuuucgccacagaauuucucugacacgggaccgcgaucucuucaccgcucauauggacaucagagggcugacacagggagauaccgccacauacuuuugugcccggcaaaaauucgagagccgcuauaccggcggccaggggugguacuuugaccuuuggggaagaggcacgcacauuguggucuccucu

SEQ ID NO: 41176 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcaaggccuccgaagacaucuucgagcggaccgaacucauucauugggugcgccaggcgccuggccaggggcuggaguggaucggaugggugaaaacagucacgggcgcugugaacuuugggucuccgaauuucagacaccggguuagccuuacccgcgauagagaccuguuuacagcccauauggauauucggggacucacccagggcgacacagccaccuacuucugugcucgccaaaaguuugaaagaggcgggcagggaugguauuucgaucuguggggccgggggacacuuaucguggucuccucu

SEQ ID NO: 41177 - RNA, 375 nt, Artificial Sequence
  derived and/or modified sequence opt5 from anti-HIV-1_HeavyChain
caggcccaccuggagcaaagcggcuccgaagugaagaaacccggggcuucugucagaguuagcugcuggaccuccgaggacaucuucgaacggacagagcucauucauugggugcgccaggccccuggacagggccuggaauggaucgggugggugaagacggucucuggagcggugaacuuuggcagcccgaauuucagacaccggguuucccuuacccgcgauagagaccuguuuacagcucauauggauauucgggggcucacccagggagacacagccaccuacuucugugcccgccaaaaauuugagagaggcggccaggggugguauuucgaucuguggggacggggcacacuuaucguggucucuagc

SEQ ID NO: 41178 - RNA, 375 nt, Artificial Sequence
  derived and/or modified sequence opt5 from anti-HIV-1_HeavyChain
caggcccaccuggugcaaagcggcuccggggucaagaaacccggagcuucuguuagagugagcugcuggaccuccgaggacaucuucgaaaagucugagcucauucauugggugcggcaggccccuggccaggggcuggaauggaucggaugggucaaaacagugacgggcgcgguuaacuuugggagcuccgauuuccgccagagagugucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucgucgugagcucc

SEQ ID NO: 41179 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagaggcggccaggggugguacuucgaucuguggggacggggcacccucaucugcgugagcucc

SEQ ID NO: 41180 - RNA, 375 nt, Artificial Sequence
  derived and/or modified sequence opt5 from anti-HIV-1_HeavyChain
caggcccaccuggagcaaagcggcuccggggugaagaaacccagagcuucuguccggguuagcugcuggaccuccgaagacaucuucgagaagucugaacucauucauugggugcgccaggccccuggacagggccuggaguggaucgggugggugaaaacagucacgggagcggugaacuuuggcagcuccgauuucagacagcggguuucucuuacccgcgacagagaucuguuuacagcucacauggacauucgggggcucacccaaggagauacagccaccuacuucugugcccgccagaaguuuuaugcuggcggccaggggugguacuucgaccuguggggaagaggcacacuuaucguggucagcucc

SEQ ID NO: 41181 - RNA, 381 nt, Artificial Sequence
  derived and/or modified sequence opt5 from anti-HIV-1_HeavyChain
caggugcaacuggagcaggccggcgcuggggucaagaaacccggaccuagcguuacccucuccugcaagacagccgacgaagauguguucgacgcggcuuacaugcacugggugagacaggccccgggccagacguuugaguggcugggguggaugaaacccgucaccggagccgugucuuaugcucggaaguuccaaggccgcguuagcuuuuacaugacaagagaacuugggauggccuauauggaucugcggaaccuccgcuucgacgauaccgcuguguacuuuugugccagaaaaacagcgggagacgucuccggcgauaaucggggcuauuucuuugaccugugggggcgcggaucuagagugaucguuagcucc

SEQ ID NO: 41182 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacagcggguuucccuuacccgcgauagagaccuguuuacagcucacauggauauucggggacucacccaaggcgacacagccaccuacuucugugcccgccagaaauuuuaugcuggcgggcagggaugguacuucgaucuguggggcagagggacacuuaucguggucucuagc

SEQ ID NO: 41183 - RNA, 381 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauguuuuugacgcugccuacaugcacugggugagacaggccccuggccagacguucgaguggcugggguggaugaaaccggugaccggagcugucaacuaugcccggaaguuucagggccgcgugucuuucuacagaacacgggaacucgggaucgcuuauauggaucugcgcaaucuuagauuugacgauaccgccguuuacuucugugcgcggaaaacagccggagacgugagcggcgauaagcgcggcuuuuucuuugaccugugggggagaggaucccgggucauugugucuagc

SEQ ID NO: 41184 - RNA, 375 nt, Artificial Sequence
  derived and/or modified sequence opt5 from anti-HIV-1_HeavyChain
caggcccaccuggagcaaagcggcuccggggugaagaaacccggagcuucugucagagccagcugcuggaccuccgaagacaucuucgagcggacagaacucauucauuggguucgccaggcgccuggccaggggcuggaguggaucggaugggugaagauugugucuggcgcugucaacuuugggagcccgaauuucagacagcgggugucccuuacgcgcgauagagaccuguuuaccgcccacauggauauccggggacucacacaaggcgacaccgccacauacuucugugcucgccagaaauuugaaagaggcgggcagggauggauuuucgaucuguggggccgggggacccuuaucgccguuucuagc

SEQ ID NO: 41185 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggcccgggggcagacguuugaguggcugggauggaugaaaccugugaccggcgccgugaacuacgcucgccaguuccaagggagagucucuuuuuaucggacacgcgaacucggaauugccuacauggaucugagagaccuuaaguucgaugacaccgcuguguauuuuugugcccggaaaacaaagggcgauguuagcggcgacgaucgcggguucuuuuucgaccuguggggaagaggcacccgggugaucgucuccucu

SEQ ID NO: 41186 - RNA, 384 nt, Artificial Sequence
  derived and/or modified sequence opt5 from anti-HIV-1_HeavyChain
caggcccaccuggagcaaagcggcgcuggggugaaggaacccggagccuccgucagaguuucuugcuggagcuccgaggacaucuucgaacggaccgagcucauucauugggugcgccaggcgccuggccaggggcuggaauggaucggaugggugaaaacagucacgggcgcugugaacuuugggucucuugauuucagacaccggauuagccugacccgcgacagagaucuccugacagcccauauggacauccggggacuuacccagggcgauacagccaccuacuuuugugcucgccaaaaguucgaguccagauauacaggcgggcagggaugguacuuugaccuguggggccgggggacccacauuguugugucuagc

SEQ ID NO: 41187 - RNA, 384 nt, Artificial Sequence
  derived and/or modified sequence opt5 from anti-HIV-1_HeavyChain
caggugcaacugguccagagcggcuccgccaugaagaaacccggggcuucuguuagagugagcugcuggaccuccgaggacaucuucgaacggacagagcucauuuacugggugcgccaggccccuggaagaggccuggaauggaucgggugggucaagacggugucuggaaccguuaacuuuggcagcuccgauuuccggaaucgcauuucucuuacaagagaccgggaucugagcaccgcgcacauggacauccgcgggcucacacaggaugacaccgcuacauauuuuugugccagacaaaaauucgagucccuguacagcgaugaccagggaucuuauuuugaucuuuggggccggggcacccugauuaucguguccagc

SEQ ID NO: 41188 - RNA, 384 nt, Artificial Sequence
  derived and/or modified sequence opt5 from anti-HIV-1_HeavyChain
caggcccaccuggugcaaagcgcuuccggcgucaagagacccggggccucuguucgggugagcugcuggaccuccgaggacaucuucgaacgcacagagcucauuuacugggugagacaggcgccuggacagggccuggaauggaucgggugggucaaaacggugucuggagcuguuaacuuuggcagccaggauuuccggcaucgcauuucccuuaccagagaccgggaucuguuuacagcccacauggacauccgcgggcucacccaaggagauacagccaccuauuucugugcuagacagaaguuugagucucgguacacaggcggccaggggugguauuucgaccuguggggacgcggcacccauauuguggucagcucc

SEQ ID NO: 41189 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaagcggggguucuuuuucgaccucuggggacgcggcucuagagugaucguuagcucc

SEQ ID NO: 41190 - RNA, 372 nt, Artificial Sequence
  derived and/or modified sequence opt5 from anti-HIV-1_HeavyChain
caggcccaccuggagcaaagcggcuccggggugaagaagcccggagcuucugucagaguuagcugcuggaccuccgaagacaucuucgagggcuacaugauucauugggugcggcaggccccugggcagggacucgaauggaucggcugggugaagacagucacgggggcggugaacuuuggaucugcuuauuuccgccacagaguuagccugacccgggaucgcgaccuuuuuacagcccauauggauauuagaggccugacccagggcgacacagccaccuacuucugugcucggcaaaaauuuuauaaagggggacagggcugguacuucgaucucugggggcgcggaacacugaucguggucuccucu

SEQ ID NO: 41191 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuuuugugcuagacagaaauucgcccggggcgaucaaggcugguuuuucgaccugugggggcgcggaacccucaucugcgugucuagc

SEQ ID NO: 41192 - RNA, 375 nt, Artificial Sequence
  derived and/or modified sequence opt5 from anti-HIV-1_HeavyChain
caggcccaccuggugcaaagcggcuccggggucaagaaaucuggagcuagcguuagaguguccugcuggaccucugaggacaucuucgaaaagagcgagcucauucauugggugcggcaggcccccggccaggggcuggaauggaucggaugggucaaaacagugacgggcgcgguuaacuuuggguccucugauuuccgccagagagugagccuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucgucguguccagc

SEQ ID NO: 41193 - RNA, 378 nt, Artificial Sequence
  derived and/or modified sequence opt5 from anti-HIV-1_HeavyChain
cagguguacauggagagagccggcgcuggggucaagaaacccggagccagcguuacccuguccugcaagacagcggacgaagauguguucggcgcuuauaugcacugggugcggcaagccccugggcagacguuugaguggcucggauggaugaaaccggucaccggcgccgugucuuacgcucgcaaguuccaggggagaguuagcuuuuauaugacacgggaacugggaauggccuacauggaccuucgcaaccugagauucgaugacaccgcuguguauuuuugugcccggaaaacagcgggcgaugucuccggcgacaaucgcggguacuucuuugaucucuggggaagaggcucucgggugaucguuagcucc

SEQ ID NO: 41194 - RNA, 375 nt, Artificial Sequence
  derived and/or modified sequence opt5 from anti-HIV-1_HeavyChain
caggcccaccuggagcaaagcggcuccggggugaagaagcccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauuuuacaaagggggacagggcugguauuucgaucugugggggcgcggaacacuuaucguggucucuagc

SEQ ID NO: 41195 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcgugagccuuacaagagaccgggaucuguuuaccgcgcauauggacauucgcgggcucacacaggaugacaccgcuacauauuucugugccagacagaaauuugcccggggagaucaaggcugguucuuugaccuguggggccgcgggacccuuaucguuguguccagc

SEQ ID NO: 41196 - RNA, 384 nt, Artificial Sequence
  derived and/or modified sequence opt5 from anti-HIV-1_HeavyChain
caggcccaccuggugcaaagcggcuccggggucaagaaacccggagcuucuguuagagugagcugcuggaccuccgaggacaucuucgaacggacagagcucauucauugggugcgccaggccccuggccaggggcuggaauggaucggaugggucaagacgguggcgggcgcuguuaacuuuucuagccuugauuucagacaccggauuucccugacccgcgacagagaucucuuuacagcccauauggacauccgggggcugacccagggagauacagccaccuacuucugugcucgccaaaaauuugagucuagauauacaggcggccaggggugguacuucgaccuuuggggacggggcacccacauuguggucagcucc

SEQ ID NO: 41197 - RNA, 384 nt, Artificial Sequence
  derived and/or modified sequence opt5 from anti-HIV-1_HeavyChain
caggcccaccuggagcaaagcggcuccggggugaagaaaucuggagcuagcgccagagucuccugcuggucuagcgaagacaucuucgagcggaccgaacucauucauuggguucgccaggcgcccggccaggggcuggaguggaucggaugggugaagacagugacgggcgcugucaacuuugggucccuugauuucagacaccggauuucucugacccgcgacagagaucucuuuacagcccauauggacauccggggacugacccagggcgauacagccaccuacuucugugcucgccaaaaauuugaaagcagauauacaggcgggcagggaugguacuucgaccuuuggggccgggggacccacauugugguuuccagc

SEQ ID NO: 41198 - RNA, 369 nt, Artificial Sequence
  derived and/or modified sequence opt5 from anti-HIV-1_HeavyChain
cugcuccagcuggugcaaagcggcgccgaggucaagaaacccggggcuuccguuaaggugaccugcaaagccucuggauacacauucacgggcuauauccacugggugagacaggcgccugggcagggacuugaauggauuggcugggucaaggcugugagcggggccguuaacuacggaucccuggacuuucggcaucgcgugucucucacccacgauagagaccugagcacagcccauauggauauccggggccuuacccaggacgauacagcuaccuauuucugugcccgccaaaaauuugcuagaggcgaccaggggugguucuuugaucuguggggacggggcacacucauugucguguccucu

SEQ ID NO: 41199 - RNA, 369 nt, Artificial Sequence
  derived and/or modified sequence opt5 from anti-HIV-1_HeavyChain
caggugcaacugguccagagcggcgccgagguuaagaaaccgggggcuuccgugaaggugucuugcaaagccagcggauguaccuucacaggcuacuauaugcacugggucagacaggcgccugggcagggacucgaauggaugggcuggaucaaccccaauuccgggggaacgaacuacgcucaaaaguuucagggccgggugaccaugacacgcgacaccucuauuagcacagccuauauggagcuguccagacuucggucugaugacaccgccguuuacuauugcgcucgccagaaauucgccagaggcgaucaggggugguuuuucgaccuguggggacggggcacacucaucguggucagcucc

SEQ ID NO: 41200 - RNA, 369 nt, Artificial Sequence
  derived and/or modified sequence opt5 from anti-HIV-1_HeavyChain
caggugcaacugguccagagcggcaccgagcucagaaagcccggggccuccguuaaagugucuugcaaggcuagcggauacacauucuccggcucuuauauccacugggugcggcaggccccugggcagggacuggaaugggucggcuggauuaacccgagcuccggggcgacgcaaugugcuaaaaaguuucaggacaaagugaccaugacacgcgauaccacaaauaacaccguuuacauggaggugaauagacuuaucucugacgauacagccaccuauuucugcgcccggcagaaguuugcucgcggagaccagggcugguucuuugaucuguggggcagagggacgcucauugucgugagcucc

SEQ ID NO: 41201 - RNA, 372 nt, Artificial Sequence
  derived and/or modified sequence opt5 from anti-HIV-1_HeavyChain
caggugcugcucguccaaagcggcgccgagguuaagaaacccggguccucugugaaggugagcugcaaaaccuccggagacucucugacaaaguacgcccuucacugggcuagacaggcgccuggccaggggcuggaauggaucggaugggucaaaacggugaccggcgcuguuaacuucgggagcuccgauuuucggcagcgcgugucucucacaagagaccgggaucuguucaccgcccauauggacauucgcggacuuacacaaggcgauaccgccacauauuuuugugcuagacagaaguucuacgccggcgggcagggaugguauuuugaccuguggggccgggggacccucaucgucgugagcucc

SEQ ID NO: 41202 - RNA, 372 nt, Artificial Sequence
  derived and/or modified sequence opt5 from anti-HIV-1_HeavyChain
caggugcaacugguccagagcggcaccgagguuaagacacccggggccuccgugaaagugucuugcaaggcuagcggauacacguucaccaacuaugacaucaauugggucagacaggccccuggccaggggcucgaauggauuggaugggugaaaacaguuaccggcgcggugaacuuuggguccucugauuuccggcaacgcgucagccugacaagagaccgggaucuuuuuaccgcucacauggacauccgcggacugacacagggcgauaccgccacguacuucugugccagacagaaguuuuaugcuggcgggcagggaugguacuucgaccucuggggccgggggacccugauugugguuuccucu

SEQ ID NO: 41203 - RNA, 372 nt, Artificial Sequence
  derived and/or modified sequence opt5 from anti-HIV-1_HeavyChain
caggugcaacugguccagagcggcgacgagguuaagaaacccggggccuccgugaaggugucuugcaaagcuagcggaaagggcuucccuaccucccucgucacaugggugagacaggccccggggcagggacuggaauggaucggcuggguuaaagcggugucuggggcugucaacuacggaagccuugauuuucggcaccgcgugucccugacgagagaccgggaucucuucaccgcccauauggacauucgcggccugacacaagaugacaccgccacauauuuuugugcuagacagaaguucgcccggggcgaucaggggugguuuuucgaccuuuggggacgcggcacccugaucguugugucuagc

SEQ ID NO: 41204 - RNA, 372 nt, Artificial Sequence
  derived and/or modified sequence opt5 from anti-HIV-1_HeavyChain
caggugcaacugguccagagcggcgccgagguuaagaaacccggguccucugugaaggugagcugcaaaaccuccggagacauccucacaaacuacggccugaauugggucagacaggcuccugggcagggacuugaauggauuggcugggugaaggccguuucuggggcggugaacuauggaagccuggauuuccggcaccgcgucucccucacgagagaccgggaucugucuaccgcucauauggacauccgcggccuuacacaagaugacaccgccacauacuuuugugccagacagaaauucgcucggggcgaucaggggugguuuuucgaccuguggggacgcggcacccucauugugguuagcucc

SEQ ID NO: 41205 - RNA, 372 nt, Artificial Sequence
  derived and/or modified sequence opt5 from anti-HIV-1_HeavyChain
caggugcaacugguccagagcggcgccgagguuaagaaacccggggcuuccgugagagugucuugcaagaccagcggauacccuuucucccgguauggcaucucuuggguccgccaggccccggggcagggacucguguggauggcguggguuaaagcugugagcggcgccgucaacuacgggucccuggacuuuagacaccgggugucucuuacacgcgauagagaccugagcacggcccauauggauauucggggacucacccaagacgauacagcuaccuauuucugugcccgccagaaguuugcuagaggcgaccagggcugguucuuugaucugugggggcggggaacacuuaucguuguguccagc

SEQ ID NO: 41206 - RNA, 372 nt, Artificial Sequence
  derived and/or modified sequence opt5 from anti-HIV-1_HeavyChain
agagagcagcuggugcaaagcggcgccgaagucaagaaacccggggcuuccguuaaggugucuugcaaaaccagcggaaacacauucggcuccuacgacuuuaauugggugcggcaggccccugggcagggacucgaguggaucggcugggucaagauugugucuggggcgguuaacuucggaagcccgaauuuucgccagagagugucccugacgcgggaucgcgaccuuuucaccgcucacauggauaucagaggccugacacaaggcgacaccgccacauauuuuugugcccggcagaaauucgaacgcgggggacagggcuggauuuuugaucucugggggagaggaacccugaucgcugucucuagc

SEQ ID NO: 41207 - RNA, 372 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaucggaugggugaagacgguuaccggcgcugugaacuuugggucuccgaauuuccggcaucgcgucagccugacaagagaccgggaucuuuuuaccgcccacauggacauucgcggacugacacaaggcgauaccgccacauauuucugugcuagacagaaauacuaugccggcgggcagggaugguacuuugaccucuggggccgggggacccugaucgugguuuccucu

SEQ ID NO: 41208 - RNA, 372 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacauccuauuacaugcacugggucagacaggcgccuggccaggggcucgaauggaucggaugggugaagacgguuaccggcacagugaacuuugggucucugaauuuccggcaacgcgucagccuuaccagagaccgggaucuguuuacagcucauauggacauucgcggacucacccagggcgauacagccaccuauuucugugccagacagaaauuugagcggggcgggcagggaugguacuucgaccuguggggccgcgggacgcuuaucgugguuuccucu

SEQ ID NO: 41209 - RNA, 372 nt, Artificial Sequence
  derived and/or modified sequence opt5 from anti-HIV-1_HeavyChain
caggugcaacugggccagagcggggccgagaugaagaaacccggauccucugucaagguuagcugcaaggcuuccggcgggaccuucagacacucuccuaucagcugggugcggcaggccccgggacagggccucgaauggauugggugggugaaagcggucuccggagcugugaacuacggcucucuggacuuucgccauagaguuagccuuacacgggaucgcgaccuguccacggcccacauggauaucagaggccucacccaagacgauacagccaccuauuucugugcucggcagaaauuugcccgcggggaccagggaugguucuuugaucuguggggcagagggacacuuauuguggucagcucu

SEQ ID NO: 41210 - RNA, 369 nt, Artificial Sequence
  derived and/or modified sequence opt5 from anti-HIV-1_HeavyChain
caggugcaacugguccagagcggcgccgagguuagaacccccggggcuuccgugaaggugucuugcaaagccagcggauacaacuucaucgcguaucacguccauugggugcggcaggcuccuggccaggggcucacauggaugggauggauuaauccggacuccggcgauacgguuuacgcccaaaacuuuguggaccgcgucaugaugaccagaaauacaucuauccagaccguguaucuggaacuuaacguucugacacucgaggauaccgccacauacuucugugcucggcagaaguuugcccgcggggaccagggaugguucuuugaucuguggggcagaggcacccuuauuguggucagcucc

SEQ ID NO: 41211 - RNA, 372 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacagucuauuacaugcacugggugagacaggcgccuggccgggggcucgaauggaucggauggguuaaggcuguguccggcgccgucaacuaugggucucuggacuuucgccauagagugagccuuacgcgggaucgcgaccuguucaccgcccacauggauauuagaggacucacacaggacgauaccgcuacauacuuuugugcccggcaaaaauucgcucgcggcgaccagggcugguuuuucgaucugugggggagaggaacccuuaucguuguguccucu

SEQ ID NO: 41212 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucgaaagaggcgggcagggaugguacuuugaccuguggggccgggggacccucaucguggucucuagc

SEQ ID NO: 41213 - RNA, 372 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucaucggcuauuacaugcacugggucagacaggcgccugggcagggacucgaauggaugggcugggugaagacaguuacgggggcugugaacuuuggauccccgaauuuccggcaucgcgucucucugaccagagaccgggaucuuuuuacagcccacauggacauucgcggccugacccaaggcgauacagccaccuauuucugugcuagacagaaauuugagcgcgggggacagggcugguacuucgaccucugggggcggggaacacugaucgugguuagcucc

SEQ ID NO: 41214 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagccuuaauuucagacaccggguuucccugacccgcgauagagaccucuuuacagcucauauggauauucggggacugacccagggcgacacagccaccuacuucugugcccgccaaaaauuugcuagaggcgaucaggggugguucuuugaccuuuggggacggggcacacugaucguggucucuagc

SEQ ID NO: 41215 - RNA, 372 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucaaggaucggauugaccauugggugcgccaggcccccggccaggggcuggaguggaucggaugggugaaagcggucucuggcgcugugaacuacgggagccuugauuuuagacaccggguuucccugacacgcgacagagaucucuucacggcccauauggacauucggggacugacccaggaugacacagccaccuauuuuugugcucgccaaaaguucgccagaggcgaucagggcugguuuuucgaccuuugggggcggggaacacugaucguggucucuagc

SEQ ID NO: 41216 - RNA, 375 nt, Artificial Sequence
  derived and/or modified sequence opt5 from anti-HIV-1_HeavyChain
caggugcaacuggcccagagcggcgcugaggucaagaaacucggggccuccguuagagugucuugcuggaccagcgaagacaucuucgagcggacagaacugauucacugggugcgccaggcgcccggacagggccuugaguggaucgggugggucaaggcuguguccggagccguuaacuacggcucucuggauuuuagacaucgggugagccucacgcgcgacagagaucuguucaccgcccacauggacauucgggggcuuacacaagaugacaccgcuaucuauuuuugugcccgccagaaauucgcuagaggagaucagggcugguuuuucgaccuguggggccgggggacacucauugucguguccucu

SEQ ID NO: 41217 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucucuaaggccgagcucauucauugggugcggcaggcgccuggccaggggcuggaauggaucggaugggugaaaacagucagcggcgcugugaacuucggguccccgaauuuucgccacagaguuucucuuacgcgggaucgcgaccuguucaccgcccauauggauauuagaggacucacacagggcgacaccgccacauacuuuugugcucggcaaaaguucgagcgcggcgggcagggaugguauuuugaucuguggggcagagggacccuuaucguggucagcucc

SEQ ID NO: 41218 - RNA, 372 nt, Artificial Sequence
  derived and/or modified sequence opt5 from anti-HIV-1_HeavyChain
accgcccaccuggagcagagcggcuccggggugagacggcccggagcuucuguccgcguuagcugcuggacauccggcgacaucuucaagucugaacucauucauugggugagacaagccccugggcagggacuggaguggaucggcugggugaaaacggucaccggggcggugaacuuuggaagcuccgauuuccggcagcgcguuucucuuacaagagaccgggaucuguuuaccgcucacauggacauucgcggccucacacagggcgauaccgccacauacuucugugccagacaaaaguuuuaugcugggggacagggcugguacuucgaccugugggggcggggaacccuuaucguggucagcucc

SEQ ID NO: 41219 - RNA, 372 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucaacacagagcucauucauugggugcgccaggccccuggccaggggcuggaauggaucggaugggugaaaacggucucuggcgcggugaauuuugggagccuuaacuucagacaccggguuucccugacccgcgauagagaccucuuuacagcucauauggauauucggggacugacccagggcgacacagccaccuacuucugugcccgccaaaaguuugcuagaggcgaucaggggugguucuuugaccuuuggggacggggcacacugaucguggucucuagc

SEQ ID NO: 41220 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagacagagcucauucauugggugcggcaggccccuggccaggggcuggaauggaucggaugggugaaagcggucucuggcgcugugaacuacgggagccuugauuuucgccacagaguuucccugacgcgggaccgcgaucucucuaccgcccauauggacauuagaggacugacacaggaugacaccgccacauauuucugugcucggcaaaaguuugcccgcggcgaucagggcugguucuuugaccuuugggggagaggaacccugaucguggucagcucc

SEQ ID NO: 41221 - RNA, 372 nt, Artificial Sequence
  derived and/or modified sequence opt5 from anti-HIV-1_HeavyChain
caggugcaacugguccagagcggcgccgagguuaagaaacccggggcuuccgugagagugucuugcaaggccagcggauacaccuucacagcguauuacauccacuggguccggcaggcuccuggccaggggcucgaauggauuggaugggugaaaacgguuuccggcgccgugaacuuugggucuccgaauuuccgccauagagucagccugacccgggaccgcgaucuuuuuacagcccacauggacaucagaggacugacccaaggcgauacagcuaccuauuucugugcccggcagaaguuugagcgcggcgggcagggaugguacuucgaccucuggggcagagggacacugauugugguuuccucu

SEQ ID NO: 41222 - RNA, 372 nt, Artificial Sequence
  derived and/or modified sequence opt5 from anti-HIV-1_HeavyChain
caggcccaccuggagcaaagcggcuccgaaucuaagaaacccggggcuagcgugagagucuccugcuggucuagcgaggacaucuucaagaccgaacucauucauuggguucggcaggccccuggacagggccuggaguggaucgggugggugaaaauuguguccggagcggucaacuuuggcucuccgaauuuccgccagagagugagccuuacacgggaucgcgaccuguuuacggcucacauggauaucagagggcucacccaaggagacacagccaccuacuucugugcccggcagaaguuugaacgcggcggccagggguggauuuucgaucuguggggaagaggcacacuuaucgcuguuuccagc

SEQ ID NO: 41223 - RNA, 375 nt, Artificial Sequence
  derived and/or modified sequence opt5 from anti-HIV-1_HeavyChain
caggcccaccuggagcaaagcggcuccgaagugaagaaacccggggcuucugucagaguuagcugcuggaccuccgaggacaucuucgaaaagucugagcucauucauugggugcggcaggccccuggacagggccuggaauggaucgggugggugaaaacagucacgggagcggugaacuuuggcagcuccgauuuccgccagagaguuucucuuacccgggaccgcgaucuguuuacagcucacauggacauuagagggcucacccaaggagauacagccaccuacuucugugcccggcagaaguuuuaugcuggcggccaggggugguacuucgaccuguggggacgcggcacacuuaucguggucagcucc

SEQ ID NO: 41224 - RNA, 372 nt, Artificial Sequence
  derived and/or modified sequence opt5 from anti-HIV-1_HeavyChain
caggcccaccuggagcaagugugggcuggcgucaagaaacucggggccagcguuagaguguccugcuggaccucugaagacaucuucaagacagagcugauucauugggugcggcaggcgcccggacagggccuugaauggaucgggugggucaaagcugugagcggagccguuaacuacggcucccuggauuuucgccacagagugucucucacgcgggaccgcgaucugagcaccgcccauauggacauuagagggcuuacacaggaugacaccgcuacauauuucugugcccggcaaaaguuugcucgcggagaucagggcugguucuuugaccuguggggcagagggacccucaucgucguguccucu

SEQ ID NO: 41225 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcaauuucagacagcggguuucccuuacccgcgauagagaccuguuuacagcucacauggauauucggggacucacccaaggcgacacagccaccuacuucugugcccgccagaaauuuuaugcuggcgggcagggaugguacuucgaucuguggggcagagggacacuuaucguggucucuagc

SEQ ID NO: 41226 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgccauagagugucucugacacgggaucgcgaccucagcaccgcucacauggauaucagaggccugacacaggacgauaccgccacauauuuuugugcccggcaaaaauucgcucgcggggaccagggaugguuuuucgaucuuuggggcagaggcacccugauuguuguguccagc

SEQ ID NO: 41227 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugccagaggcgaucaggggugguucuuugaccuguggggacggggcacgcuuaucguggucuccucu

SEQ ID NO: 41228 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccggcgggaucuucgaacggacagagcucauucauugggugcgccaggccccuggacagggccuggaauggaucgggugggugaagacggucaccggagcggugaacuuuggcucuccgaauuucagacaccggguuagccuuacacgcgacagagaucuguuuaccgcucauauggacauucggggccucacacagggggauaccgccacauacuucugugcccgccaaaaauuugagagaggaggccaggggugguauuucgaccuguggggacggggcacccuuaucguggucuccucu

SEQ ID NO: 41229 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccaggaugacacagccaccuacuucugugcccgccaaaaauuugcuagaggcgaucagggcugguucuuugaccuuugggggcggggaacacugauuguugugucuagc

SEQ ID NO: 41230 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugagcgcggcgggcagggauggaucuucgaccuguggggcagagggacacuuauugcugugagcucc

SEQ ID NO: 41231 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucucuggcgcggugaacuuugggagccuuaauuucagacaccggguuucccugacacgcgauagagaccucuuuaccgcucauauggauauucggggacugacacagggcgacaccgccacauacuucugugcccgccaaaaguuugcuagaggcgaucaggggugguucuuugaccuuuggggacggggcacccugaucguggucucuagc

SEQ ID NO: 41232 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacagcggguuucccucacgcgcgacagagaucuguucaccgcccacauggacauucggggacuuacacaaggcgauaccgccacauauuuuugugcucgccagaaauucuacgccggcgggcagggaugguauuuugaccuguggggcagagggacccucaucguggucucuagc

SEQ ID NO: 41233 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaaccuuguucaccagauuagcgaucgcgugucccugaccagagaccgggaucucuuuacagcucauauggacauccgcgggcugacccaaggagauacagccaccuacuucugugccagacagaaguuuuaugcuggcggccaggggugguacuucgaccuuuggggacggggcacacugauugucgugucuagc

SEQ ID NO: 41234 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccggggacgcgaccuguuuacagcucacauggauauuagaggccucacccaaggcgacacagccaccuacuucugugcccggcagaaguuuuaugcugggggacagggcugguacuucgaucugugggggcgcggaacacuuaucguggucagcucc

SEQ ID NO: 41235 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucaccggcgcugugaacuuuggguccccgaauuucagacaccggguuucucuuacacgcgauagagaccuguuuaccgcccauauggauauucggggacucacacagggcgacaccgccacauacuucugugcucgccaaaaauuugaaagaggcgggcagggaugguauuucgaucuguggggccgggggacccuuaucguggucagcucc

SEQ ID NO: 41236 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauucauuggguucggcaggccccuggacagggccuggaauggaucgggugggugaaggcggugagcggagcugucaacuacggcucccuugacuuucgccacagagugucucugacccgggaucgcgaccucagcacagcccauauggauauuagagggcugacccaggacgauacagccaccuauuucugugcucggcaaaaauuugcccgcggagaccagggcugguucuuugaucuuuggggcagagggacacugaucguuguguccagc

SEQ ID NO: 41237 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagacagagcucauucauugggugcggcaggccccuggccaggggcuggaauggaucggaugggugaaaacggucucuggcgcggugaacuuugggagcccgaauuuccgccacagaguuucccuuacccgggaucgcgaccuguuuacagcucauauggauauuagaggacucacccagggcgacacagccaccuacuucugugcccggcaaaaguuugagcgcggcgggcagggaugguauuucgaucuguggggcagagggacacuuaucguggucucuagc

SEQ ID NO: 41238 - RNA, 375 nt, Artificial Sequence
  derived and/or modified sequence opt5 from anti-HIV-1_HeavyChain
caggugcaccuggagcaaagcggcuccggggucaagaaacucggagccucuguuagagugagcugcuggaccuccgaagacaucuucgagcggacagaacugauucauugggugcgccaggcucccggccaggggcuugaguggaucggaugggucaaggccgugucuggcgcgguuaacuacgggagccuggauuuuagacaccgggugucccucacgcgcgacagagaucuguucaccgcucauauggacauucggggacuuacacaggaugacaccgccacauauuuuugugcccgccaaaaauucgcuagaggcgaucagggcugguuuuucgaccugugggggcggggaacccucaucgucgugucuagc

SEQ ID NO: 41239 - RNA, 372 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucagcggagcugugaaccuugccccgaauuuucggcagcgcguuucccugacgagagaucgggaccucuucaccgcccauauggauauucgcggccugacacaaggggacaccgcuacauauuuuugugccagacagaaguucgaacggggaggccagggcuggaucuuugaucuuugggggcgcggaacccugauugcugugucuagc

SEQ ID NO: 41240 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggacggagaucuguuuacagcucacauggacauucgcggccucacccaaggcgauacagccaccuacuucugugccagacagaaguuuuaugcugggggacagggcugguacuucgaccugugggggcggggaacacuuaucauugugagcucc

SEQ ID NO: 41241 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgucugaccgcgaucugagcaccgcccauauggacauuagaggacuuacacaggaugacaccgccacauauuucugugcucggcaaaaauuugcccgcggcgaucagggcugguucuuugaccugugggggagaggaacccucaucguggucuccagc

SEQ ID NO: 41242 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucugagcacagcucacauggacauuagaggacucacccaagaugacacagccaccuacuuuugugcccggcagaaguucgcucgcggcgaucagggcugguuuuucgaccugugggggagaggaacacuuaucguggucuccagc

SEQ ID NO: 41243 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugagcgcggcgggcagggaugguauuucgaccuguggggcagagggacacuuaucguggucagcucc

SEQ ID NO: 41244 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggcaccagauuagcgaucgcguuucccuuaccagagaccgggaucuguucacagcucauauggacauccgcggacucacccaaggcgauacagccaccuacuuuugugccagacagaaguucuaugcuggcgggcagggaugguacuuugaccuguggggccgggggacacuuauuguggucucuagc

SEQ ID NO: 41245 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaagaugacacagccaccuacuucugugcccggcagaaguuugcucgcggcgaucagggcugguucuuugaccugugggggagaggaacacuuaucguggucagcucc

SEQ ID NO: 41246 - RNA, 372 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacauccugaagacagagcuuauucauugggugcggcaggcccccggccaggggcuggaauggaucggaugggugaaagcggucucuggcgcugugaacuacgggagccucgauuuccgccacagaguuucccugacgcgggaccgcgaucuuuuuaccgcccauauggacauuagaggacugacacaggaugacaccgccacauauuucugugcucggcaaaaguuugcccgcggcgaucagggcugguucuuugaccucugggggagaggaacccugaucguggucucuagc

SEQ ID NO: 41247 - RNA, 372 nt, Artificial Sequence
  derived and/or modified sequence opt5 from anti-HIV-1_HeavyChain
gugagaagcgucguucagugcgaggccggcgugaagaaacccggggcuuccgugaagaucucuugugccaccagcggauacgcguucacacuguauuaccuccacuggguccggcaagcuccuggccaggggcuggaauggauuggaugggugaaaacgguuaccggcgccgugaacuuuggguccgccuauuuccgccauagagucucucuuacaccggaccgggaucuguuuaccgcucacauggacauccgcggacucacacagggcgauaccgccacauacuucugcgcuagacagaaguuuuauaaaggcgggcaaggaugguacuucgaccuguggggccgggggacccuuauugugguuagcucc

SEQ ID NO: 41248 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugccuggacuccgaagauaucuucgagcggaccgaacuuauucauugggugcgccaggcccccggccaggggcuggaguggaucggaugggugaaggcggucucuggcgcugugaacuacgggagccucgacuuuagacaccggguuucccugacacgcgauagagaccuuuucacggcccauauggauauucggggacugacccaggacgauacagccaccuauuuuugugcucgccaaaaauucgccagaggcgaccagggcugguuuuucgaucucugggggcggggaacacugaucguggucucuagc

SEQ ID NO: 41249 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcucgcggggaccagggaugguuuuucgaucuuuggggcagaggcacacugaucgugguuagcucu

SEQ ID NO: 41250 - RNA, 375 nt, Artificial Sequence
  derived and/or modified sequence opt5 from anti-HIV-1_HeavyChain
caggcccaccuggagcaaagcggcuccggggugaagaaacucggagcuucugucaagagcuccugcuggaccucugaagacaucuucgagagaacagaacugauucauuggguucggcaggcccccggccaggggcuugaguggaucggaugggugaaagcggugagcggcgcugucaacuacgggucccuggauuuucgccacagagugucucucacgcgggaccgcgaucugagcaccgcccauauggacauuagaggacuuacacaggaugacaccgccacauauuucugugcucggcaaaaguuugcccgcggcgaucagggcugguucuuugaccugugggggagaggaacccucaucguuguguccagc

SEQ ID NO: 41251 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagauugucuccggcgcugugaacuuugggucuccgaauuucagacagcggguuagccuuacgcgcgauagagaccuguuuaccgcccacauggauauccggggacucacacaaggcgacaccgccacauacuucugugcucgccagaaauuugaaagaggcgggcagggauggauuuucgaucuguggggccgggggacccuuaucgccguguccucu

SEQ ID NO: 41252 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggauggaugaagacggugaccggcgcggucaacuuugggucuccgaauuucagacaccgggugagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguuguguccucu

SEQ ID NO: 41253 - RNA, 375 nt, Artificial Sequence
  derived and/or modified sequence opt5 from anti-HIV-1_HeavyChain
caggcccaccuggagcaaagcggcuccgaagugaagaaacccggggcuucugucagaguuagcugcuggaccuccgaggacaucuucgaacggacagagcucauucauugggugcgccaggccccuggacagggccuggaauggaucgggugggugaagacggucaccggagcggugaacuuuggcucuccgaauuucagacaccggguuagccuuacacgcgauagagaccuguuuaccgcucauauggauauucgggggcucacacagggagacaccgccacauacuucugugcccgccaaaaauuugagagaggcggccaggggugguauuucgaucuguggggacggggcacccuuaucguggucuccucu

SEQ ID NO: 41254 - RNA, 375 nt, Artificial Sequence
  derived and/or modified sequence opt5 from anti-HIV-1_HeavyChain
caggcccaccuggagcaaagcggcgcuggggugaagaaacucggagccuccgucagaguuucuugcuggaccagcggcgacaucuucgaacggacagagcugauucauugggugcgccaggcgcccgggcagggacuugaauggaucggcugggugaaggcugucuccggggccgugaacuacggaucucuggauuuuagacagcggguuagccucacgcgcgacagagaucuguucaccgcccacauugacauccggggccuuacacaaggcgauaccgcuacauauuuuugugcccgccagaaauucgagagagggggacagggcuggauuuuugaccugugggggcggggaacccucaucgcuguguccucu

SEQ ID NO: 41255 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcugggccuccgaagacaucuucgagcggaccgaacugauucauugggugcgccaggcgcccggccaggggcuugaguggaucggaugggugaaggcugucucuggcgccgugaacuacgggagccuggauuuuagacaccggguuucccucacacgcgacagagaucugucuacggcccauauggacauucggggacuuacccaggaugacacagcuaccuauuucugugcccgccaaaaauuugcuagaggcgaucagggcugguucuuugaccugugggggcggggaacacucaucguggucagcucc

SEQ ID NO: 41256 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucagaauuucagacaacggguuagccuuacccgcgauagagaccuguuuacagcgcacauggauauucggggacucacccagggcgacacagcuaccuacuucugugcccgccagaaauuugaaagaggcgggcagggauggaucuucgaucuguggggccgggggacgcuuauugccguguccucu

SEQ ID NO: 41257 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucacaggcgcggugaacuuugggucuccgaauuucagacaccggguuagccuuacccgcgauagagaccuguuuacagcucauauggauauucggggacucacccagggcgacacagccaccuacuucugugcccgccaaaaguuugaaagaggcgggcagggaugguauuucgaucuguggggccgggggacgcuuaucguggucuccucu

SEQ ID NO: 41258 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacauccuccggaagucugagcugauucauugggugcgccaggccccuggccaggggcuugaauggaucggaugggugaaaacagucacgggcgcggugaacuucgggagcuccgauuuuagacagcggguuucucugacccgcgacagagaucucuucacagcucacauggacauucggggacugacccaaggcgauacagccaccuacuuuugugcccgccagaaguucuaugcuggcgggcagggaugguacuuugaccuuuggggcagagggacacugaucguggucagcucc

SEQ ID NO: 41259 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagacagagcucauucauugggugcggcaggccccuggccaggggcuggaauggaucggaugggugaaaacggucaccggcacagugaacuuugggucucuuaauuuccgccagagaguuagccugacccgggaucgcgaccucuuuacagcgcacauggauauuagaggacugacccaaggcgacacagcuaccuacuucugugcccggcagaaguuuuaugccggcgggcagggaugguacuucgaucuuuggggccgcgggacgcugaucguggucuccucu

SEQ ID NO: 41260 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagc

SEQ ID NO: 41261 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuagcgauuucagacagcggguuucccuuacacgcgacagagaucuguuuaccgcucacauggacauucggggacucacacaaggcgauaccgccacauacuucugugcccgccagaaauuuuaugcuggcgggcagggaugguacuucgaccuguggggcagagggacccuuaucguggucucuagc

SEQ ID NO: 41262 - RNA, 375 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagcgguccgaacucauuuacuggguccgccaggccccuggaagaggccuggaguggaucggguggauuaaacuugugucuggagcgguuaacuuuggcagcguggauuuccgggaccgcgucucccugacaagagaucgggaccucuuuacggcucacauggauauccgcgggcugacccaggacgauacagccaccuauuucugugccagacaaaaguuugcucggggagaccagggcugguucuuugaucuuuggggccgcgggacacugauugugguuucuagc

SEQ ID NO: 41263 - RNA, 375 nt, Artificial Sequence
  derived and/or modified sequence opt5 from anti-HIV-1_HeavyChain
caggcccaccuggagcaaagcagauccggcgugaagaaacccggggcuucuguccggguuagcugcuggaccuccgaagacaucuucgagcgcacagaacucauucauugggugagacaggccccuggacagggccuggaguggaucgggugggugaaggcggucucuggagcugugaacuuuggcagcccgaauuuccggcaccgcguuucccuuacgagagaucgggaccugucuaccgcccauauggauauucgcgggcucacacaggacgauaccgccacauacuuuugugcuagacaaaaauucgcccggggagaccagggcugguuuuucgaucuguggggccgcgggacccuuaucguggucagcucc

SEQ ID NO: 41264 - RNA, 375 nt, Artificial Sequence
  derived and/or modified sequence opt5 from anti-HIV-1_HeavyChain
cagagcuaccuggagcaauccggcucugccaugaagaaacccggggcuagcgugagagucuccugcuggaccucugaagacaucuucgauacaacggagcucauuuauuggguucggcaggccccuggacagggccuggaauggaucgggugggugaagauugugagcggaaccgucaacuuugcgucccuugacuuccgcaauagaaucucucugagccgggaucgcgaccucuuuacagcucacauggauauuagaggccugacccagggggacacagccaccuacuucugugcccggcaaaaauuuuaugcuggaggccagggcugguacuucgaucuuugggggcgcggaacacugaucgugguuuccagc

SEQ ID NO: 41265 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagacagaacucauucauugggugcggcaggccccuggccaggggcuggaguggaucggaugggugaaagcggucucuggcgcugugaacuacgggagccuugauuuucgccacagaguuucccugacgcgggaccgcgaucucuucaccgcccauauggacauuagaggacugacacaggaugacaccgccacauauuuuugugcucggcaaaaguucgcccgcggcgaucagggcugguuuuucgaccuuugggggagaggaacccugaucguggucucuagc

SEQ ID NO: 41266 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcucc

SEQ ID NO: 41267 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccaggacgauacagccaccuacuucugugcccgccaaaaauuugcuagaggcgaccagggcugguucuuugaucugugggggcggggaacacuuaucguggucucuagc

SEQ ID NO: 41268 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugcuagaggcgaucaggggugguucuuugaccuguggggacggggcacccuuauuguggucucuagc

SEQ ID NO: 41269 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucuacgccggcgggcagggaugguauuuugaccuguggggcagagggacccucaucguggucucuagc

SEQ ID NO: 41270 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccagggggacacagccaccuauuuuugugcccggcaaaaauucgagcgcggaggccagggcugguacuuugaucuuugggggagaggaacacugaucgugguuagcucu

SEQ ID NO: 41271 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgccagagagugucucugacacgggaucgcgaccucuuuaccgcucauauggauaucagaggccugacacaaggggacaccgccacauauuucugugcccggcagaaauuugagcgcggaggccagggcuggauuuucgaucuuugggggagaggaacccugaucgcuguuagcucc

SEQ ID NO: 41272 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaaggcgacacagcuaccuacuucugugcccgccagaaauuugaaagaggcgggcagggauggaucuucgaucuuuggggccgggggacgcugauugccguguccucu

SEQ ID NO: 41273 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucu

SEQ ID NO: 41274 - RNA, 375 nt, Artificial Sequence
  derived and/or modified sequence opt5 from anti-HIV-1_HeavyChain
agacacaccguggagcagagcggcuccggggucaagaaacccggagccucuguucgggugagcugcuggacauccgaagacaucuucgagcgcacggaacugauucauugggugagacaagcuccuggccaggggcucgaguggaucggaugggucaagaccgugucuggcgccguuaacuuugggagcccgaauuuccggcaccgcgugucccugacaagagaucgggaccuuuuuaccgcgcauauggauauucgcggacugacacagggcgacaccgcuacauacuucugugccagacagaaauuugaacggggcgggcaaggaugguauuucgaucucuggggccgcgggacccugaucgucgugucuagc

SEQ ID NO: 41275 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaacgcggcgggcagggaugguauuucgaccuguggggcagagggacacuuaucguggucagcucc

SEQ ID NO: 41276 - RNA, 375 nt, Artificial Sequence
  derived and/or modified sequence opt5 from anti-HIV-1_HeavyChain
agacacaccugggagcagagcggcuccggggugaagaaacugggagccucuguccggguuagcugcuggacauccgaagacaucuucgagcgcacggaacucauucauugggugagacaagcucccggccaggggcuggaguggaucggauggaugaaggccgugucuggcgcggucaacuacgggagccuugauuuucggcaccgcgugucccugaccagagaccgggaucucucuacagcucauauugacauccgcggacugacccaggaugacacagccaccuauuucugugccagacagaaauuugcucggggcgaucaaggcugguucuuugaccuuugggggcgcggaacacugauuguugugagcucc

SEQ ID NO: 41277 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucuccuaauuucagacaccggguuagccugacacgcgauagagaccucuuuaccgcucauauggauauucggggacugacacagggcgacaccgccacauacuucugugcccgccaaaaauuugaaagaggcgggcagggaugguauuucgaucuuuggggccgggggacccugaucguggucuccucu

SEQ ID NO: 41278 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggauggaucuucgaucuguggggccgggggacccuuauugcuguguccucu

SEQ ID NO: 41279 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccacagaguuucucuuacccgggaccgcgaucuguuuacagcucauauggacauuagaggacucacccagggcgauacagccaccuacuucugugcccggcaaaaguauuacgcuggcgggcagggaugguauuuugaccuguggggccgcgggacacuuaucguggucagcucc

SEQ ID NO: 41280 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacaugggaauuagaggccucacccaaggcgacacagccaccuacuucugugcccggcagaaguuuuaugcugggggacagggcugguacuucgaucugugggggcgcggaacacuuaucguggucagcucc

SEQ ID NO: 41281 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuuuucuuacccgggaccgcgaucuguucacagcucacauggacauuagaggacucacccaaggcgauacagccaccuacuuuugugcccggcagaaguucuaugcuggcgggcagggaugguacuuugaccuguggggccgcgggacacuuaucguggucucuagc

SEQ ID NO: 41282 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuacgggagccuugauuuuagacaccggguuucccugacgcgcgacagagaucucucuaccgcccauauggacauucggggacugacacaggaugacaccgccacauauuucugugcucgccaaaaauuugccagaggcgaucagggcugguucuuugaccuuugggggcggggaacccugaucguggucagcucc

SEQ ID NO: 41283 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagccaggauuuccgcgacagauuuucccuuacccgggaucgcgaccuguucacagcucacauggauauuagaggacucacccaaggcgacacagccaccuacuuuugugcccggcagaaguucuaugcuggcgggcagggaugguacuuugaucuguggggccgcgggacacuuaucguugugucuagc

SEQ ID NO: 41284 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgaugccacaggacucauuuacuggguucggcaggcgccuggccaggggcuggaguggaucggaugggugaagauugugagcggcacggucaacuuugcuucccuugacuuccgccagagagugucucugacccgggaucgcgaccucuuuacagcccauauggauaucagagggcugacccaaggagacacagccaccuauuucugugcucggcagaaauuuuacgccggcggccaggggugguauuucgaucuuuggggacgcggcacacugauuguugugagcucc

SEQ ID NO: 41285 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgccuauauggacauucggggacuuacacaggaugacaccgccacauacuucugugcucgccaaaaauuugccagaggcgaucagggcugguucuuugaccugugggggcggggaacccucaucguggucagcucc

SEQ ID NO: 41286 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccaucuaucugugugcucgccaaaaauuugccagaggcgaucagggcugguucuuugaccucugggggcggggaacacugauuguggucucuagc

SEQ ID NO: 41287 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccagggggacacagccaccuauuuuugugcccggcaaaaauucgagcgcggaggccagggcuggaucuuugaucuuugggggagaggaacacugaucgcugugagcucu

SEQ ID NO: 41288 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcccgaauuuccgccacagaguuucccuuacccgggaucgcgaccuguuuacagcucauauggauauuagaggacucacccagggcgacacagccaccuacuucugugcccggcaaaaguuugaacgcggcgggcagggaugguauuucgaucuguggggcagagggacacuuaucguggucucuagc

SEQ ID NO: 41289 - RNA, 375 nt, Artificial Sequence
  derived and/or modified sequence opt5 from anti-HIV-1_HeavyChain
caggcccaccccgagcaaagcggcuccggggugaagaaaccuggagcuucugucagaguuagcugcuggaccuccgaagacaucuucgagaagucugaacugauucauugggugcggcaggccccgggccaggggcucgaguggaucggaugggugaaaacagucacgggcgcggugaacuuugggagcuccgauuuccgccagagaguuucucugacccgggaccgcgaucuuuuuacagcucacauggacauuagaggacugacccaaggcgauacagccaccuacuucugugcccggcagaaguuuuaugcuggcgggcagggaugguacuucgaccucuggggccgcgggacacugaucguggucagcucc

SEQ ID NO: 41290 - RNA, 375 nt, Artificial Sequence
  derived and/or modified sequence opt5 from anti-HIV-1_HeavyChain
agagcccaccuggagcagagcggcuccggggugcggaagcccggagcuucuguccgcguuagcugcuggaccuccgaagacaucuucgagaaaucugaacucauucauugggugagacaagccccuggccaggggcuggaguggaucggaugggugaagacagucacgggcgcggugaacuuugggagcuccgauuuccggcagcgcguuucucuuaccagagaccgggaucuguuuacagcucacauggacauucgcggacucacccagggcgauacagccaccuacuucugugccagacaaaaauuuuaugcuggcgggcagggaugguacuucgaccuguggggccgggggacacuuaucguggucagcucc

SEQ ID NO: 41291 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggauggaucuucgaucuguggggccgggggacacuuauugcugugucuagc

SEQ ID NO: 41292 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgaaaagagcgagcucauucauuggguucggcaggccccuggacagggccuggaguggaucgggugggugaaaacagugacgggagcggucaacuuuggcuccucugauuuccgccagagagugagccuuacccgggaccgcgaucuguuuacagcucacauggacauuagagggcucacccaaggagauacagccaccuacuucugugcccggcagaaguuuuaugcuggcggccaggggugguacuucgaccuguggggacgcggcacacuuaucguuguguccagc

SEQ ID NO: 41293 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacauaucguggucagcucc

SEQ ID NO: 41294 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagc

SEQ ID NO: 41295 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgccauagagugagccuuacacgggaucgcgaccuguccaccgcucacauggauaucagaggccucacacaggacgauaccgccacauauuuuugugcccggcaaaaauucgcucgcggggaccagggaugguuuuucgaucuguggggcagaggcacccuuauuguugugagcucu

SEQ ID NO: 41296 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuuuaugcuggcgggcagggaugguacuucgaucuguggggcagagggacccuuauuguggucucuagc

SEQ ID NO: 41297 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacagcggguuucccuuacccgcgauagagaccuguuuacagcucacauggauauucggggacucaccgaaggcgacacagccaccuacuucugugcccgccaaaaauuuuaugcuggcgggcagggaugguacuucgaucuguggggcagagggacacuuaucguggucucuagc

SEQ ID NO: 41298 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugccaacuacgggagccuggauuuuagacaccgggugucccucacgcgcgacagagaucuguucaccgcccauauggacauucggggacuuacacaggaugacaccgcuacauauuuuugugcccgccaaaaauucgcuagaggcgaucagggcugguuuuucgaccugugggggcggggaacccucaucguugugucuagc

SEQ ID NO: 41299 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucagcggcgcggugaacuuuggguccccgaauuuccgccacagaguuucucuuacgcgggaucgcgaccuguuuaccgcucauauggauauuagaggacucacacagggcgacaccgccacauacuucugugcccggcaaaaguuugaacgcggcgggcagggaugguauuucgaucuguggggcagagggacccuuaucguggucagcucc

SEQ ID NO: 41300 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuuugggagcccuaauuucagacaccggguuucccugacgcgcgauagagaccucuuuaccgcccauauggauauucggggacugacacagggcgacaccgccacauacuucugugcucgccaaaaauuugaaagaggcgggcagggaugguauuucgaucuuuggggccgggggacccugaucguggucucuagc

SEQ ID NO: 41301 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauaccugugugcccgccagaaauucgaaagaggcgggcagggauggauuuuugaucuuuggggccgggggacccugaucgcugugucuagc

SEQ ID NO: 41302 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucagcggcgcggugaacuuuggguccccgaauuucagacaccggguuucucuuacgcgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucagcucc

SEQ ID NO: 41303 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaaggcgacacagcuaccuacuucugugcccgccagaaauuuuaugccggcgggcagggaugguacuucgaucuuuggggcagagggacgcugaucguggucuccucu

SEQ ID NO: 41304 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucagcggagcugugaacuuuggcuccacggauuuccgggaacgcguuucucuuaccagagaccgggaucuguuuacagcccauauggacauucgcgggcucacccagggagauacagccaccuauuucugugcuagacaaaaguuugcccggggcgaccagggcugguucuuugaucugugggggcgcggaacacuuaucguggucagcucc

SEQ ID NO: 41305 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagcggucugaacucauucauugggugcgccaggcuccuggccaggggcuggaguggaucggaugggucaagacagugacgggcgccguuaacuuugggagcccgaauuucagacaccgggugucccuuacccgcgauagagaccuguuuacagcgcauauggauauucggggacucacccagggcgacacagcuaccuacuucugugcccgccaaaaauauuacgccggcgggcagggaugguauuuugaucuguggggcagagggacacuuaucgucgugucuagc

SEQ ID NO: 41306 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuuguggacucacccaaggcgauacagccaccuacuucugcgccagacagaaguuuuaugcuggcgggcagggaugguacuucgaccuguggggccgggggacacuuaucguggucagcucc

SEQ ID NO: 41307 - RNA, 375 nt, Artificial Sequence
  derived and/or modified sequence opt5 from anti-HIV-1_HeavyChain
caggcccaccuggagcaaagcggcuccggggugaagaaacccgaggcuucugucagaguuagcugcuggaccuccgaagacaucuucgaaaagucugagcucauucauugggugcggcaggccccuggacagggccuggaauggaucgggugggugaaaacagucacgggagcggugaacuuuggcagcuccgauuuccgccagagaguuucucuuacccgggaccgcgaucuguuuacagcucacauggacauuagagggcucacccaaggagauacagccaccuacuucugugcccggcagaaguuuuaugcuggcggccaggggugguacuucgaccuguggggacgcggcacacuuaucguggucagcucc

SEQ ID NO: 41308 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuugaaagaggcgggcagggauggaucuucgaucuguggggccgggggacccuuauugcuguguccucu

SEQ ID NO: 41309 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcacagaacucauuuacugggugagacaggcgccuggacagggccuggaguggaucgggugggugaaaacggucucuggagcugugaacuuuggcagccaggauuuccgggaccgcuuuucccuuaccagagaucgggaccuguucacagcccauauggauauucgcgggcucacccaaggagacacagccaccuauuuuugugcuagacagaaguucgaacggggcggccaggggugguacuuugaucuguggggacgcggcacacuuaucguugugucuagc

SEQ ID NO: 41310 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaauugucagcggcgcggugaacuuuggguccccgaauuuccgccagagaguuucucuuacacgggaucgcgaccuguuuacggcucacauggauaucagaggacucacccaaggcgacacagccaccuacuucugugcccggcagaaguuugaacgcggcgggcagggauggauuuucgaucuguggggcagagggacacuuaucgcugugagcucc

SEQ ID NO: 41311 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccccuuuaccgcucauauggauauucggggacugacacagggcgacaccgccacauacuucugugcccgccaaaaauuugaaagaggcgggcagggaugguauuucgaucucuggggccgggggacccugaucguggucuccucu

SEQ ID NO: 41312 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucuggccucauucauugggugcggcaggccccugggcagggacuggaauggaucggcugggugaaaacagucacgggggcggugaacuuuggaagcuccgauuuccgccagagaguuucucuuacccgggaccgcgaucuguuuacagcucacauggacauuagaggccucacccaaggcgauacagccaccuacuucugugcccggcagaaguuuuaugcugggggacagggcugguacuucgaccugugggggcgcggaacacuuaucguggucagcucc

SEQ ID NO: 41313 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaagcggucagcggcacagugaacuacgggucccuugauuuucgccacagaguuucucugacgcgggaccgcgaucucuucaccgcucauauggacauuagaggacugacacaggaugacaccgccacauauuuuugugcccggcaaaaguucgcucgcggcgaucagggcugguuuuucgaccuuugggggagaggaacccugaucguggucagcucc

SEQ ID NO: 41314 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauuuuacgccgggggacagggcugguauuucgaucugugggggcgcggaacacuuaucguggucucuagc

SEQ ID NO: 41315 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuuuaugcuggcgggcagggaugguacuucgaccuuuggggcagagggacacugauuguugugucuagc

SEQ ID NO: 41316 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucagcacggcccauauggacauucggggacugacccaggaugacacagccacccacuucugugcucgccaaaaauuugccagaggcgaucagggcugguucuuugaccuuugggggcggggaacacugaucguggucuccagc

SEQ ID NO: 41317 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcacagaacucauucauugggugcggcaggccccugggcagggacuggaguggaucggcugggugaagauugucucuggggcggugaacuuuggaagcccgaauuuccgccagagaguuucccuuacgcgggaucgcgaccuguuuaccgcucacauggauaucagaggccucacacaaggcgacaccgccacauacuucugugcccggcagaaauuugaacgcgggggacagggcuggauuuucgaucugugggggagaggaacccuuaucgcugugucuagc

SEQ ID NO: 41318 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuuuaugcuggcgggcagggaugguacuucgaucuguggggcagagggacccuuaucguggucuccucu

SEQ ID NO: 41319 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcccgaauuuccgccacagaguuucccuuacccgggaucgcgaccuguuuacagcucauauggauauuagaggccucacccagggcgacacagccaccuacuucugugcccggcaaaaauuugaacgcgggggacagggcugguauuucgaucugugggggagaggaacacuuaucguggucucuagc

SEQ ID NO: 41320 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugcuagaggcgaucaggggugguucuuugaccuguggggacggggcacacuuaucguggucucuagc

SEQ ID NO: 41321 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaaggcaucuucgagcggacagaacucauucauugggugcgccaggccccugggcagggacuggaguggaucggcugggugaagauugucucuggggcggugaacuuuggaagcccgaauuucagacagcggguuucccuuacgcgcgacagagaucuguuugcugcccacauggacauccggggccucacccaaggcgauacagccaccuacuucugugcucgccagaaauuugaaagagggggacagggcuggauuuucgaccugugggggcggggaacacuuaucgccgugucuagc

SEQ ID NO: 41322 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcgggccgaacugauucauugggugcgccaggcgcccggccaggggcuugaguggaucggaugggugaaggcugucucuggcgccgugaacuacgggagccuggauuuuagacaccggguuucccucacacgcgacagagaucuguucacggcccauauggacauucggggacuuacccaggaugacacagcuaucuauuuuugugcccgccaaaaauucuacgcuggcggccaggggugguauuuugaucuguggggaagaggcacccucauuguggucucuagc

SEQ ID NO: 41323 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagcccuaauuuuagacagcggguuucccugacgcgcgauagagaccucuucaccgcccacauggauauucggggacugacacaaggcgacaccgccacauauuuuugugcucgccagaaauucgaaagaggcgggcagggauggaucuuugaucuuuggggccgggggacccugauugccgugucuagc

SEQ ID NO: 41324 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuuaauuuuagaagccggauuucccugacacgcgauagagaccucuucaccgcucacauggauauccggggacugacagaaggcgacaccgccacauauuuuugugcccgccagaaauucuacgcuggcgggcaaggaugguauuuugaucuuuggggcagagggacccugauuguugugucuagc

SEQ ID NO: 41325 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucagcggcgcggugaacuuuggguccccgaauuuccgccagagaguuucucuuacgcgggaucgcgaccuguuuaccgcucacauggauauuagaggacucacacaaggcgacaccgccacauacuucugugcccggcagaaguuugaacgcggcgggcagggauggaucuucgaucuguggggcagagggacccuuauugcugugagcucc

SEQ ID NO: 41326 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucagaugggugaaggcggucucuggagcugugaacuacggcagccuggauuuucggcaccgcguuucccucacgagagaccgggaucugucuaccgcccauauggacauucgcgggcuuacacaggaugacaccgccacauauuucugugcuagacaaaaauuugcccggggagaucagggcugguucuuugaccuguggggccgcgggacccucaucguggucagcucc

SEQ ID NO: 41327 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucuagcgauuucagacagcggguuucccugacacgcgacagagaucucuuuaccgcucaaauggacauucggggacugacacagggcgauaccgccacauacuucugugcccgccagaaauuuuaugcuggcgggcagggaugguacuucgaccuuuggggcagagggacccugaucguggucucuagc

SEQ ID NO: 41328 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugcucaccagauuagcgaucgcguuucccuuaccagagaccgggaucuguucacagcccauauggacauccgcgggcucacccaaggagauacagccaccuacuuuugugcuagacagaaguucuaugccggcggccaggggugguacuuugaccuguggggacggggcacacuuauuguggucucuagc

SEQ ID NO: 41329 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggucgugucuggcgcgguuaacuuugggagcccgaauuucagacagcgggugucccuuacgcgcgauagagaccuguuuaccgcucacauggauauucggggacucacacaaggcgacaccgccacauacuucugugcccgccagaaauuugaaagaggcgggcagggauggaucuucgaucuguggggccgggggacccuuauugcugucucuagc

SEQ ID NO: 41330 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagaagucugaacucauucauugggugcggcaggcuccuggccaggggcuggaguggaucggaugggucaaaacagugacgggcgccguuaacuuugggagcuccgauuuccgccagagagugucucuuacccgggaccgcgaucuguuuacagcgcacauggacauuagaggacucacccaaggcgauacagcuaccuacuucugugcccggcagaaguuuuaugccggcgggcagggaugguacuucgaccuguggggccgcgggacacuuaucgucgugagcucc

SEQ ID NO: 41331 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaagaggcgggcagggauggauuuucgaccuuuggggccgggggacacugaucgcuguuucuagc

SEQ ID NO: 41332 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcucgcggggaccagggaugguuuuucgaucuuuggggcagaggcacacugaucgugguuagcucu

SEQ ID NO: 41333 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauaccugugugcccgccaaaaauucgaaagaggcgggcagggaugguauuuugaucuuuggggccgggggacccugaucguggucuccucu

SEQ ID NO: 41334 - RNA, 372 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucaagucugagcugauucauugggugcgccaagcuccuggccaggggcucgaauggaucggaugggugaaaacggucaccggcgccgugaacuuugggagcuccgauuucagacagcggguuucucugacacgcgacagagaucuuuuuaccgcgcacauggacauucggggacugacacagggcgauaccgcuacauacuucugugcccgccaaaaguuuuaugccggcgggcagggaugguacuucgaccucuggggcagagggacccugaucguggucagcucc

SEQ ID NO: 41335 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacagaaggcgacaccgccacauacuucugugcccgccagaaauuuuaugcuggcgggcaaggaugguacuucgaucuguggggcagagggacccuuaucguggucuccucu

SEQ ID NO: 41336 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucugcuuacuucagacaccggguuagccuuacacgcgauagagaccuguuuaccgcccauauggauauucggggacucacacagggcgacaccgccacauauuucugugcucgccaaaaauuuuacaagggcgggcagggaugguauuucgaucuguggggcagagggacccuuaucguggucuccucu

SEQ ID NO: 41337 - RNA, 375 nt, Artificial Sequence
  derived and/or modified sequence opt5 from anti-HIV-1_HeavyChain
caggcccaccuggagcaaagcggccccggggugaagaaacucggagcuuccgucagaguuucuugcuggaccagcgaagacaucuucgagcggacagaacugauucauugggugcgccaggccccuggccaggggcuugaguggaucggaugggugaaggcggucuccggcgcugugaacuacgggucucuggauuuuagacaccggguuagccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucuccucu

SEQ ID NO: 41338 - RNA, 375 nt, Artificial Sequence
  derived and/or modified sequence opt5 from anti-HIV-1_HeavyChain
agagcccaccuggagcagagcggcuccggggugaagaaacccggagcuucuguccggguuagcugcuggaccuccgaagacaucuucgagcgcacagaacucauucauugggugagacaagccccuggccaggggcuggaguggaucggaugggugaagauugucucuggcgcggugaacuuugggagcccgaauuuccggcagcgcguuucccuuacgagagaucgggaccuguuuaccgcucacauggauauccgcggacucacacagggcgacaccgccacauacuucugugccagacaaaaauuugaacggggcgggcagggauggauuuucgaucuguggggccgcgggacccuuaucgcugugucuagc

SEQ ID NO: 41339 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucuagcgauuucagacagcggguuucccugacacgcgacagagaucucuuuaccgcucacauggacauucggggacugacacaaggcgauaccgccacauacuucugugcccgccagaaauuuuaugcuggcgggcagggaugguacuucgaccuuuggggcagagggacccugaucguggucucuagc

SEQ ID NO: 41340 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucuucacggcccauauggacauucggggacugacccaggaugacacagccaucuauuuuugugcucgccaaaaauucgccagaggcgaucagggcugguuuuucgaccuuugggggcggggaacccugauuguggucagcucc

SEQ ID NO: 41341 - RNA, 375 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaaggcggugucuggcgcuguuaacuacgggagccuugauuuuagacaccgggugucccugacgcgcgacagagaucucuucaccgcccauauggacauucggggacugacacaggaugacaccgccaucuauuuuugugcucgccaaaaauucgccagaggcgaucagggcugguuuuucgaccuuugggggcggggaacacugauugucgugucuagc

SEQ ID NO: 41342 - RNA, 375 nt, Artificial Sequence
  derived and/or modified sequence opt5 from anti-HIV-1_HeavyChain
caggugcaacugguccagagcggcgccgagcucaagaaacccggguccucuguuagagugagcugcuggaccuccgaagacaucuucgagggaucugaacugauucacugggugcggcaggcuccuggccaggggcuugaguggaucggaugggucaagacagugacgggcgccguuaacuuugggagcgcguacuuccgccauagagugucccugacccgggaucgcgaccucuuuacagcucacauggauauuagaggacugacccaaggcgacacagccaccuauuucugugcccggcagaaauuuuacaagggcgggcagggaugguauuucgaucuuuggggccgcgggacacugaucgucgugucuagc

SEQ ID NO: 41343 - RNA, 375 nt, Artificial Sequence
  derived and/or modified sequence opt5 from anti-HIV-1_HeavyChain
caggcccaccuggagcaaagcggcuccggggugaagaaacccggagucucuguuagagugagcugcuggaccuccgaagacaucuucgagcggacagaacucauucauugggugcgccaggcuccuggccaggggcuggaguggaucggaugggucaagauugugucuggcgccguuaacuuugggagcccgaauuucagacagcgggugucccuuacgcgcgauagagaccuguuuaccgcgcacauggauauccggggacucacacaaggcgacaccgcuacauacuucugugcccgccagaaauuugaaagaggcgggcagggauggauuuucgaucuguggggccgggggacccuuaucgccgucucuagc

SEQ ID NO: 41344 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggucgugucuggcgcgguuaacuacgggagccuggauuuuagacaccgggugucccucacgcgcgacagagaucuguucaccgcucauauggacauucggggacuuacacaggaugacaccgccacauauuuuugugcccgccaaaaauucgcuagaggcgaucagggcugguuuuucgaccugugggggcggggaacccucaucgucgugucuagc

SEQ ID NO: 41345 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccgcuuauuuuugugcccgccaaaaauucgcuagaggcgaucagggcugguuuuucgaccugugggggcggggaacacucaucguggucucuagc

SEQ ID NO: 41346 - RNA, 375 nt, Artificial Sequence
  derived and/or modified sequence opt5 from anti-HIV-1_HeavyChain
caggcccaccuggagcaaagcggcuccggggugagaaagcccggagcuucuguccggguuagcugcuggaccuccgaagacaucuucgagaaaucugaacucauucauugggugcgccaggccccuggccaggggcuggaguggaucggaugggugaagacagucacgggcgcggugaacuuugggagcuccgauuucagacagcggguuucucuuacccgcgacagagaucuguuuacagcucacauggacauucggggacucacccaaggcgauacagccaccuacuucugugcccgccagaaauuuuaugcuggcgggcagggaugguacuucgaccuguggggcagagggacacuuaucguggucagcucc

SEQ ID NO: 41347 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaaggcgacacagcuaccuacuucugugcccgccagaaauuuuauaagggcgggcagggaugguacuucgaucuuuggggcagagggacgcugaucguggucuccucu

SEQ ID NO: 41348 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauucauuggguucgccaggccccuggacagggccuggaguggaucgggugggugaaggcggugagcggagcugucaacuacggcucccuugauuuuagacaccgggugucucugacgcgcgacagagaucucuucaccgcccauauggacauucgggggcugacacaggaugacaccgccacauauuuuugugcucgccaaaaauucgccagaggagaucagggcugguuuuucgaccuuuggggccgggggacccugaucguugugagcucc

SEQ ID NO: 41349 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggguuucccugacccgcgacagagaucucuuuacagcucauauggacauucggggacugacccagggcgauacagccaccuacuucugugcccgccaaaaauuugcuagaggcgaccaggggugguucuuugaucuuuggggacggggcacacugaucguggucucuagc

SEQ ID NO: 41350 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucucuggcgcggugaacuuugggagccuuaauuucagacaccggguuucccugacacgcgauagagaccucuuuaccgcucauauggauauucggggacugacacagggcgacaccgccacauacuucugugcccgccaaaaguuuuauaaaggcgggcagggaugguacuucgaucuuuggggcagagggacccugaucguggucucuagc

SEQ ID NO: 41351 - RNA, 375 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaaacuugugagcggagcugucaacuuuggcuccguggauuucagagaccggguuucucugacacgcgauagagaccucuuuacggcccauauggauauccgggggcugacccagggagacacagccaccuauuucugugcucgccagaaguuuuacgccggcggccaagggugguauuucgaucuuuggggaagaggcacacugauuguggucagcucc

SEQ ID NO: 41352 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagauugucagcggcgcggugaacuuuggguccccgaauuucagacagcggguuucucuuacacgcgauagagaccuguuuacggcucacauggauauccggggacucacccaaggcgacacagccaccuacuucugugcccgccagaaauuugaaagaggcgggcagggauggauuuucgaucuguggggccgggggacacuuaucgcugugagcucc

SEQ ID NO: 41353 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucucuggcgcggugaacuuugggagcccuaauuucagacaccggguuucccugacccgcgauagagaccucuuuacagcucauauggauauucggggacugacccagggcgacacagccaccuacuucugugcccgccaaaaauuugaaagaggcgggcagggaugguauuucgaucuuuggggccgggggacacugaucguggucucuagc

SEQ ID NO: 41354 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagaaaucugaacucauucauugggugcgccaggccccuggccaggggcuggaguggaucggaugggugaagacagucacgggcgcggugaacuuugggagcuccgauuucagacagcggguuucucuuacccgcgacagagaucuguuuacagcucacaugggcauucggggacucacccaaggcgacacagccaccuacuucugugcccgccagaaauuuuaugcugggggacagggcugguacuucgaucugugggggagaggaacacuuaucguggucagcucc

SEQ ID NO: 41355 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuacgggagccuugauuuuagacaccggguuucccugacgcgcgacagagaucucuucaccgcccauauggacauucggggacugacacaggaugacaccgccaucuauuuuugugcucgccaaaaauucgccagaggcgaucagggcugguuuuucgaccuuugggggcggggaacacugauuguggucucuagc

SEQ ID NO: 41356 - RNA, 375 nt, Artificial Sequence
  derived and/or modified sequence opt5 from anti-HIV-1_HeavyChain
cagagccaccuggagcaauccggcucugccaugaagaaacucggggcuagcgugagaguccccugcuggaccuccgaagacaucuucgagcggacagaacugauucauuggguucgccaggccccuggacagggccuugaguggaucgggugggugaaggcggugucuggagcugucaacuacggcagccuggauuuuagacaccgggugucccucacgcgcgacagagaucuguucaccgcccauauggacauucgggggcuuacacaggaugacaccgccacauauuuuugugcucgccaaaaauucgccagaggagaucagggcugguuuuucgaccuguggggccgggggacccucaucguugugucuagc

SEQ ID NO: 41357 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagcggacagaacucauucauugggugcgccaggcuccuggccaggggcuggaguggaucggaugggucaagauugugucuggcgccguuaacuuugggagcccgaauuucagacagcgggugucccuuacgcgcgauagagaccuguuuaccgcgcacauggauauccggggacucacacaaggcgacaccgcuacauacuucugugcccgccagaaauuugaaagaggcgggcagggauggauuuucgaucuguggggccgggggacccuuaucgccgucucuagc

SEQ ID NO: 41358 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuacgggagccuugauuuuagacaccggguuucccugacgcgcgacagagaucucuucaccgcccauauggacauucggggacugacacaggaugacaccgccacauauuuuugugcucgccaaaaauucgccagaggcgaucagggcugguuuuucgaccuuugggggcggggaacccugaucguggucucuagc

SEQ ID NO: 41359 - RNA, 375 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucgggugggugaagacagucagcggagcugugaacuuuggcuccccgaauuucagacaucggguuucucuuacgcgcgauagagaccuguuuaccgcccacauggauauucgggggcucacacagggagacaccgccacauauuucugugcucgccagaaauuugaaagaggcggccaagggugguacuucgaucuguggggacggggcacccuuaucguggucagcucc

SEQ ID NO: 41360 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuugaaagaggcgggcagggaugguauuucgaucuguggggccgggggacccuuaucguggucuccucu

SEQ ID NO: 41361 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucuacgccggaggccaaggcugguauuuugaucugugggggcggggaacccuuauugugguuagcucu

SEQ ID NO: 41362 - RNA, 375 nt, Artificial Sequence
  derived and/or modified sequence opt5 from anti-HIV-1_HeavyChain
caggugcaacuggagcagagcggcuccggggucaagaaacccggagccucuguuagagugagcugcuggaccuccgaagacaucuucgagaagucugaacucauucacugggugcggcaggcuccuggccaggggcuggaguggaucggaugggucaaaacagugacgggcgccguuaacuuugggagcuccgauuuccgccaaagagugucucuuacccgggaccgcgaucuguuuacagcgcauauggacauuagaggacucacccagggcgauacagcuaccuacuucugugcccggcagaaguuuuaugccggcgggcagggaugguacuucgaccuguggggccgcgggacacuuaucgucgugagcucc

SEQ ID NO: 41363 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggcagagggcuggaguggaucggaugggugaaggcggucucuggcgcugugaacuacgggagccuugauuuucggcaccgcguuucccugacgagagaccgggaucucuucaccgcccauauggacauucgcggacugacacaggaugacaccgccacauauuuuugugcuagacagaaauucgcccggggcgaucaaggcugguuuuucgaccuuugggggcgcggaacccugaucguggucucuagc

SEQ ID NO: 41364 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauucauuggguucgccaggccccuggacagggccuggaguggaucgggugggugaagacggugaccggagcggucaacuuuggcagcccgaauuucagacaccgggugucccuuacacgcgauagagaccuguuuaccgcucauauggauauucgggggcucacacagggagacaccgccacauacuucugugcccgccaaaaauuugaaagaggcggccaggggugguauuucgaucuguggggacggggcacccuuaucguugugucuagc

SEQ ID NO: 41365 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggacagggugggugaaaacggucagcggagcugugaacuuuggcuccaccgauuuccgggaacgcguuucucuuacaagagaccgggaucuguuuaccgcccauauggacauccgcgggcucacacagggagauaccgccacauauuucugugcuagacaaaaguuugcccggggcgaccagggcugguucuuugaucugugggggcgcggaacccuuauuguggucagcucc

SEQ ID NO: 41366 - RNA, 375 nt, Artificial Sequence
  derived and/or modified sequence opt5 from anti-HIV-1_HeavyChain
caggugcaccuggagcaaagcggcuccggggucaagaaacucggagccucuguuagagugagcugcuggaccuccgaagacaucuucgagcggacagaacugauucauugggugcgccaggcucccggcagagggcuugaguggaucggaugggucaaggccgugucuggcgcgguuaacuacgggagccuggauuuucggcaccgcgugucccucacgagagaccgggaucuguucaccgcucauauggacauucgcggacuuacacaggaugacaccgccacauauuuuugugccagacagaaauucgcucggggcgaucaaggcugguuuuucgaccugugggggcgcggaacccucaucgucgugucuagc

SEQ ID NO: 41367 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauauuacgcuggcgggcagggaugguauuuugaucuguggggcagagggacacuuaucguggucucuagc

SEQ ID NO: 41368 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuuuaugcuggcgggcagggaugguacuucgaucuguggggcagagggacccuuaucguggucuccucu

SEQ ID NO: 41369 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcggcacagccaccuacuucugugcccggcagaaguuuuaugcugggggacagggcugguacuucgaucugugggggcgcggaacacuuaucguggucagcucc

SEQ ID NO: 41370 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauuuguggacucacccagggcgacacagccaccuacuucugcgcccggcaaaaauuugaacgcggcgggcagggaugguauuucgaucuguggggcagagggacacuuaucguggucucuagc

SEQ ID NO: 41371 - RNA, 375 nt, Artificial Sequence
  derived and/or modified sequence opt5 from anti-HIV-1_HeavyChain
caggcccaccuggagcaaagcggcuccggggugagaaaggucggagcuucuguucgggugagcugcuggaccuccgaagacaucuucgagcgcacagaacucauucauugggugagacaggcccccggccaggggcuggaguggaucggaugggucaaagcggugucuggcgcuguuaacuacgggagccuugauuuucggcaccgcgugucccugacgagagaccgggaucucuucaccgcccauauggacauucgcggacugacacaggaugacaccgccaucuauuuuugugcuagacaaaaguucgcccggggcgaucagggcugguuuuucgaccuuugggggcgcggaacacugauugucgugucuagc

SEQ ID NO: 41372 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauauuacgcuggcgggcagggaugguauuuugaucuguggggcagagggacccuuaucguggucuccucu

SEQ ID NO: 41373 - RNA, 375 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagcggacagaacucauucacuggguccgccaggccccuggacagggccuggaguggaucgggugggugaagacgguuaccggagcggugaacuuuggcuccccgaauuucagacaucgggucucucuuacacgcgauagagaccuguuuaccgcucacauggauauucgggggcucacacaaggagacaccgccacauacuucugugcccgccagaaauuugaaagaggcggccaggggugguauuucgaucuguggggacggggcacccuuaucgugguuagcucc

SEQ ID NO: 41374 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggcuuagcgauuuccgccagagaguuucccugacccgggaccgcggacucuuuacagcucacauggauauuagaggccugacccaaggcgacacagccaccuacuucugugcccggcagaaguuuuaugcugggggacagggcugguacuucgaucuuugggggcgcggaacacugaucguggucucuagc

SEQ ID NO: 41375 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacagcggguuagccuuacccgcgauagagaccuguuuacagcgcacauggauauucggggacucacccaaggcgacacagcuaccuacuucugugcccgccagaaauuugaaagaggcgggcagggauggaucuucgaucuguggggccgggggacgcuuauugccguguccucu

SEQ ID NO: 41376 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgagcgcgggggacagggcugguacuuugaccuuuggggcagagggacacugaucgugguuagcucu

SEQ ID NO: 41377 - RNA, 375 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagggauccgaacucauucacuggguccggcaggccccuggccaggggcuggaguggaucggaugggugaagacaguuacgggcgcggugaacuuugggucugcuuacuuccgccauagagucagccuuacccgggaucgcgaccuguuuacagcccacauggauauuagaggacucacccaaggcgacacagccaccuauuucugugcucggcagaaauuuuacaagggcgggcagggaugguauuucgaucuguggggccgcgggacacuuaucgugguuuccucu

SEQ ID NO: 41378 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauauggauauuagaggccucacccaggacgauacagccaccuauuuuugugcccggcaaaaauucgagcgcgggggacagggcuggaucuuugaccuguggggcagagggacacuuaucgcugugucuucc

SEQ ID NO: 41379 - RNA, 375 nt, Artificial Sequence
  derived and/or modified sequence opt5 from anti-HIV-1_HeavyChain
caggugcaacugguccagagcggcaccgagguuaagaaacccggggccuccgugagagugucuugcaaggcuagcggauacacauucgaaaaauccgagcucauccacuggguccggcaggccccuggccaggggcuggaauggauuggaugggugaagacgguuaccggcgcggugaacuuugggucuagcgacuuccgccaaagagucucccuuacacgggaucgcgaccuguuuaccgcucauauggauaucagaggacucacacagggcgacaccgccacauauuucugugcccggcagaaauuuuacgcuggcgggcagggaugguauuucgaucuguggggccgcgggacccuuauugugguuucuagc

SEQ ID NO: 41380 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaacggggaggccaaggcuggauuuuugaucugugggggcgcggaacccuuaucgccgugagcucu

SEQ ID NO: 41381 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucagcacggcccauauggacauucggggacugacccaggaugacacagccaccuauuucugugcucgccaaaaauuugccagaggcgaucagggcugguucuuugaccuuugggggcggggaacacugaucguggucuccagc

SEQ ID NO: 41382 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaagaugacacagccaucuacuucugugcccggcagaaguuugcucgcggcgaucagggcugguucuuugaccugugggggagaggaacccuuauuguggucagcucc

SEQ ID NO: 41383 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuuuaugcuggcgggcagggaugguacuucgaccuuuggggcagagggacccugauuguuguguccucu

SEQ ID NO: 41384 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucgugcauugggugcggcaggccccuggccaggggcuggaguggauuggaugggucaaaacagugacgggcgcgguuaacuuugggagcuccgauuuccgccagagagugucucuuacccgggaccgcgaucuguuuacagcucacauggacaucagaggacucacccaaggcgauacagccaccuacuucugugcccggcagaaguuugaacgcggcgggcagggauggauuuucgaccuguggggcagagggacacuuaucgcugucagcucc

SEQ ID NO: 41385 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucgccagaggcgaccaggggugguuuuucgaucuguggggacggggcacccucaucguggucucuagc

SEQ ID NO: 41386 - RNA, 375 nt, Artificial Sequence
  derived and/or modified sequence opt5 from anti-HIV-1_HeavyChain
caggcccacagagagcaaagcggcuccggggugaagaaacccggagcuucuguccggguuagcugcuggaccuccgaagacaucuucgagcgcacagaacugauucauugggugagacaggccccuggccaggggcucgaguggaucggaugggugaagacggucaccggcgcggugaacuuugggucuagcgauuuccggcagcgcguuucccugacaagagaccgggaucuuuuuaccgcucacauggacauucgcggacugacacaaggcgauaccgccacauacuucugugccagacagaaauuuuaugcuggcgggcagggaugguacuucgaccucuggggccgggggacccugaucguggucucuagc

SEQ ID NO: 41387 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugccucgccuccgaagacaucuucaagaccgagcugauucauugggugcggcaggcgccuggccaggggcuugaauggaucggaugggugaaaauugucucuggcgcugugaacuuugggagcccgaauuuccgccagagaguuucccugacacgggaucgcgaccucuuuacggcccacauggauaucagaggacugacccaaggcgacacagccaccuacuucugugcucggcagaaguuugagcgcggcgggcagggauggauuuucgaucuuuggggcagagggacacugaucgccgugucuagc

SEQ ID NO: 41388 - RNA, 375 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaaggcggugucuggcgcuguuaacuacgggagccuugauuuuagacaccgggugucccugacgcgcgacagagaucucuucaccgcccauauggacauucggggacugacacaggaugacaccgccaucuauuuuugugcucgccaaaaauucgaaagaggcggccagggguggauuuuugaucuuuggggacggggcacacugaucgccgucucuagc

SEQ ID NO: 41389 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugcucgcggcgaccaggggugguucuuugaucuguggggaagaggcacacuuaucguggucagcucc

SEQ ID NO: 41390 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucacgggagcugugaacuuuggcagcuccgauuuccggcagcgcguuucucuuaccagagaccgggaucuguuuacagcccauauggacauucgcgggcucacccaaggagauacagccaccuauuucugugcuagacagaaguuuuacgccggcggccaggggugguauuucgaccuguggggacggggcacacuuaucguggucagcucc

SEQ ID NO: 41391 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucuccuaauuucagacaccggguuagccugacacgcgauagagaccucuuuaccgcucauauggauauucggggacugacacagggcgacaccgccacauacuucugugcccgccaaaaauauuacgcuggcgggcagggaugguauuuugaucuuuggggcagagggacccugaucguggucuccucu

SEQ ID NO: 41392 - RNA, 375 nt, Artificial Sequence
  derived and/or modified sequence opt5 from anti-HIV-1_HeavyChain
caggugcaacugguccagagcggcuccgggguuaagaaacccggagccucugugagagugagcugcuggaccuccgaggacaucuucgaacggacagagcucauucacuggguccgccaggcuccuggccaggggcuggaauggaucggaugggugaagauuguuucuggcgccgugaacuuugggagcccgaauuucagacaacgggucucccuuacgcgcgauagagaccuguuuaccgcgcauauggauauccggggacucacacagggcgacaccgcuacauacuucugugcccgccagaaauuugagagaggcgggcagggauggauuuucgaucuguggggccgggggacccuuaucgccgugucuagc

SEQ ID NO: 41393 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagauugucucuggcgccgugaacuuugggagcccgaauuuccggcagcgcguuucccugaccagagaucgggaccuuuuuacagcgcacauggauauccgcggacugacccagggcgacacagcuaccuacuucugugccagacaaaaauuugaacggggcgggcagggauggauuuucgaucucuggggccgcgggacacugaucgccgugucuagc

SEQ ID NO: 41394 - RNA, 372 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaaccuggcgccgaauuuucggcaccgcguuucucuuaccagagaucgggaccuguucacagcucauauggauauucgcgggcucacccagggagacacagccaccuacuuuugugccagacagaaauucgaacggggcggccaagggugguauuuugaucuguggggacgcggcacgcuuaucguggucagcucc

SEQ ID NO: 41395 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcuccgauuuccgccagagaguuucucuuacccgggaccgcgaucuguuuacagcucacauggacauuagaggccucacccaaggcgauacagccaccuacuucugugcccggcagaaauuuuaugcugggggacagggcugguacuucgaccugugggggcgcggaacacuuaucguggucagcucc

SEQ ID NO: 41396 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauauggauauuagaggccucacccagggggacacagccaccuauuuuugugcccggcaaaaauacuaugcuggaggccagggcugguacuucgaucugugggggcgcggaacacuuaucgugguuucuucc

SEQ ID NO: 41397 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagauugucucuggcgcggugaacuuugggagcccuaauuucagacagcggguuucccugacgcgcgauagagaccucuuuaccgcucacauggauauccggggacugacacaaggcgacaccgccacauacuucugugcccgccagaaauuugaaagaggcgggcagggauggauuuucgaucuuuggggccgggggacccugaucgcugugucuagc

SEQ ID NO: 41398 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuauaaaggcgggcagggaugguacuucgaccuguggggccgcgggacacuuaucguggucagcucc

SEQ ID NO: 41399 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugcuagaggcgaucaggggugguucuuugaccuguggggacggggcacccuuaucguggucuccucu

SEQ ID NO: 41400 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacagggcgauaccgccacauauuuuugugcuagacagaaauucgaacggggcgggcaaggaugguacuuugaccuguggggccgcgggacccucaucguggucucuagc

SEQ ID NO: 41401 - RNA, 375 nt, Artificial Sequence
  derived and/or modified sequence opt5 from anti-HIV-1_HeavyChain
caggccagacccggcaccagcggguccggagugaagaaaccuggcgcuucuguccggguuagcugcugguccucugaggacaucuucgaacgcacagagcugauucacugggugagacaagccccggggcagggacucgaauggaucggcugggugaagacggucaccggggcggugaacuuuggaagccuggauuuccggcagcgcguuucccuuacaagagaccgggaucuguuuaccgcucauauggacauucgcggccucacacagggcgauaccgccacauacuucugugccagacaaaaauuugagcgcgggggacagggcuggaucuucgaccugugggggcggggaacccuuauugcugugucuagc

SEQ ID NO: 41402 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacagaaggcgacaccgccacauacuucugugcccgccagaaauuugagagaggcgggcaaggauggaucuucgaucuguggggccgggggacccuuauugcuguguccucu

SEQ ID NO: 41403 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcgauuucuggcgcugucaacuacgggagccuugauuuuagacaccgggugucccugacgcgcgacagagaucucuucaccgcccauauggacauccggggacugacacaggaugacaccgccacauauuuuugugcucgccaaaaauucgccagaggcgaucagggcugguuuuucgaccuuugggggcggggaacccugauuguugugucuagc

SEQ ID NO: 41404 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacagcggguccccgaauuuucgccacagaguuucucuuacccgggaucgcgaccuguucacagcucauauggauauuagaggacucacccagggcgacacagccaccuacuuuugugcccggcaaaaguucgaacgcggcgggcagggaugguauuuugaucuguggggcagagggacacuuaucguggucagcucc

SEQ ID NO: 41405 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcgggccgaacucauucauugggugcgccaggcgccuggccaggggcuggaguggaucggaugggugaagacagucucuggcgcugugaacuuugggagccuuaauuucagacaccggguuucccugacgcgcgauagagaccucuuuaccgcccauauggauauucggggacugacacagggcgacaccgccacauacuucugugcucgccaaaaauuugccagaggcgaucaggggugguucuuugaccuuuggggacggggcacccugaucguggucucuagc

SEQ ID NO: 41406 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucgugacagucagcucc

SEQ ID NO: 41407 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuuaauuucagacaccggguuagccugacacgcgauagagaccucuuuaccgcucauauggauauucggggacugacacagggcgacaccgccacauacuucugugcccgccaaaaauuugaaagaggcgggcagggaugguauuucgaucuuuggggccgggggacccugaucguggucuccucu

SEQ ID NO: 41408 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguccaccgcucauauggauauucggggacucacacaggacgauaccgccacauacuuuugugcccgccaaaaauucgcuagaggcgaccagggcugguuuuucgaucugugggggcggggaacccuuaucguggucucuagc

SEQ ID NO: 41409 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagaccgugacaggagcggucaacuuuggcagcccgaauuuccgccauagagugucccuuacccgggaccgcgaucuguuuacagcucacauggacauuagagggcucacccagggagauacagccaccuauuucugugcccggcaaaaauacuaugcuggcggccaggggugguacuuugaccuguggggacgcggcacgcuuaucguugugucuagc

SEQ ID NO: 41410 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggcgucuggcgcugucaacuuugggagcccgaauuucagacaccgggugucccuuacccgcgauagagaccuguuuacagcccauauggauauucggggacucacccagggcgacacagccaccuacuucugugcucgccaaaaauuugaaagaggcgggcagggaugguauuucgaucuguggggccgggggacacuuaucguugugucuagc

SEQ ID NO: 41411 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgaaagaggcggccaggggugguacuuugaucuguggggacggggcacccucaucguggucucuagc

SEQ ID NO: 41412 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucagcggagcugugaacuuuggcuccacggauuuccgggaacgcguuucucuuaccagagaccgggaucuguuuacagcccauauggacauucgcgggcucacccagggagauacagccaccuauuucugugcuagacaaaaguuugagcggggcggccaggggugguacuucgaccuguggggacgcggcacacuuaucguggucagcucc

SEQ ID NO: 41413 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgugguuaacuacgggagccuggauuuuagacaccgggugucccucacgcgcgacagagaucugucuaccgcucauauggacauucggggacuuacacaggaugacaccgccacauauuucugugcccgccaaaaauuugcuagaggcgaucagggcugguucuuugaccugugggggcggggaacccucaucgucgugagcucc

SEQ ID NO: 41414 - RNA, 375 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaagacggugucuggcgcgguuaacuuugggagcccuaauuucagacaccgggugucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucgucgugucuagc

SEQ ID NO: 41415 - RNA, 375 nt, Artificial Sequence
  derived and/or modified sequence opt5 from anti-HIV-1_HeavyChain
caggccuaccuggagcaaagcggcuccaucaugaagaaacccggggcuucugugagagucagcugcuggaccuccgaagacauuuucgaucggacagagcucauccacuggguucgccaggccccuggacagggccuggaauggauugggugggugaagacggugaccggagcggucaacuuuggcucuagcgacuucagacagcgggugucccuuacacgcgauagagaccuguuuaccgcucauauggauauccgggggcucacacaaggagacaccgccacauauuucugugcccgccagaaauuuuacgcuggcggccaggggugguauuucgaucuguggggaagaggcacccuuauuguugugucuagc

SEQ ID NO: 41416 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcuggccccuggccaggggcuugaguggaucggaugggugaaaacagucacgggcgcggugaacuuugggagcuccgauuuccgccagagaguuucucugacccgggaccgcgaucucuuuacagcucacauggacauuagaggacugacccagggcgauacagccaccuacuucugugcccggcaaaaguuuuaugcuggcgggcagggaugguacuucgaccuuuggggccgcgggacacugaucguggucagcucc

SEQ ID NO: 41417 - RNA, 375 nt, Artificial Sequence
  derived and/or modified sequence opt5 from anti-HIV-1_HeavyChain
gaggcccaccuggaacagagcggcuccggggugaagaaacccggagcuucugucagaguuagcugcuggaccuccgaggacaucuucgaacggacagagcucacgcauugggugcgccaagccccuggccaggggcuggaauggauuggaugggugaagaccgucacaggcgcggugaacuuugggucuccgaauuucagacagcggguuagccuuacccgcgauagagaccuguuuacagcucacauggauauccggggacucacccagggcgacacagccaccuacuucugugcccgccaaaaauuugagagaggcgggcagggauggauuuucgaucuguggggccgggggacgcuuaucgcuguguccucu

SEQ ID NO: 41418 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuacgagcggacagaacucauucauugggugcgccaggccccuggccaggggcuggaguggaucggaugggugaaggcggucucuggcgcugugaacuaugggagccuugauuucagacaccggguuucccugacgcgcgacagagaucucuuuaccgcccauauggacauucggggacugacacaggaugacaccgccaucuacuucugugcucgccaaaaauuugccagaggcgaucagggcugguucuuugaccuuugggggcggggaacacugauuguggucucuagc

SEQ ID NO: 41419 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagcggacagaacucauucauugggugcgccaggcuccuggccaggggcuggaguggaucggaugggucaagacggugaccggcgccguuaacuuugggucuccgaauuucagacaccgggugagccuuacacgcgauagagaccuguuuaccgcgcauauggauauucggggacucacacagggcgacaccgcuacauacuucugugcccgccaaaaauuugaaagaggcgggcagggaugguauuucgaucuguggggccgggggacccuuaucgucguguccucu

SEQ ID NO: 41420 - RNA, 375 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaaggcggugucuggcgcuguuaacuacgggagccuugauuuuagacaccgggugucccugacgcgcgacagagaucucucuaccgcccauauggacauucggggacugacacaggaugacaccgccacauauuucugugcucgccaaaaauuugccagaggcgaucagggcugguucuuugaccuuugggggcggggaacccugaucgucgugagcucc

SEQ ID NO: 41421 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggccgcccaauuucagacaccggguuagccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucuccucu

SEQ ID NO: 41422 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagaggcggccagggguggaucuucgaucuguggggacggggcacccucauugccgugagcucc

SEQ ID NO: 41423 - RNA, 375 nt, Artificial Sequence
  derived and/or modified sequence opt5 from anti-HIV-1_HeavyChain
caggcccaccuggagcaaagcggcuccggggugagaaagcccggagcuucuguccggguuagcugcuggaccuccgaagacaucuucgagcgcacagaacucauucauugggugagacaggccccuggccaggggcuggaguggaucggaugggugaaaacggucaccggcgcggugaacuuugggucuagcgauuuccggcagcgcguuucccuuacaagagaccgggaucuguuuaccgcucacauggacauucgcggacucacacaaggcgauaccgccacauacuucugugccagacagaaguuuuaugcuggcgggcagggaugguacuucgaccuguggggccgggggacccuuaucguggucucuagc

SEQ ID NO: 41424 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagcccuaauuuucggcaccgcguuucccugacgagagaucgggaccucuucaccgcccauauggauauucgcggacugacacagggcgacaccgccacauauuuuugugcuagacagaaauucgaacggggcgggcaaggaugguacuuugaucuuuggggccgcgggacccugaucguggucucuagc

SEQ ID NO: 41425 - RNA, 375 nt, Artificial Sequence
  derived and/or modified sequence opt5 from anti-HIV-1_HeavyChain
caggcccaccuggagcaaagcggcuccggggugaagaaacccggagcuucuguccggguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggcagaggggcucuuaucguggucucuagc

SEQ ID NO: 41426 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcgcuuacuuccgccacagaguuucccuuacccgggaucgcgaccuguuuacagcccauauggauauuagaggacucacccagggcgacacagccaccuauuucugugcucggcaaaaguuuuacaaaggcgggcagggaugguauuucgaucuguggggccgcgggacacuuaucguggucucuagc

SEQ ID NO: 41427 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcucccuugauuuccggcaucgcgugucucugacaagagaccgggaucucagcaccgcgcacauggacauucgcgggcugacacaggaugacaccgcuacauauuuuugugccagacagaaauucgcccggggagaucaaggcugguuuuucgaccuuuggggccgcgggacccugaucguuguguccagc

SEQ ID NO: 41428 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauauggauauuagaggccucacccaggacgauacagccaccuauuuuugugcccggcaaaaauucuacgcugggggacagggcugguauuuugaccuguggggccgcgggacacuuaucgugguuucuucc

SEQ ID NO: 41429 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucacgggcgcugugaacuuugggucuagcgauuucagacagcggguuucccugacccgcgacagagaucucuuuacagcccacauggacauucggggacugacccaaggcgauacagccaccuacuucugugcucgccagaaauuuuaugccggcgggcagggaugguacuucgaccuuuggggcagagggacacugaucguggucucuagc

SEQ ID NO: 41430 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggagcggucaacuuuggcuccucugauuuccggcagcgcgugagccuuaccagagaccgggaucuguuuacagcucauauggacauucgcgggcucacccagggagauacagccaccuauuucugugccagacaaaaauuuuacgcuggcggccaggggugguauuucgaccuguggggacggggcacacuuaucguuguguccagc

SEQ ID NO: 41431 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacgccgccaccuacuucugugcucgccaaaaauuugaaagaggcgggcagggaugguauuucgaucuguggggccgggggacacuuaucguggucuccucu

SEQ ID NO: 41432 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuuuugugcuagacagaaauucuacgccggcggccaagggugguauuuugaucuguggggacggggcacccucaucguggucucuagc

SEQ ID NO: 41433 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuugcugcccacauggauauccggggacucacccaaggcgacacagccaccuacuucugugcucgccagaaauuugaaagaggcgggcagggauggauuuucgaucuguggggccgggggacacuuaucgccgugucuagc

SEQ ID NO: 41434 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucgcccagggcgacacagccaccuacuucugugcucgccaaaaauuugaaagaggcgggcagggaugguauuucgaucuguggggccgggggacacuuaucguggucuccucu

SEQ ID NO: 41435 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauauggauauuagaggccucacccaggacgauacagccaccuauuuuugugcccggcaaaaauucgagcgcgggggacagggcugguacuuugaccuguggggcagagggacacuuaucgugguuucuucc

SEQ ID NO: 41436 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagagugucucugacacgggaucgcgaccucuuuaccgcucauauggauaucagaggccugacacagggggacaccgccacauauuucugugcccggcaaaaauuuuacgcuggaggccagggcugguauuucgaucuuugggggcgcggaacccugauuguugugagcucc

SEQ ID NO: 41437 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacaccggguuucccuuacgcgcgauagagaccuguuuaccgcucauauggauauccggggacucacacagggcgacaccgccacauacuucugugcccgccaaaaauuugaaagaggcgggcagggaugguauuucgaucuguggggccgggggacccuuauuguggucucuagc

SEQ ID NO: 41438 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcgcgccccuggccaggggcuggaguggaucggaugggugaaaacagucacgggcgcggugaacuuugggagcuccgauuucagacagcggguuucucuuacccgcgacagagaucuguuuacagcucacauggacauucggggacucacccagggcgauacagccaccuacuucugugcccgccaaaaguuuuaugcuggcgggcagggaugguacuucgaccuguggggcagagggacacuuaucguggucagcucc

SEQ ID NO: 41439 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacagcggguuucccucacgcgcgacagagaucuguucaccgcccacauggacauucggggacuuacacaaggcgauaccgccacauauuuuugugcucgccagaaauucgaaagaggcgggcagggauggaucuuugaccuguggggccgggggacccucauugccgugucuagc

SEQ ID NO: 41440 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuuuauaagggcgggcagggaugguacuucgaccuuuggggcagagggacacugauuguugugucuagc

SEQ ID NO: 41441 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagaagucugaacucauucauugggugcggcaggcuccuggccaggggcuggaguggaucggaugggugaaaacggucaccggcgccgugaacuuugggagcuccgauuuccgccagagaguuucucuuacacgggaccgcgaucuguuuaccgcgcacauggacauuagaggacucacacaaggcgauaccgcuacauacuucugugcccggcagaaguuuuaugccggcgggcagggaugguacuucgaccuguggggccgcgggacccuuaucguggucagcucc

SEQ ID NO: 41442 - RNA, 375 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucuacgcugggggacagggcugguauuuugaccuuuggggccgcgggacacugaucgugguuagcucu

SEQ ID NO: 41443 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacaggccugauucauugggugcgccaggcccccgggcagggacuugaauggaucggcugggugaaggcggucucuggggcugugaacuacggaagccuggauuuuagacaccggguuucccucacgcgcgacagagaucuguucaccgcccauauggacauucggggccuuacacaggaugacaccgccacauauuuuugugcucgccaaaaauucgccagaggcgaucaggggugguuuuucgaccuguggggacggggcacccucaucguggucucuagc

SEQ ID NO: 41444 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacguguucgagcggacggaacucauccauugggugcgccaggcuccuggccaggggcuggaguggauuggaugggucaagaccgugaucggcgccguuaacuuugggucuccgaauuucagacaccgggugagccuuacacgcgauagagaccuguuuaccgcgcauauggauauucggggacucacacagggcgacaccgcuacauacuucugugcccgccaaaaauuugaaagaggcgggcagggaugguauuucgaucuguggggccgggggacccuuaucgucguguccucu

SEQ ID NO: 41445 - RNA, 372 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucaagacagagcucauucauugggugcggcaggcgccuggccaggggcuggaauggaucggaugggugaaaauugucuccggcgcugugaacuuugggucuccgaauuuccgccagagaguuagccuuacgcgggaucgcgaccuguuuaccgcccacauggauaucagaggacucacacaaggcgacaccgccacauacuucugugcucggcagaaguuugagcgcggcgggcagggauggauuuucgaucuguggggcagagggacccuuaucgccguguccucu

SEQ ID NO: 41446 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccggauuucagacaccggguuucccuuacccgcgacagagaucuguuuacagcucauauggacauucggggacucacccagggcgauacagccaccuacuucugugcccgccaaaaauuugcuagaggcgaccaggggugguucuuugaucuguggggacggggcacacuuaucguggucucuagc

SEQ ID NO: 41447 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucucuggcgcggugaacuuugggagccuuaauuucagacaccggauuucccugacacgcgauagagaccucuuuaccgcucauauggauauccggggacugacacagggcgacaccgccacauacuucugugcccgccaaaaguuugcuagaggcgaucaggggugguucuuugaccuuuggggacggggcacccugauuguugugucuagc

SEQ ID NO: 41448 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccaucuauuucugugcucgccaaaaauuugccagaggcgaucagggcugguucuuugaccugugggggcggggaacacucauuguggucagcucc

SEQ ID NO: 41449 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggacgggaugggugaaggcggucucuggcgcugugaacuacgggagccuggauuuuagacaccggguuucccucacccgcgacagagaucugucuacagcccauauggacauccggggacuuacccaggaugacacagccaccuauuucugugcucgccaaaaauuugccagaggcgaucagggcugguucuuugaccugugggggcggggaacacucauuguggucagcucc

SEQ ID NO: 41450 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggaccuacacaggaugacaccgccacauauuuuugugcucgccaaaaauucgccagaggcgaucagggcugguuuuucgaccuuugggggcggggaacccugaucguggucucuagc

SEQ ID NO: 41451 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacagggcgauaccgccacauauuucugugcucgccaaaaauuugaaagaggcgggcagggaugguacuucgaccuguggggccgggggacccucaucguggucagcucc

SEQ ID NO: 41452 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagc

SEQ ID NO: 41453 - RNA, 375 nt, Artificial Sequence
  derived and/or modified sequence opt5 from anti-HIV-1_HeavyChain
agacacaccuggaacgagagcggcuccggggugaagaaacccggagccucuguccggguuagcugcuggacauccgaagacaucuucgagcgcacggaacugauucauugggugagacaggcuccuggccaagggcucgaguggaucggaugggugaagaccgucacaggcaccgugaauuuugggucucugaacuuccggcagcgcguuagccuuacaagagaucgggaccuguuuaccgcccacauggauauucgcggacucacacagggcgacaccgcgacguacuucugugcuagacagaaauuuuaugccggcgggcaaggaugguacuucgaucuguggggccgggggacccuuaucguggucuccucu

SEQ ID NO: 41454 - RNA, 375 nt, Artificial Sequence
  derived and/or modified sequence opt5 from anti-HIV-1_HeavyChain
caggcccaccuggagcaaagcggcgcuggggugaagagacccggagccuccguccggguuucuugcuggaccagcgaagacaucuucgagacaacggaacucauucauugggugcgccaggcgccuggccaggggcuggaguggaucggaugggugaaaaccgucuccggcgcugugaacuuugggucuccgaauuucagacaccggguuagccuuacacgcgauagagaccuguuuaccgcccauauggauauucggggacucacacagggcgacaccgccacauacuucugugcucgccaaaaguuugaaagaggcgggcagggaugguauuucgaucuguggggccgggggacccuuaucguggucuccucu

SEQ ID NO: 41455 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuuugggagcccgaauuucagacaccggguuucccuuacgcgcgauagagaccuguuuaccgcccauauggauauucggggacucacacagggcgacaccgccacauacuucugugcucgccaaaaauuugaaagaggcgggcagggaugguauuucgaucuguggggccgggggacccuuaucguggucucuagc

SEQ ID NO: 41456 - RNA, 375 nt, Artificial Sequence
  derived and/or modified sequence opt5 from anti-HIV-1_HeavyChain
caggcccaccugggcaccauccucgggcuggagagcaagaaacccggagcuuccgugagagucucuugcuggacaagcgaagacauuuucgagcggacggaacuuauccauuggguucgccaagccccuggccaggggcuggaguggauuggaugggugaagaccgugacaggcgcguccauccucgcuccgaacuuuagacaccgggucucucugacccgcgauagagaccuuuucacagcccauauggauauucgggggcugacccagggagacacagccaccuacuuuugugcucgccagaaauucgaaagaggcggccaagggugguauuuugaucucuggggacggggcacgcugaucgugguuagcucc

SEQ ID NO: 41457 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagcucuguuuaccgcccauauggacauucggggacucacacagggcgauaccgccacauacuucugugcucgccaaaaauuugccagaggcgaccaggggugguucuuugaucuguggggacggggcacccuuaucguggucuccucu

SEQ ID NO: 41458 - RNA, 375 nt, Artificial Sequence
  derived and/or modified sequence opt5 from anti-HIV-1_HeavyChain
agagugcaccuggagcagagcggcuccggggucaagaaacccggagccucuguucgggugagcugcuggaccuccgaagacaucuucgagcgcacagaacucauucauugggugagacaagcuccuggccaggggcuggaguggaucggaugggucaagacggugaccggcgccguuaacuuugggucuccgaauuuccggcaccgcgugagccuuacaagagaucgggaccuguuuaccgcgcauauggauauucgcggacucacacagggcgacaccgcuacauacuucugugccagacagaaauuugaacggggcgggcaaggaugguauuucgaucuguggggccgcgggacccuuaucgucguguccucu

SEQ ID NO: 41459 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucaccggcgcugugaacuuuggguccccgaauuucagacagcggguuucucuuacacgcgauagagaccugagcaccgcccacauggauauucggggacucacacaagacgauaccgccacauacuuuugugcucgccagaaauucgccagaggcgaccagggcugguuuuucgaucugugggggcggggaacccuuaucguggucuccucu

SEQ ID NO: 41460 - RNA, 375 nt, Artificial Sequence
  derived and/or modified sequence opt5 from anti-HIV-1_HeavyChain
caggugcaacugguccagagcggcgccgagguuaagagacccggggcuuccgugaaagugucuugcuggaccagcgaagacaucuucgagcggacagaacucauucacuggguccgccaggccccuggacagggccuggaguggaucgggugggugaagacgguuuccggagcggugaacuuuggcucuccgaauuucagacaucgggucagccuuacccgcgauagagaccuguuuacagcucacauggauauucgggggcucacccaaggagacacagccaccuacuucugugcccgccagaaauuugaaagaggcggccaggggugguauuucgaucuguggggacggggcacacuuaucgugguuuccucu

SEQ ID NO: 41461 - RNA, 375 nt, Artificial Sequence
  derived and/or modified sequence opt5 from anti-HIV-1_HeavyChain
agacacgaccuggagcagagcggcuccggggugaagaaacccggagccucuguccggguuagcugcuggaccuccgaagauaucuucgagcgcacagaacucauucauugggugagacaagcuccuggccaggggcuggaguggaucggaugggugaagauugucucuggcgccgugaacuuugggagcccgaauuuccggcagcgcguuucccuuacgagagaccgggaucuguuuaccgcgcacauggacauccgcggacucacacagggcgauaccgcuacauacuucugugccagacaaaaauuugaacggggcgggcagggauggauuuucgaccuguggggccgcgggacccuuaucgccgugucuagc

SEQ ID NO: 41462 - RNA, 375 nt, Artificial Sequence
  derived and/or modified sequence opt5 from anti-HIV-1_HeavyChain
agacacaccugggaacagguguggagcggcgucaagaaacccggggccuccguucgggugucuugcuggacaagcgaggacaucuucgagaaguccgaacugauucauugggugcgccaagcuccuggacagggccucgaguggaucgggugggucaaaacggugaccggagccguuaacuuuggcucuagcgauuucagacagcgggugucccugacacgcgacagagaucuuuuuaccgcgcacauggacauucgggggcugacacagggagauaccgcuacauacuucugugcccgccaaaaguuuuaugccggcggccaggggugguacuucgaccucuggggaagaggcacccugaucgucgugucuagc

SEQ ID NO: 41463 - RNA, 375 nt, Artificial Sequence
  derived and/or modified sequence opt5 from anti-HIV-1_HeavyChain
agacacaccuggaacaagagcggcuccggggugaaaaagcccggagccucuguccggguuagcugcuggacauccgaggacaucuucgaacgcacggagcugauucauugggugagacaggcuccuggccaagggcucgaauggaucggaugggugaaagccgucucuggcgcggugaauuacgggagccuggauuuucggcaccgcguuucccuuaccagagaccgggaucugucuacagcucauauggacauucgcggacucacccaggaugacacagccaccuauuucugugccagacagaaguuugcucggggcgaucagggcugguucuuugaccugugggggcgcggaacacuuaucguggucagcucc

SEQ ID NO: 41464 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagaagucugaacugauucauugggugcgccaagcuccuggccaggggcucgaguggaucggaugggugaaaacggucaccggcgccgugaacuuugggagcuccgauuucagacagcggguuucucugacacgcgacagagaucuuuuuaccgcgcacauggacauucggggacugacacagggcgauaccgcuacauacuucugugcccgccaaaaguuugaaagaggcgggcagggauggaucuucgaccucuggggccgggggacccugauugccgugagcucc

SEQ ID NO: 41465 - RNA, 375 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaagcggucucuggcgcugugaacuacgggagccuugauuuuagacaccggguuucccugacccgcgacagagaucucucuacagcccauauggacauucggggacugacccaggaugacacagccaccuauuucugugcucgccaaaaguuugccagaggcgaucagggcugguucuuugaccuuugggggcggggaacacugaucguggucagcucc

SEQ ID NO: 41466 - RNA, 375 nt, Artificial Sequence
  derived and/or modified sequence opt5 from anti-HIV-1_HeavyChain
agacacgaccuggagcagagcggcuccggggugaagaaacccggagccucuguccggguuagcugcuggaccuccgaagauaucuucgagcgcacagaacucauucauugggugagacaagcuccuggccaggggcuggaguggaucggaugggugaagacggucaccggcgccgugaacuuugggucuccgaauuuccggcaccgcguuagccuuacaagagaccgggaucuguuuaccgcgcauauggacauucgcggacucacacagggcgauaccgcuacauacuucugugccagacagaaauuugaacggggcgggcaaggaugguauuucgaccuguggggccgcgggacccuuaucguggucuccucu

SEQ ID NO: 41467 - RNA, 375 nt, Artificial Sequence
  derived and/or modified sequence opt5 from anti-HIV-1_HeavyChain
agacacaccugggagcagagcggcuccggggugaagaaacugggagccucuguccggguuagcugcuggacauccgaagacaucuucgagcgcacggaacucauucauugggugagacaagcucccggccaggggcuggaguggaucggaugggugaaggccgucucuggcgcggugaacuacgggagccuugauuuucggcaccgcguuucccugaccagagaccgggaucucucuacagcucauauggacauucgcggacugacccaggaugacacagccaccuauuucugugccagacagaaauuugcucggggcgaucaaggcugguucuuugaccuuugggggcgcggaacacugaucguggucagcucc

SEQ ID NO: 41468 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugccucgccuccgaagacaucuucgagaagucugaacugauucauugggugcggcaggcgccuggccaggggcuugaguggaucggaugggugaaaaccgucacaggcgcugugaacuuugggagcuccgauuuccgccagagaguuucucugacgcgggaccgcgaucucuuuaccgcccacauggacauuagaggacugacacaaggcgauaccgccacauacuucugugcucggcagaaguuuuaugccggcgggcagggaugguacuucgaccuuuggggccgcgggacccugaucguggucagcucc

SEQ ID NO: 41469 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagaaguccgaacucauucauugggugcggcaggcgccuggccaggggcuggaguggaucggaugggugaaaacagucacgggcgcugugaacuuugggucuagcgauuuccgccagagaguuucccuuacccgggaccgcgaucuguuuacagcccacauggacauuagaggacucacccaaggcgauacagccaccuacuucugugcucggcagaaguuuuaugccggcgggcagggaugguacuucgaccuguggggccgcgggacacuuaucguggucucuagc

SEQ ID NO: 41470 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagaagucugaacugauucauugggugcgccaagcuccuggccaggggcucgaguggaucggaugggugaaaacggucaccggcgccgugaacuuugggagcuccgauuucagacagcggguuucucugacacgcgacagagaucuuuuuaccgcgcacauggacauucggggacugacacagggcgauaccgcuacauacuucugugcccgccaaaaguuuuaugccggcgggcagggaugguacuucgaccucuggggcagagggacccugaucguggucagcucc

SEQ ID NO: 41471 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaacuuugggucuccgaauuuccggcaccgcguuagccugaccagagaucgggaccuuuuuacagcgcauauggauauucgcggacugacccacggcgacacagcuaccuacuucugugccagacagaaauuugaacggggcgggcagggaugguauuucgaucucuggggccgcgggacgcugaucguggucuccucu

SEQ ID NO: 41472 - RNA, 375 nt, Artificial Sequence
  derived and/or modified sequence opt5 from anti-HIV-1_HeavyChain
agacacaccugggagcagagcggcuccggggugaagaaacugggagccucuguccggguuagcugcuggacauccgaagacaucuucgagcgcacggaacucauucauugggugagacaagcucccggccaggggcuggaguggaucggaugggugaaggccgucucuggcgcggugaacuacgggagccuugauuuucggcaccgcguuucccugaccagagaccgggaucucuucacagcucauauggacauucgcggacugacccagggcgauacagccaccuauuuuugugccagacagaaauucuacgcuggcgggcaaggaugguauuuugaccuuuggggccgggggacacugaucguggucucuagc

SEQ ID NO: 41473 - RNA, 375 nt, Artificial Sequence
  derived and/or modified sequence opt5 from anti-HIV-1_HeavyChain
caggcccaccuggagcaaagcggcgcuggggugaagaaacucggagccuccgucagaguuucuugcuggaccagcgaagacaucuucgagcggacagaacugauucauugggugcgccaggcgcccggccaggggcuugaguggaucggaugggugaaggcugucuccggcgccgugaacuacgggucucuggauuuuagacaccggguuagccucacgcgcgacagagaucuguucaccgcccauauggacauucggggacuuacacaggaugacaccgcuacauauuuuugugcccgccaaaaauucgcuagaggcgaucagggcugguuuuucgaccugugggggcggggaacccucaucguggucuccucu

SEQ ID NO: 41474 - RNA, 375 nt, Artificial Sequence
  derived and/or modified sequence opt5 from anti-HIV-1_HeavyChain
caggcccaccuggagcaaagcggcuccggggugaagaaacccggagcuucugucgaaguuagcugcuggaccuccgaggacaucuucgaaagaacagagcucauucauugggugcggcaggccccuggccaggggcuggaauggaucggaugggugaagacggucucuggcgcggugaacuuugggagcccgaauuuccgccacagaguuucccuuacccgggaucgcgaccuguuuacagcucauauggauauuagaggacucacccagggcgacacagccaccuacuucugugcccggcaaaaauuugcucgcggcgaucaggggugguucuuugaccuguggggaagaggcacacuuaucguggucucuagc

SEQ ID NO: 41475 - RNA, 372 nt, Artificial Sequence
  derived and/or modified sequence opt5 from anti-HIV-1_HeavyChain
caggcccaccuggagcaaagcggcgcuggggugaagaaacucggagccuccgucagaguuucuugcuggaccagcgaagacaucuucaagacagagcugauucauugggugcggcaggcgcccggccaggggcuugaauggaucggaugggugaaagcugucuccggcgccgugaacuacgggucucuggauuuucgccacagaguuagccucacgcgggaccgcgaucuguccaccgcccauauggacauuagaggacuuacacaggaugacaccgcuacauauuucugugcccggcaaaaguuugcucgcggcgaucagggcugguucuuugaccugugggggagaggaacccucaucguggucucuagc

SEQ ID NO: 41476 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaacuuugggucuccgaauuuccggcaccgcguuagccugaccagagaucgggaccuuuuuacagcgcauauggauauucgcggacugacccagggcgacacagcuaccuacuucugugccagacagaaauuuuaugccggcgggcaaggaugguacuucgaucucuggggccgggggacgcugaucguggucuccucu

SEQ ID NO: 41477 - RNA, 375 nt, Artificial Sequence
  derived and/or modified sequence opt5 from anti-HIV-1_HeavyChain
agacacaccugggagcggaucuggagcggcgugaagaaacccggggccuccguccgcguuucuugcuggacaagcgaagacauuuucgagagaacggaacugauccauugggugcggcaggcuccuggacaaggccucgaguggauugggugggugaagaucgucuccggagccgugaacuuuggcucuccgaauuuccgccagagaguuagccugacccgggaucgcgaccuuuuuacagcgcacauggauauuagagggcugacccagggagacacagcuaccuacuucugugcccggcagaaauuugaacgcggcggccaaggguggaucuucgaucucuggggaagaggcacacugaucgccguguccucu

SEQ ID NO: 41478 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggcgccuuacacaggaugacaccgccacauauuucugugcuagacaaaaauuugcccggggagaucagggcugguucuuugaccuguggggccgcgggacccucaucguggucagcucc

SEQ ID NO: 41479 - RNA, 375 nt, Artificial Sequence
  derived and/or modified sequence opt5 from anti-HIV-1_HeavyChain
agacacaccguggagcagagcggcuccggggucaagaaacccggagccucuguucgggugagcugcuggacauccgaagacaucuucgagcgcacggaacugauucauugggugagacaagcuccuggccaggggcucgaguggaucggaugggucaagaccgugacaggcgccguuaacuuugggucuccgaauuuccggcaccgcgugagccugaccagagaucgggaccuuuuuacagcgcauauggauauucgcggacugacccagggcgacacagcuaccuacuucugugccagacagaaauuugaacggggcgggcaaggaugguauuucgaucucuggggccgcgggacgcugaucgucguguccucu

SEQ ID NO: 41480 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuaccccggaccgggaucuguuuacagcucacauggacauucgcggacucacccaaggcgauacagccaccuacuucugugccagacagaaguuuuaugcuggcgggcagggaugguacuucgaccuguggggccgggggacacuuaucguggucagcucc

SEQ ID NO: 41481 - RNA, 375 nt, Artificial Sequence
  derived and/or modified sequence opt5 from anti-HIV-1_HeavyChain
agacacaccguggagcagagcggcuccggggucaagaaaguuggagccucugugcgggugagcugcuggacauccgaagacaucuucgagcgcacggaacugauucauugggucagacaagcucccggccaggggcucgaguggaucggaugggugaaggccguuucuggcgcggugaacuacgggagccuggauuuucggcaccgcgucucccuuaccagagaccgggaucuguucacagcucauauggacauucgcggacucacccaggaugacacagccaucuauuuuugugccagacagaaauucgcucggggcgaucaaggcugguuuuucgaccugugggggcgcggaacccuuauugugguuucuagc

SEQ ID NO: 41482 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugggccuccgaagacaucuucgagcggaccgaacucauucauugggugcgccaggcgccuggccaggggcuggaguggaucggaugggugaagacagucucuggcgcugugaacuuugggagcccgaauuucagacaccggguuucccuuacgcgcgauagagaccuguuuaccgcccauauggauauucggggacucacacagggcgacaccgccacauacuucugugcucgccaaaaauuugaaagaggcgggcagggaugguauuucgaucuguggggccgggggacccuuaucguggucucuagc

SEQ ID NO: 41483 - RNA, 375 nt, Artificial Sequence
  derived and/or modified sequence opt5 from anti-HIV-1_HeavyChain
agacacaccugggaacagguguggagcggcgucaagaaacccggggccuccguucgggugucuugcuggacaagcgaggacaucuucgagcgcacggaacugauucauugggugagacaagcuccuggacagggccucgaguggaucgggugggucaagaccgugacaggagccguuaacuuuggcuccccgaauuuccggcaccgcgugucucugaccagagaucgggaccuuuuuacagcgcauauggauauucgcgggcugacccagggagacacagcuaccuacuucugugccagacagaaauuugaacggggcggccaagggugguauuucgaucucuggggacgcggcacgcugaucgucgugagcucc

SEQ ID NO: 41484 - RNA, 375 nt, Artificial Sequence
  derived and/or modified sequence opt5 from anti-HIV-1_HeavyChain
agacacaccuggcggcagagcggcuccggggugaagaaacugggagccucuguccgcguuagcugcuggacauccgaggacaucuucgaaagaacggagcucauucauugggugcggcaagcucccggccaggggcuggaauggaucggaugggugaaggccgucucuggcgugguuaacuacgggagccuugauuuucgccacagagugucccugacccgggaccgcgaucucucuacagcgcauauggacauuagaggacugacccaggaugacacagcuaccuauuucugugcccggcagaaauuugcccgcggcgaucaaggcugguucuuugaccuuugggggagaggaacacugaucgucgugagcucc

SEQ ID NO: 41485 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccggcgacaucuucgaacggacagagcucauucauugggugcgccaggccccugggcagggacuggaauggaucggcugggugaagauugucucuggggcggugaacuuuggaagcccgaauuucagacagcggguuucccuuacgcgcgauagagaccuguuuaccgcucacauggauauccggggccucacacaaggcgacaccgccacauacuucugugcccgccagaaauuugagagagggggacagggcuggauuuucgaucugugggggcggggaacccuuaucgcugugucuagc

SEQ ID NO: 41486 - RNA, 375 nt, Artificial Sequence
  derived and/or modified sequence opt5 from anti-HIV-1_HeavyChain
agacacaccguggagcagagcggcuccggggucaagaaacccggagccucuguucgggugagcugcuggacauccgaagacaucuucgagaagucugaacugauucauugggugcgccaagcuccuggccaggggcucgaguggaucggaugggucaaaacggugaccggcgccguuaacuuugggagcuccgauuucagacagcgggugucucugacacgcgacagagaucuuuuuaccgcgcacauggacauucggggacugacacagggcgauaccgcuacauacuucugugcccgccaaaaguuuuaugccggcgggcagggaugguacuucgaccucuggggcagagggacccugaucgucgugagcucc

SEQ ID NO: 41487 - RNA, 375 nt, Artificial Sequence
  derived and/or modified sequence opt5 from anti-HIV-1_HeavyChain
caggcccaccuggagcaaagcggcuccggggugaagaaaagaugggcuucuguccggguuagcugcuggaccuccgaagacaucuucgagcgcacagaacucauucauugggugagacaggcccccggacagggccuggaguggaucgggugggugaaggcggucucuggagcugugaacuacggcagccuugauuuucggcaccgcguuucccugacgagagaccgggaucucuucaccgcccauauggacauucgcgggcugacacaggaugacaccgccacauauuuuugugcuagacaaaaauucgcccggggagaucagggcugguuuuucgaccuuuggggccgcgggacccugaucguggucucuagc

SEQ ID NO: 41488 - RNA, 375 nt, Artificial Sequence
  derived and/or modified sequence opt5 from anti-HIV-1_HeavyChain
agacacaccguggagcagagcggcuccggggucaagcggcccggagccucuguucgcgugagcugcuggacauccgaagacaucuucgagacgaccgaacugauucauugggugagacaagcuccuggccaggggcucgaguggaucggaugggucaaaacagugaccggcgccguuaacuuugggucuagcgauuuccggcagcgcgugucccugacaagagaccgggaucuuuuuaccgcgcacauggacauucgcggacugacacagggcgauaccgcuacguacuucugugccagacaaaaguuuuaugccggcgggcagggaugguacuucgaccucuggggccgggggacccugaucgucgugucuagc

SEQ ID NO: 41489 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagaggacuguucaccgcccauauggauauucggggccuuacacaggacgauaccgccacauauuuuugugcucgccaaaaauucgccagaggcgaccaggggugguuuuucgaucuguggggacggggcacccucaucguggucucuagc

SEQ ID NO: 41490 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagaagucugaacucauucauugggugcggcaggcuccuggccaggggcuggaguggaucggaugggucaaaacagugacgggcgccgcgaacuuugggagcuccgauuuccgccagagaguuucucuuaccccggaccgggaucuguuuacagcucacauggacauucgcggacucacccaaggcgauacagccaccuacuucugugccagacagaaguuuuauaaaggcgggcagggaugguacuucgaccuguggggccgggggacacuuaucguggucagcucc

SEQ ID NO: 41491 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgauacaacggagcucauucauugggugcggcaggcgccuggccaggggcuggaauggaucggaugggugaagauugucuccggcgcugugaacuuugggucuccgaauuuccgccagagaguuagccuuacccgggaccgcgaucuguuuacagcccacauggacaucagaggacucacccaaggcgauacagccaccuacuucugugcucggcagaaauuugagcgcggcgggcagggauggauuuucgaccuguggggcagagggacacuuaucgccguguccucu

SEQ ID NO: 41492 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccucccgggacaucuucgaacgcacagagcugauucauugggugagacaggcccccggccaggggcuugaauggaucggaugggugaaggcggucucuggcgcugugaacuacgggagccuggauuuucggcaccgcguuucccucacgagagaccgggaucugucuaccgcccauauggacauucgcggacuuacacaggaugacaccgccacauauuucugugcuagacaaaaauuugcccggggcgaucagggcugguucuuugaccugugggggcgcggaacccucaucguggucagcucc

SEQ ID NO: 41493 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugccuggccuccgaagacaucuucgagcggaccgaacuuauucauugggugcgccaggcgcccggccaggggcuggaguggaucggaugggugaaggcugucucuggcgccgugaacuacgggagccucgauuuuagacaccggguuucccugacacgcgacagagaucuuucuacggcccauauggacauucggggacugacccaggaugacacagcuaccuauuucugugcccgccaaaaauuugcuagaggcgaucagggcugguucuuugaccucugggggcggggaacacugaucguggucagcucc

SEQ ID NO: 41494 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggccuuccgaagacaucuucgagcggaccgaacucauucauugggugcgccaggccccgggccaggggcuggaguggaucggaugggugaagacagucacgggcaccgugaacuuugggucucuuaauuucagacagcggguuagccugacacgcgauagagaccucuuuaccgcgcacauggauauucggggacugacacaaggcgacaccgcuacauacuucugugcccgccagaaauuugaaagaggcgggcagggaugguauuucgaucuuuggggccgggggacccugaucguggucuccucu

SEQ ID NO: 41495 - RNA, 375 nt, Artificial Sequence
  derived and/or modified sequence opt5 from anti-HIV-1_HeavyChain
agagcccaccuggagcagagcggcuccgaauggaagaaacucggggcuucugugcgggucagcugcuggaccuccggagacaucuucgagcgcacagaacugauucauuggguuagacaagcccccggccaggggcuugaguggaucggaugggugaaggcggugucuggcgcugucaacuacgggagccuggauuuucggcaccgcgugucccucacgagagaccgggaucuguucaccgcccauauggacauucgcggacuuacacaggaugacaccgccacauauuuuugugcuagacagaaauucgcccggggcgaucaaggcugguuuuucgaccugugggggcgcggaacccucaucguugugucuagc

SEQ ID NO: 41496 - RNA, 375 nt, Artificial Sequence
  derived and/or modified sequence opt5 from anti-HIV-1_HeavyChain
agacacaccguggagcagagcggcuccggggucaagaaacugggagccucuguuaacgugagcugcuggacauccgaagacaucuucgagcggacggaacucauucauugggugcgccaagcucccggccaggggcuggaguggaucggaugggucaaggccgugucuggcgcgguuaauuacgggagccuugauuuuagacaccgggugucccugacccgcgacagagaucucuucacagcucauauggacauucggggacugacccaggaugacacagccaccuauuuuugugcccgccagaaauucgcuagaggcgaucaaggcugguuuuucgaccuuugggggcggggaacacugaucgucgugucuagc

SEQ ID NO: 41497 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaccggucacaggcgcggugaacuuugggagcuccgauuuccgccagagaguuucucuuacgcgggaccgcgaucuguuuaccgcucacauggacauuagaggacucacacaaggcgauaccgccacauacuucugugcccggcagaaguuuuaugcuggcgggcagggaugguacuucgaccuguggggccgcgggacccuuaucguggucagcucc

SEQ ID NO: 41498 - RNA, 375 nt, Artificial Sequence
  derived and/or modified sequence opt5 from anti-HIV-1_HeavyChain
agacacaccuggaacaagagcggcuccggggugaaaaagcccggagccucuguccggguuagcugcuggacauccgaggacaucuucgaacgcacggagcugauucauugggugagacaggcuccuggccaagggcucgaauggaucggaugggugaaaaccgucacaggcgccgugaauuuugggucuccgaacuuccggcaccgcguuagccugaccagagaucgggaccuuuuuacagcgcauauggauauucgcggacugacccagggcgacacagcuaccuacuucugugccagacagaaguuugagcggggcgggcagggaugguauuucgaucucuggggccgcgggacgcugaucguggucuccucu

SEQ ID NO: 41499 - RNA, 375 nt, Artificial Sequence
  derived and/or modified sequence opt5 from anti-HIV-1_HeavyChain
caggcccacagcgagcaauccggcucuggggugaagaaacccggagcuagcgucagaguuuccugcuggaccucugaagacaucuucgagcggacagaacugauucauugggugcgccaggccccuggccaggggcucgaguggaucggaugggugaagauugucagcggcgcggugaacuuuggguccccgaauuucagacagcggguuucucugacgcgcgauagagaccuuuuuaccgcucacauggauauccggggacugacacaaggcgacaccgccacauacuucugugcccgccagaaauuugaaagaggcgggcagggauggauuuucgaucucuggggccgggggacccugaucgcugugagcucc

SEQ ID NO: 41500 - RNA, 375 nt, Artificial Sequence
  derived and/or modified sequence opt5 from anti-HIV-1_HeavyChain
caggcccaccuggagcaaagcggcgcuggggugaagagacccggagccuccguccggguuucuugcuggaccagcgaagacaucuucgagacaacggaacucauucauugggugcgccaggcgccuggccaggggcuggaguggaucggaugggugaaaaccgucacaggcgcugugaacuuuggguccccgaauuucagacaccggguuucucuuacccgcgauagagaccuguuuacagcccauauggauauucggggacucacccagggcgacacagccaccuacuucugugcucgccaaaaguuugaaagaggcgggcagggaugguauuucgaucuguggggccgggggacgcuuaucguggucagcucc

SEQ ID NO: 41501 - RNA, 375 nt, Artificial Sequence
  derived and/or modified sequence opt5 from anti-HIV-1_HeavyChain
ggccacaccugggagcagagcggggccggagugaagaaacugggcgcuuccgucagaguuucuugcuggacaagcgaagacaucuucgagcggacggaacucauucauugggugcgccaagcccccgggcagggacuggaguggaucggcugggugaaggcggucuccggggcugugaacuacggaucucuugauuuuagacaccggguuagccugacccgcgacagagaucucuucacagcccauauggacauucggggccugacccaggaugacacagccaucuauuuuugugcucgccagaaauucgccagaggcgaucaagggugguuuuucgaccuuuggggacggggcacccugauuguggucuccucu

SEQ ID NO: 41502 - RNA, 375 nt, Artificial Sequence
  derived and/or modified sequence opt5 from anti-HIV-1_HeavyChain
ggcacccccgggagcgaguccggaucuggcgugaagaaacugggggccagcgucagaguuuccugcuggacaucugaagacaucuucgagcggacggaacucauucacugggugcgccaggcuccuggacaaggccuggaguggaucgggugggugaaggccgucagcggagcggugaacuacggcucccuugauuuuagacaucggguuucucugacccgcgacagagaucucagcacagcucacauggacauucggggccugacccaggaugacacagccaccuauuucugugcccgccagaaauuugcuagaggggaucagggaugguucuuugaccuuuggggccgggggacacugaucguggucuccagc

SEQ ID NO: 41503 - RNA, 375 nt, Artificial Sequence
  derived and/or modified sequence opt5 from anti-HIV-1_HeavyChain
ggcacccccgggagcgaguccggaucuggcgugaagaugccuggggccagcgucagaguuuccugcuggacaucugaagacaucuucgagcggacggaacugauucacugggugcgccaggcuccgggacaaggccucgaguggaucgggugggugaaaaccgucagcggagccgugaacuuuggcucccccaauuucagacaucggguuucucugacacgcgauagagaccuuuuuaccgcgcacauggauauucggggccugacacagggggacaccgcuacauacuucugugcccgccagaaguuugaaagaggaggccaggggugguauuucgaucucuggggacggggcacccugaucguggucagcucc

SEQ ID NO: 41504 - RNA, 375 nt, Artificial Sequence
  derived and/or modified sequence opt5 from anti-HIV-1_HeavyChain
agacacaccugggagcagagcggcgccggggugaagaaacccggagcuuccguccggguuucuugcuggacaagcgaagacaucuucgagcgcacggaacugauucauugggugagacaagccccuggccaggggcucgaguggaucggaugggugaagaccgucuccggcgcggugaacuuugggucuccgaauuuccggcaccgcguuagccugacaagagaucgggaccuuuuuaccgcucauauggauauucgcggacugacacagggcgacaccgccacauacuucugugccagacagaaauuugaacggggcgggcaaggaugguauuucgaucucuggggccgcgggacccugaucguggucuccucu

SEQ ID NO: 41505 - RNA, 375 nt, Artificial Sequence
  derived and/or modified sequence opt5 from anti-HIV-1_HeavyChain
ggcacccccgggaacaagagcggauccggcgugaaaaagccuggggccucugucagaguuagcugcuggacauccgaggacaucuucgaaaaaucugagcugauucacugggugcggcaggcuccgggacaaggccucgaauggaucgggugggugaagacggucaccggagccgugaauuuuggcagcuccgauuuccgccagagaguuucucugacacgggaccgcgaucuuuuuaccgcgcauauggacauuagaggccugacacagggggauaccgcuacauacuucugugcccggcagaaauuuuaugccggaggccaagggugguacuucgaccucuggggacgcggcacccugaucguggucagcucc

SEQ ID NO: 41506 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggagcuccgaagacaucuucgagcggaccgaacucauucauugggugcgccaggcgccuggccaggggcuggaguggaucggaugggugaagacagucacgggcgcugugaacuuugggucuccgaauuucagacaccggguuagccuuacccgcgauagagaccuguuuacagcccauauggauauucggggacucacccagggcgacacagccaccuacuucugugcucgccaaaaauuugaaagaggcgggcagggaugguauuucgaucuguggggccgggggacacuuaucguggucuccucu

SEQ ID NO: 41507 - RNA, 375 nt, Artificial Sequence
  derived and/or modified sequence opt5 from anti-HIV-1_HeavyChain
ggcacccccgggaacaagagcggauccggcgugaaaaagccuggggccucugucagaguuagcugcuggacauccgaggacaucuucgaacggacggagcugauucacugggugcgccaggcuccgggacaaggccucgaauggaucgggugggugaaaaccgucacaggagccgugaauuuuggcucucccaacuucagacaucggguuagccugacccgcgauagagaccuuuuuacagcgcacauggauauucggggccugacccagggggacacagcuaccuacuucugugcccgccagaaguuugagagaggaggccagggguggaucuucgaucucuggggacggggcacgcugauugccguguccucu

SEQ ID NO: 41508 - RNA, 375 nt, Artificial Sequence
  derived and/or modified sequence opt5 from anti-HIV-1_HeavyChain
ggcacccccgggaacaagagcggauccggcgugaaaaagccuggggccucugucagaguuagcugcugguccucugaggacaucuucgaacggacagagcugauucacugggugcgccaggcuccgggacaaggccucgaauggaucgggugggugaaaacggucaccggagccgugaauuuuggcagccuggauuucagacaucggauuucccuuacacgcgacagagaucuguuuaccgcgcacauggacauccggggccucacacagggggauaccgcuacauacuucugugcccgccagaaguuugagagaggaggccagggguggauuuucgaccuguggggacggggcacccuuaucgccguuucuagc

SEQ ID NO: 41509 - RNA, 375 nt, Artificial Sequence
  derived and/or modified sequence opt5 from anti-HIV-1_HeavyChain
caggcccaccuggagcaaagcgcuuccggcgugaagagacccgggggauggguccggguuucuugcuggaccagcgaagacaucuucgagcgcuccgaacucauuuacugggugagacaggccccuggccaggggcuggaguggaucggaugggugaaaacagucacgggcgcggugaacuuugggucuccgaauuuccggcaucgcguuagccuuaccagagaucgggaccuguuuacagcucacauggauauucgcggacucacccagggcgacacagccaccuauuucugugccagacaaaaguuugaacggggcgggcagggaugguacuucgaucuguggggccgcgggacacuuaucguggucuccucu

SEQ ID NO: 41510 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacgucuagcggcgcggucaacuuuggguccccgaauuucagaacccgggugucucuuacacgcgauagagaccuguuuaccgcucacauggauauucggggacucacacagggcgacaccgccacauacuucugugcccgccaaaaauuugaaagaggcgggcagggaugguauuucgaucuguggggccgggggacccuuaucguugugagcucc

SEQ ID NO: 41511 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucuccggcgcugugaacuuugggucuccgaauuucagacaccggguuagccuuacccgcgauagagaccuguuuacagcccauauggauauucggggacucacccagggcgacacagccaccuacuucugugcucgccaaaaauuugaaagaggcgggcagggaugguauuucgaucuguggggccgggggacacuuaucguggucuccucu

SEQ ID NO: 41512 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaacuuugggucuccgaauuuccggcaccgcguuagccugaccagagaucgggaccuuuuuacagcgcauauggauauucgcggacugacccagggcgacacagcuaccuacuucugugccagacagaaauuugaacggggcgggcaaggaugguauuucgaucucuggggccgcgggacgcugaucguggucuccucu

SEQ ID NO: 41513 - RNA, 375 nt, Artificial Sequence
  derived and/or modified sequence opt5 from anti-HIV-1_HeavyChain
ggcaccacauggaacaagagcggguccggagugaaaaagcccggcgccucugucagaguuagcugcuggacguccgaggacaucuucgaacggaccgagcugauucacugggugcgccaggcuccugggcaaggacucgaauggaucggcugggugaaaacagucaccggggccgugaauuuuggaucuccgaacuucagacaucggguuagccugacacgcgauagagaccuuuuuaccgcgcacauggauauucggggccugacacagggcgacaccgcuacguacuucugugcccgccagaaguuugagagagggggacagggcugguauuucgaucucugggggcggggaacccugaucguggucuccucu

SEQ ID NO: 41514 - RNA, 375 nt, Artificial Sequence
  derived and/or modified sequence opt5 from anti-HIV-1_HeavyChain
agacacaccuggaacgagagcggcuccggggugaagaaacccggagccucuguccggguuagcugcuggacauccgaagacaucuucgagaagucugaacugauucauugggugcgccaggcuccuggccaagggcucgaguggaucggaugggugaaaacggucaccggcgccgugaauuuugggagcuccgauuucagacagcggguuucucugacacgcgacagagaucuuuuuaccgcgcacauggacauucggggacugacacagggcgauaccgcuacauacuucugugcccgccagaaguuuuaugccggcgggcaaggaugguacuucgaccucuggggcagagggacccugaucguggucagcucc

SEQ ID NO: 41515 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccggcaacaucuucgaacggacagagcugauucauugggugcgccaggcccccgggcagggacuugaauggaucggcugggugaaggcggucucuggggcugugaauuacggaagccuggacuuuagacaccggguuucccucacgcgcgauagagaccugucuaccgcccauauggauauucggggccuuacacaggacgauaccgccacauauuucugugcucgccaaaaauuugccagaggcgaccaggggugguucuuugaucuguggggacggggcacccucaucguggucagcucc

SEQ ID NO: 41516 - RNA, 378 nt, Artificial Sequence
  derived and/or modified sequence opt5 from anti-HIV-1_HeavyChain
agaugcagcauggagcagcccggcugguccgaaaagccuggggccucugugacccugagcuguaaaacagcugacgaggaugucuucgacgccgcguacaugcacuggguucggcaagcuccgggacagacguuugaauggcucggcuggaugaagcccgugaccggggccguguccuaugcccgcaaauuccagggaagagucucuuuuuacaugacacgggagcugggcauggcuuauauggaucuucgcaaccugagauucgacgauaccgccguguacuuuugcgcucggaagacagccggggacguuagcggagauaaucgcggcuauuucuuugaccucuggggcagagggucccgggugaucgucucuagc

SEQ ID NO: 41517 - RNA, 375 nt, Artificial Sequence
  derived and/or modified sequence opt5 from anti-HIV-1_HeavyChain
agacacaccagcgagcaguccggcucuggggugaagaaacccggagccagcguccggguuuccugcuggacaucugaagacaucuucgagcgcagcgaacugauucauugggugagacaagcuccuggccaggggcucgaguggaucggaugggugaagacggucaccggcgccgugaacuuuggguccccgaauuuccggcaccgcguuucucugacaagagaucgggaccuuuuuaccgcgcauauggauauucgcggacugacacagggcgacaccgcuacauacuucugugccagacagaaauauuacgccggcgggcaaggaugguauuuugaucucuggggccgggggacccugaucguggucagcucc

SEQ ID NO: 41518 - RNA, 375 nt, Artificial Sequence
  derived and/or modified sequence opt5 from anti-HIV-1_HeavyChain
agacacaccguggagcagagcggcgccggggucaagaaacccggagcuuccguucgggugucuugcuggacaagcgaagacaucuucgagcgcacggaacugauucauugggugagacaagccccuggccaggggcucgaguggaucggaugggucaagaccguguccggcgcgguuaacuuugggucuccgaauuuccggcaccgcgugagccugacaagagaucgggaccuuuuuaccgcucauauggauauucgcggacugacacagggcgacaccgccacauacuucugugccagacagaaauuugaacggggcgggcaaggaugguauuucgaucucuggggccgcgggacccugaucgucguguccucu

SEQ ID NO: 41519 - RNA, 375 nt, Artificial Sequence
  derived and/or modified sequence opt5 from anti-HIV-1_HeavyChain
ggcacccccuggaacgagagcggguccggagugaagaaaccuggcgccucugucagaguuagcugcuggacauccgaagacaucuucgagaagucugaacugauucacugggugcggcaggcuccggggcaaggacucgaguggaucggcugggugaaaacggucaccggggccgugaauuuuggaagccccaacuuccgccauagaguuucccugacacgggaucgcgaccuuuuuaccgcgcacauggauauuagaggccugacacagggcgacaccgcuacauacuucugugcccggcagaaguuugaacgcgggggacagggcugguauuucgaucucugggggagaggaacccugaucguggucucuagc

SEQ ID NO: 41520 - RNA, 375 nt, Artificial Sequence
  derived and/or modified sequence opt5 from anti-HIV-1_HeavyChain
agacacgaccuggagcccagcggcuccggggugaagaaaccuggagccucuguccggguuagcugcuggaccuccgaagauaucuucgagcgcacagaacucauucauugggugagacaggcuccgggccaagggcuggaguggaucggaugggugaagacggucaccggcgccgugaacuuugggucucuugacuuccggcaccgcauuagccugacaagagaucgggaccucuuuaccgcgcauauggauauccgcggacugacacagggcgacaccgcuacauacuucugugccagacagaaauuugaaucccgguauaccggcgggcagggaugguacuucgaucuuuggggccgcgggacgcacauuguu

SEQ ID NO: 41521 - RNA, 375 nt, Artificial Sequence
  derived and/or modified sequence opt5 from anti-HIV-1_HeavyChain
agacacaccguggagcagagcggcuccggggucaagaaacugggagccucuguucgggugagcugccucgcuuccgaagacaucuucgagcgcacagaacugauucauugggugagacaagcccccggccaggggcuugaguggaucggaugggucaaggcggugucuggcgcuguuaacuacgggagccuggauuuucggcaccgcgugucccucacgagagaccgggaucugucuaccgcccauauggacauucgcggacuuacacaggaugacaccgccacauauuucugugcuagacagaaauuugcccggggcgaucaaggcugguucuuugaccugugggggcgcggaacccucaucgucgugagcucc

SEQ ID NO: 41522 - RNA, 375 nt, Artificial Sequence
  derived and/or modified sequence opt5 from anti-HIV-1_HeavyChain
caggcccaccuggagcaaagcggcuccgaaucuaagaaacccggggcuagcgugagagucuccugcuggaccucugaggacaucuucgaaaagagcgagcucauucauuggguucggcaggccccuggacagggccuggaauggaucgggugggugaaaacagugacgggagcggucaacuuuggcuccucugauuuccgccagagagugagccuuacccgggaccgcgaucuguuuacagcucacauggacauuagagggcucacccaaggagauacagccaccuacuucugugcccggcagaaguuuuaugcuggcggccaggggugguacuucgaccuguggggacgcggcacacuuaucguuguguccagc

SEQ ID NO: 41523 - RNA, 375 nt, Artificial Sequence
  derived and/or modified sequence opt5 from anti-HIV-1_HeavyChain
ggcacccccgggagcgaguccgccucuggagugagacggccuggcgcuagcguccgcguuuccugcuggacaucugaagacaucuucgagagaagcgaacugauuuacugggugcggcaggccccggggcgcggacucgaguggaucggcuggauuaagcugguguccggggcggucaacuuuggaucuguggauuucagagaccggguuagccuuacgcgcgauagagaccuguuuaccgcucacauggauauccggggccucacacaaggcgacaccgccacauauuucugugcccgccagaaauuugaaagagggggacagggcugguacuucgaucugugggggcggggaacccuuauuguggucuccagc

SEQ ID NO: 41524 - RNA, 375 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagaagucugaacucauucagugggugcggcaggcuccuggccaggggcuggaguggaucggaugggucaaaacagugacgggcgccguuaacuuugggagcuccgauuuccgccaaagagugucucuuacccgggaccgcgaucuguuuacagcgcauauggacauuagaggacucacccagggcgauacagcuaccuacuucugugcccggcagaaguuuuaugccggcgggcagggaugguacuucgaccuguggggccgcgggacacuuaucgucgugagcucc

SEQ ID NO: 41525 - RNA, 375 nt, Artificial Sequence
  derived and/or modified sequence opt5 from anti-HIV-1_HeavyChain
ggcacccccgggagcgaguccggaucuggcgugaagaaagucggggccagcguuagaguguccugcuggacaucugaagacaucuucgagcggacggaacugauucacugggugcgccaggcuccuggacaaggccucgaguggaucgggugggucaaggccgugagcggagcgguuaacuacggcucccuggauuuuagacaucgggugucucuuacccgcgacagagaucuguucacagcucggauggacauucgcggccucacccaggaugacacagccaucuauuuuugugccagacagaaauucgcucgcggggaucagggaugguuuuucgaccuguggggccgggggacccuuauugucgugagcucc

SEQ ID NO: 41526 - RNA, 375 nt, Artificial Sequence
  derived and/or modified sequence opt5 from anti-HIV-1_HeavyChain
ggcacccccgggagcgaguccggaucuggcgugaagagaccuggggccagcguccggguuuccugcuggacaucugaagacaucuucgagacgaccgaacugauucacugggugcgccaggcuccgggacaaggccucgaguggaucgggugggugaaaacagucagcggagccgugaacuuuggcucccugaauuucagacaucggguuucucuuacccgcgauagagaccugagcacagcgcacauggauauucggggccucacccaggacgauacagcuaccuacuuuugugcccgccagaaguucgccagaggggaccagggaugguuuuucgaucuguggggccgggggacgcuuaucguggucuccagc

SEQ ID NO: 41527 - RNA, 372 nt, Artificial Sequence
  derived and/or modified sequence opt5 from anti-HIV-1_HeavyChain
agagcccaccuggagcagagcggcgcuggggugaagaaacccggaggcuggguccggguuuccugcuggaccucugaagacaucuucaagacagagcucauucauugggugcgccaagccccugggcagggacuggaauggaucggcugggugaaaacggucaccggggcggugaacuuuggaagcccgaauuucagacaccggguuucccuuacacgcgauagagaccuguuuaccgcucauauggauauucggggccucacacagggcgacaccgccacauacuucugugcccgccagaaguuugagagagggggacaaggcugguauuucgaucugugggggcggggaacccuuaucguggucucuagc

SEQ ID NO: 41528 - RNA, 378 nt, Artificial Sequence
  derived and/or modified sequence opt5 from anti-HIV-1_HeavyChain
caggugcaacugaugcagagcggcgccgaggucaagagacccggggcuuccguuaaaaucucuugcaccgccagcggauucacacucacggaccacuacaugcauugggugcggcaggcgccuggccagaccuuugaauggcugggguggaugaagccggugacaggagcugucaacuaugcccgcaaauuccaaggcagaguguccuuuuaccggacccgcgagcuugggauugccuauauggaucugagaaaucuccgguucgacgauacagcuguuuacuuuugugcccgcaagaccgcuggagacgugucuggcgauaaaagaggcuucuuuuucgaccugugggggcggggaagccgcgucaucguguccucu

SEQ ID NO: 41529 - RNA, 378 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaacuucaccggcuauuaccuccacugggucagacaggcgccugggcagacauuugaauggcugggauggaugaagccggugacgggcgcuguuuccuaugcccggaaauuccaagggcgcgugucuuuuuacaugaccagagagcuuggaauggccuauauggaccugcggaaucuccgcuucgaugacacagcugucuacuuuugugccagaaagaccgcuggcgaugugagcggcgacaaccggggguauuucuuugaucuguggggacgcggcuccagaguuaucgugucuagc

SEQ ID NO: 41530 - RNA, 375 nt, Artificial Sequence
  derived and/or modified sequence opt5 from anti-HIV-1_HeavyChain
ggcacccccgggagcaaguccggaucuggcgugaaaaagccuggggccagcgucagaguuuccugcuggacaucugaggacaucuucgaacggacggagcugauucacugggugcgccaggcuccgggacaaggccucgaauggaucgggugggugaaaaccgucacaggagccgugaacuuuggcagccccaauuucagacaucggguuucccugacccgcgauagagaccuuuuuacagcgcacauggauauucggggccugacccagggggacacagcuaccuacuucugugcccgccagaaguuugagagaggaggccaggggugguauuucgaucucuggggacggggcacgcugaucguggucucuagc

SEQ ID NO: 41531 - RNA, 378 nt, Artificial Sequence
  derived and/or modified sequence opt5 from anti-HIV-1_HeavyChain
caggugcaacugguccagagcggcgccgagcucaagaaacccggggcuuccguuaaggugucuugcgaagccagcggauacuccuucaccgaccaccauauccacugggugagacaggcgccuggccaggggcuggaguggcuuggauggaugaacccgaauaacggcgauacagcuuaugcccaaacguuucuggggcgggucaccaugacacgcgacaccucuauuaauacagccuacauggaacucagcagacugaccuccgaugacacagcuguguauuucugugcccggaaaaccgcuggagauguuucuggcgacaagcgcggcuuuuucuuugaucuuugggggagaggaagccgggugaucgucuccagc

SEQ ID NO: 41532 - RNA, 378 nt, Artificial Sequence
  derived and/or modified sequence opt5 from anti-HIV-1_HeavyChain
cagguguacaugagcuccagaggcgggaugaagaaacccggagccucuaugaccgucagcugcaagacagcugacgaggauaucuucgacgccgcguauaugcacuggguucggcaagcuccuggccagacguuugaauggcugggguggaugaaaccggugaccggagccgugaacuacgcccgccaguuccagggcagagucuccuuuuaucggacacgcgagcucgggauugcuuacauggaucugagagaccuuaaguucgaugacaccgccguguauuuuugugcucggaaaacaaagggagauguuucuggcgacgaucgcggcuucuuuuucgaccugugggggagaggaacccgggugaucgucagcucc

SEQ ID NO: 41533 - RNA, 378 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacagcguauuacaugcacuggcucagacaggcuccuggccaggggcuggaauggaugggauggaucaacccgcauuccggcgggacgaauuuugcccaaaaguuccagggacgggucaccaugacacgcgacaccucuauuacaaccgccuauauggagcuuagcagacugcgguccgaugacacagcuaccuacuuuugugcccgccagaaauucgcuucuagauauagcggcgaucagggcuccuacuuugaccucugggggcggggaacgcugaucgugguuagcucu

SEQ ID NO: 41534 - RNA, 375 nt, Artificial Sequence
  derived and/or modified sequence opt5 from anti-HIV-1_HeavyChain
agagcccaccuggagcagagcggcgcuggggugaagaaacucggagccuccguccggguuucuugcuggaccagcgaagacaucuucgagcgcacagaacugauucauugggugagacaagcgcccggccaggggcuugaguggaucggaugggugaaggcugucuccggcgccgugaacuacgggucucuggauuuucggcaccgcguuagccucacgagagaccgggaucuguucaccgcccauauggacauucgcggacuuacacaggaugacaccgcuacauauuuuugugccagacagaaauucgcucggggcgaucaaggcugguuuuucgaccugugggggcgcggaacccucaucguggucuccucu

SEQ ID NO: 41535 - RNA, 378 nt, Artificial Sequence
  derived and/or modified sequence opt5 from anti-HIV-1_HeavyChain
caggugagacugguccaaagcggcgccgacguuaagcagcccggggcuuccgugaaagugucuugcaaggccagcggauacaccuucacagauuauuacaugcacuggguccggcaggcgccuggccagacguuugaguggcucggguggaugaaaccggugaccggagcuguuuccuaugcccgcaaguuccaaggcagagugucuuuuuacaugacacgggaacuggggauggccuauauggaccuucgcaaccugagauucgaugacaccgcugucuacuuuugugcccggaaaacagcuggagaugugagcggcgacaaucgcggcuauuucuuugaucucugggggagaggaucccggguuaucgugucuagc

SEQ ID NO: 41536 - RNA, 378 nt, Artificial Sequence
  derived and/or modified sequence opt5 from anti-HIV-1_HeavyChain
caggcccaccugggcaacaagagcggguccggagugaaaaagcccggcgcuucugucagaguuagcugcuggaccuccgaggacaucuucgaaaaaucugagcucauucauugggugcggcaagccccugggcagggacuggaauggaucggcugggugaagacagucacgggggcggugaauuuuggaagcuccgauuuccgccagagaguuucucuuacccgggaccgcgaucuguuuacagcucacauggacauuagaggccucacccagggcgauacagccaccuacuucugugcccggcaaaaauuuuaugcugggggacagggcugguacuucgaccugugggggcgcggaacacuuaucguggucagcucc

SEQ ID NO: 41537 - RNA, 381 nt, Artificial Sequence
  derived and/or modified sequence opt5 from anti-HIV-1_HeavyChain
cagguguacauggagcaaagcggcgggggagucaagaaacccggcgccuccguuacccugucuugcaagacagcugacgaagauguguucgacgccgcguauaugcacugggugagacaggcuccugggcagacguuugaguggcucggauggaugaaaccggucaccggcgccgugaacuacgcccggaaguuccaggggcgcguuagcuuuuauagaacacgggaacugggaaucgcuuacauggaucuucgcaaucugagauucgacgauaccgccguguauuuuuguacacggaaaaccgcuggcgacgucuccggcgauaagcgcggguucuuuuucgaccucuggggaagaggcucucgggugauuguuagcucc

SEQ ID NO: 41538 - RNA, 381 nt, Artificial Sequence
  derived and/or modified sequence opt5 from anti-HIV-1_HeavyChain
cagguguacgucgagcaacccggcgggggaguuaagaaaccuggcgccagcgugacccuguccugcaagacagcugacgaagauguguucgacgccacguauaugcacugggucagacaggcgccggggcagaccuuugaguggcucggauggaugaaacccgugacaggcgcuguuaacuacgcccggaaguuccaggggcgcgugucuuuuuauagaacccgggaacugggaaucgccuacauggaucuucgcaaucugagauucgacgauacagcugucuauuuuugugcccggaaaaccgcuggcgacgugagcggcgauaagcgcggguucuuuuucgaccucuggggaagaggcucccggguuauugugucuagc

SEQ ID NO: 41539 - RNA, 381 nt, Artificial Sequence
  derived and/or modified sequence opt5 from anti-HIV-1_HeavyChain
cagguguacauggagcaagccggcgucgaaguugagaagcccggggcuagcgugacccuguccugcaaaacagccgacgaagauguguucgacgcggcuuauaugcacugggucagacaggccccuggacagacguuugaguggcucggcuggaugaagccggugaccggggccguuucuuacgcucggaaauuccagggacgcgugagcuuuuauaugacaagagaacugggcauggccuacauggaucuucggaaccugcgcuucgacgauaccgcugucuauuuuugugccagaaagacagcgggggacguguccggagauaaucggggcuacuucuuugaccucuggggccgcgggucuagaguuaucgugagcucc

SEQ ID NO: 41540 - RNA, 381 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggauggcuuacauggaucuucggaaccugcgcuucgacgauaccgccguguauuuuugugcgagaaaaacagccggagacgucuccggcgauaaucggggcuacuucuuugaccucugggggcgcggaucuagagugaucguuagcucc

SEQ ID NO: 41541 - RNA, 381 nt, Artificial Sequence
  derived and/or modified sequence opt5 from anti-HIV-1_HeavyChain
caggugcacauggagcaagccggcgcuggggucaagaaacccggagccagcguuacccuguccugcaagacagcggacgaagauguguucgacgcugccuacaugcauugggugagacaggccccuggccagacguuugaguggcucggguggaugaaaccggucaccggagcugugaacuaugcccggaaguuccagggccgcguuucuuuuuacagaacacgggaacuggggaucgcuuauauggaucuucgcaaucugagauucgacgauaccgccguguacuuuugugcgcggaaaacagccggagacgucagcggcgauaagcgcggcuucuuuuucgaccucugggggagaggaucccgggugauuguuucuagc

SEQ ID NO: 41542 - RNA, 381 nt, Artificial Sequence
  derived and/or modified sequence opt5 from anti-HIV-1_HeavyChain
cagguguacauggagcaagccggcgcugaagucaagaaacccggggccagcguuacccuguccugcgagacagcggacgaagauguguucgacgcugccuauaugcacugggugagacaggccccuggacagacguuugaguggcucggcuggaugaagccggucaccggggcugugaacuacgcccggaaauuccagggacgcguuucuuuuuauagaacacgggaacugggcaucgcuuacauggaucuucgcaaucugagauucgacgauaccgccguguauuuuugugcgcggaagacagccggggacgucagcggagauaaacgcggcuucuuuuucgaccucuggggcagagggucccgggugauuguuucuagc

SEQ ID NO: 41543 - RNA, 381 nt, Artificial Sequence
  derived and/or modified sequence opt5 from anti-HIV-1_HeavyChain
cagguguacauggagcaacccggcgggggagucaagaaaccuggcgccagcguuacccuguccugcaagacagcugacgaagauguguucgacgccgcguauaugcacugggugagacaggcuccggggcagacguuugaguggcucggauggaugaaacccgucaccggcgccgugaacuacgcccggaaguuccaggggcgcguuucuuuuuauagaacacgggaacugggaaucgcuuacauggaucuucgcaaucugagauucgacgauaccgccguguauuuuugugcucggaaaacagccggcgacgucagcggcgauaagcgcggguucuuuuucgaccucuggggaagaggcucccgggugauuguuucuagc

SEQ ID NO: 41544 - RNA, 372 nt, Artificial Sequence
  derived and/or modified sequence opt5 from anti-HIV-1_HeavyChain
gccacccccuggaacaagagcggcuccggggugaaaaagccuggagcuucugucagaguuagcugcuggacauccgaggacaucuucgaacggacggagcugucucucgugcgccaggccccgggccaagggcuggaauggauuggauggaugaaaaccgugacaggcgcggucaauuuugggagccccaacuucagacacggagugucccuuacccgggaucgcgaccuguuuacagcucauauggauaucagaggccucacccagggcgacacagccaccuacuucugugcccggcagaaguuugagcgcgggggacagggcugguauuucgaucugugggggagaggaacgcuuauuguugugucuagc

SEQ ID NO: 41545 - RNA, 381 nt, Artificial Sequence
  derived and/or modified sequence opt5 from anti-HIV-1_HeavyChain
cagguguacauggagcaagccggcgcugggaugaagaaacccggagccagcaugaccgcguccugcaagacagcugacgaagauaucuucgacgccgccuauaugcacugggucagacaggcuccuggccagacguuugaguggcugggguggaugaaaccgguuaccggagccgugaacuacgcucggcaguuccaaggccgcgugucuuuuuauagaacacgggaacucgggauugccuacauggaucugcgcgaccuuaaguucgaugacaccgcggucuauuuuugugccagaaaaacaaagggagaugugagcggcgacgaucggggcuucuuuuucgaccugugggggcgcggaaccagaguuaucguguccucu

SEQ ID NO: 41546 - RNA, 378 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacaggcuauuacaugcacugggucagacaggcgccugggcagacguuugaauggcucggauggaugaagccggugaccggcgcuguuaacuaugcccggcaauuccaggggcgcguguccuuuuacagaacacgggagcugggaaucgccuauauggaccuucgcgaucugaaauucgacgauaccgcugucuacuuuugugccagaaagacaaaggcugacgugucuggcgaugaccggggcuucuuuuucgaucucugggggcgcggaaccagaguuauugugagcucc

SEQ ID NO: 41547 - RNA, 381 nt, Artificial Sequence
  derived and/or modified sequence opt5 from anti-HIV-1_HeavyChain
agaguguacauggagcaggccggcgcuggggucaagaaacccggagccagcguuacccuguccugcaagacagcggacgaagauguguucgacgcugccuauaugcacugggugcggcaagccccuggccagacguuugaguggcucggguggaugaaaccggucaccggagcugugucuuacgcccgcaaguuccagggcagaguuagcuuuacaaugacccgggaacuggggauggcuuauauggaucuucgcaaccugagauucgacgauacagccguguacuuuugugcgcggaaaaccgccggagacgucuccggcgauaaucgcggcuauuucuuugaccucugggggagaggaucucgggugaucguuagcucc

SEQ ID NO: 41548 - RNA, 381 nt, Artificial Sequence
  derived and/or modified sequence opt5 from anti-HIV-1_HeavyChain
cagguguacauggagcaaagcggcgggggagucaagaaacccggcccuuccguuacccugucuugcaagacagccgacgaagauguguucgacgcugccuauaugcacugggugagacaggcgccggggcagacguuugaguggcucggauggaugaaacccgucaccggcgcugugaacuacgcccggaaguuccaggggcgcguuagcuuuuauagaacacgggaacugggaaucgccuacauggaucuucgcaaucugagauucgacgauaccgcuguguauuuuugugcccggaaaacagcuggcgacgucuccggcgauaagcgcggguucuuuuucgaccucuggggaagaggcucucgggugauuguuagcucc

SEQ ID NO: 41549 - RNA, 378 nt, Artificial Sequence
  derived and/or modified sequence opt5 from anti-HIV-1_HeavyChain
caggugcaacugguccagagcggcgccgagguuaagaaaccgggggcuuccgugaaggugucuugcaaagccagcggauacaccuucacaggcuauuacauccacuggaugagacaggcgccugggcagggacucgaauggaugggcuggauuaaccccaauuccggggcugucucuuaugcccggaaguuucaaggacgcgugagcuuccugcaugaccagggcaucagaauggccuacauggaucuucggaaccugcgcuuugacgauacggcuguuuauuucugugccagaaaaaccgcuggcgacguguccggggauaaucggggauacuuuuucgaccucuggggccgcgggucuagagucauugugagcucc

SEQ ID NO: 41550 - RNA, 381 nt, Artificial Sequence
  derived and/or modified sequence opt5 from anti-HIV-1_HeavyChain
caggugcacauggagcaagccggcgucgaaguugagaagcccggggcuagcgugacccuguccugcaaaacagccgacgaagauguguucgacgcggcuuacaugcauugggucagacaggccccuggacagacguuugaguggcucggcuggaugaagccggugaccggggccguuaacuaugcucggaaauuccagggacgcgugucuuuuuacagaacacgggaacugggcaucgccuauauggaucuucgcaaucugagauucgacgauaccgcugucuacuuuugugcccggaagacagcgggggacgugagcggagauaaacgcggcuucuuuuucgaccucuggggcagagggucccggguuauugugucuagc

SEQ ID NO: 41551 - RNA, 381 nt, Artificial Sequence
  derived and/or modified sequence opt5 from anti-HIV-1_HeavyChain
cagguguacauggagcaagccggcgcuggggucaagaaacccggagccagcgcgacccuguccugcaagacagcugacgaagauguuuucgacgccgccuauaugcacugggugagacaggcuccuggccagacguuugaguggcucggguggaugaaaccggugaccggagccgucucuuacgcucggaaguuccagggccgcgugagcuuuuauaugacaagagaacuggggauggccuacauggaucuucggaaccugcgcuucgacgauaccgcgguuuauuuuugugccagaaaaacagcuggagacguguccggcgauaaucggggcuacuucuuugaccucugggggcgcggaucuagagucaucgugagcucc

SEQ ID NO: 41552 - RNA, 375 nt, Artificial Sequence
  derived and/or modified sequence opt5 from anti-HIV-1_HeavyChain
ggccacgaccuggagcagagcggguccggagugaagaaacccggcgccucugucagaguuagcugcuggaccuccgaagauaucuucgagaagucugaacucauucauugggugcggcaagcuccugggcagggacuggaguggaucggcugggugaaagccgucagcggggcggugaacuacggaucccuugacuuucgccacagaguuucucugacacgggaucgcgaccucuucacggcucauauggauauuagaggccugacccaggacgauacagccaucuauuuuugugcccggcagaaguucgcucgcggcgaccaagggugguuuuucgaucuuuggggaagaggcacccugauuguggucagcucc

SEQ ID NO: 41553 - RNA, 378 nt, Artificial Sequence
  derived and/or modified sequence opt5 from anti-HIV-1_HeavyChain
caggcccacagaggcaccaucugggggcuggaggugaagaaacccggaggcuggguccggguuagcugcuggacauccgaagacauuuucgagcgcacggaacucauccauugggugagacaagcuccugggcagggacuggaguggauuggcugggugaagaccgucacaggggccgugaacuuuggaucuccgaauuuccggcaccgcguuagccuuaccagagaucgggaccuguuuacagcgcauauggauauccgcggccucacccagggcgacacagcuaccuacuucugugccagacagaaauuugaacgcgggggacaaggcugguauuucgaucugugggggcggggaacgcuuauuguggucuccucu

SEQ ID NO: 41554 - RNA, 381 nt, Artificial Sequence
  derived and/or modified sequence opt5 from anti-HIV-1_HeavyChain
caggugcacauggagcaagccggcgcuggggucgaaaagcccggagccagcguuacccuguccugcaaaacagcggacgaggauguguucgacgcugccuacaugcauugggugagacaggccccuggccagacguuugaauggcucggguggaugaagccggucaccggagcugugucuuaugcccggaaauuccagggccgcguuagcuuuuacaugacaagagagcuggggauggcuuauauggaucuucggaaccugcgcuucgacgauaccgccguguacuuuugugcgagaaagacagccggagacgucuccggcgauaaucggggcuauuucuuugaccucugggggcgcggaucuagagugaucguuagcucc

SEQ ID NO: 41555 - RNA, 381 nt, Artificial Sequence
  derived and/or modified sequence opt5 from anti-HIV-1_HeavyChain
cagguguacauggagcaaagcggcgggggagucaagaaacccggcgccuccguuacccugucuugcaagacagcugacgaagauguguucgacgccgcguauaugcacugggugagacaggcuccugggcagacguuugaguggcucggauggaugaaaccggucaccggcgccgugagcuacgcccggaaguuccaggggcgcguuuccuuuuauaugacaagagaacugggaauggcuuacauggaucuucggaaccugcgcuucgacgauaccgccguguauuuuugugcuagaaaaacagccggcgacgucucuggcgauaaucggggguacuucuuugaccucuggggacgcggcagcagagugaucguuuccucu

SEQ ID NO: 41556 - RNA, 381 nt, Artificial Sequence
  derived and/or modified sequence opt5 from anti-HIV-1_HeavyChain
cagguguacauggagcaaagcggcgggggagucaagaaacccggcgccuccguuacccugucuugcaagacagcugacgaagauguguucgacgccgcguauaugcacugggugagacaggcuccugggcagacguuugaguggcucggauggaugaaaccggucaccggcgccgugaacuacgcccggaaguuccaggggcgcguuagcuuuuauagaacacgggaacugggaaucgcuuacauggaucuucgcaaucugagauucgacgauaccgccguguauuuuugugcucggaaaacagccggcgacgucuccggcgauaagcgcggguucuuuuucgaccucuggggaagaggcucucgggugauuguuagcucc

SEQ ID NO: 41557 - RNA, 381 nt, Artificial Sequence
  derived and/or modified sequence opt5 from anti-HIV-1_HeavyChain
gagguguacauggaacagagcggcgggggagucaagaaacccggcgccuccguuacccugucuugcaagacagcuagcgaggacguguucgaugccgcguauaugcacugggugagacaagcuccugggcagacguuugaauggcucggauggaugaaaccggucaccggcgccgugaacuacgcccggaaguuccaggggcgcguuuccuuuuauagaacacgggagcugggaaucgcuuacauggaccuucgcaaucugagauucgaugacaccgccguguauuuuugugcucggaaaacagccggcgaugucucuggcgacaagcgcggguucuuuuucgaucucuggggaagaggcagccgggugauuguuuccucu

SEQ ID NO: 41558 - RNA, 381 nt, Artificial Sequence
  derived and/or modified sequence opt5 from anti-HIV-1_HeavyChain
caggugcaacugguccagagcggcgccgagguuaagaaacccggggcuuccgugacccucucuugcaagacagccgacgaagauguguucgacgcggcuuacaugcacugggucagacaggccccuggacagacguuugaguggcugggcuggaugaaaccggugaccggggccguuagcuaugcucggaaguuccaaggacgcguguccuuuuacaugacaagagaacuuggcauggccuauauggaucugcggaaccuccgcuucgacgauaccgcugucuacuuuugugccagaaaaacagcgggggacgugucuggagauaaucggggcuauuucuuugaccuguggggccgcgggagcagaguuaucguguccucu

SEQ ID NO: 41559 - RNA, 381 nt, Artificial Sequence
  derived and/or modified sequence opt5 from anti-HIV-1_HeavyChain
cagguguucauggagcaaagcggcgggggaaugaagaaacccggcgccuccaugaccgucucuugcaagacagcugacgaagauguuuuugacgccgcguauaugcacugggugagacaggcuccugggcagacguucgaguggcugggauggaugaaaccggugaccggcgccgucagcuaugcccggaaguuucaggggcgcguguccuucuacaugacaagagaacucggaauggcuuauauggaucugcggaaccuucgcuuugacgauaccgccguuuacuucugugcuagaaaaacagccggcgacgugucuggcgauaaucggggguacuuuuucgaccuguggggacgcggcagcagagucaucguguccucu

SEQ ID NO: 41560 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcgcuuccaggggagagucucuuuuuaucggacacgcgaacucggaauugccuacauggaucugagagaccuuaaguucgaugacaccgcuguguauuuuugugcccggaaaacaaagggcgauguuagcggcgacgaucgcggguucuuuuucgaccuguggggaagaggcacccgggugaucgucuccucu

SEQ ID NO: 41561 - RNA, 381 nt, Artificial Sequence
  derived and/or modified sequence opt5 from anti-HIV-1_HeavyChain
cagguguacauggagcaagccggcgcuggggucaagaaacccggagccagcguuacccuguccugcaaggcggcugacgaagauguguucgacgccgccuauaugcacugggugagacaggcuccuggccagacauuugaguggcucggguggaugaaaccggucacgggagccgugucuuacgcucggaaguuccagggccgcguuagcuuuuauaugaccagagaacuggggauggccuacauggaucuucggaaccugcgcuucgacgauacagcgguguauuuuugugccagaaaaaccgcuggagacgucuccggcgauaaucggggcuacuucuuugaccucugggggcgcggaucuagagugaucguuagcucc

SEQ ID NO: 41562 - RNA, 381 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauaucuuugacgcugccuacaugcacuggguuagacaggccccuggccagacguucgaguggcugggguggaugaaaccggugaccggagcugugaacuaugcccggcaguuucaaggccgcgucucuuucuacagaacacgggaacucgggauugcuuauauggaucugcgcgaccuuaaguuugaugacaccgccguguacuucugugcgagaaaaacaaagggagauguuagcggcgacgaucggggcuuuuucuuugaccugugggggcgcggaaccagagugaucgucuccucu

SEQ ID NO: 41563 - RNA, 381 nt, Artificial Sequence
  derived and/or modified sequence opt5 from anti-HIV-1_HeavyChain
cagguguacauggagcaacccggcggggaagucaagaaaccuggagccagcguuacccuguccugcaagacagcugacgaggauguguucgacgccgcguauaugcacugggugagacaggcuccgggccagacguuugaauggcucggguggaugaaacccgucaccggagccgugaacuacgcccggaaguuccagggccgcguuucuuuuuauaugacaagagagcuggggauggcuuacauggaucuucggaaucugcgcuucgacgauaccgccguguauuuuugugcuagaaaaacagccggagacgucagcggcgauaaccggggcuacuucuuugaccucugggggcgcggauccagagugaucguuucuagc

SEQ ID NO: 41564 - RNA, 381 nt, Artificial Sequence
  derived and/or modified sequence opt5 from anti-HIV-1_HeavyChain
caggugcacauggagcaagccggcgcuggggucaagaaacccggagccagcguuacccuguccugcaagacagcggacgaagauguguucgacgcugccuacaugcauugggugagacaggccccuggccagacguuugaguggcucggguggaugaaaccggucaccggagcugugucuuaugcccggaaguuccagggccgcguuagcuuuuacaugacaagagaacuggggauggcuuauauggaucuucggaaccugcgcuucgacgauaccgccguguacuuuugugcgagaaaaacagccggagacgucuccggcgauaaucggggcuauuucuuugaccucugggggcgcggaucuagagugaucguuagcucc

SEQ ID NO: 41565 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcccccgggugauuguuuccucu

SEQ ID NO: 41566 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggacacaccuucacaaacuacgacaucaauugggucagacaggcgccuggccaggggcucgaauggauuggaugggugaagaucguuuccggcacggugaacuuugcuucucuggauuuccggaaucgcauuagccuuuccagagaccgggaucugucuaccgccuauauggacauccgcgggcucacacaagaugacaccgccacauacuuuugugcuagacagaaauucgccagccgguauuccggagaucagggcagcuacuuugaccuguggggccgcgggacccuuauugucgugucuucc

SEQ ID NO: 41567 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcaguuccaagggcgcgucucuuuuuauagaacacgggaacucggaauugccuacaccgaucugcgcgaccuuaaguucgaugacacagcuguguauuuuugugccagaaaaaccaagggcgauguuagcggcgacgaucggggguucuuuuucgaccuguggggacgcggcacaagagugaucgucuccucu

SEQ ID NO: 41568 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggcaguuccaagggcgcguuucuuuuuauagaacacgggaacugggaaucgccuacauggaucuucgcgaccugaaguucgaugacaccgcuguguauuuuugugccagaaaaacaaagggcgaugucagcggcgacgaucggggguucuuuuucgaccucuggggacgcggcaccagagugauuguuuccucu

SEQ ID NO: 41569 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggccgggauggaugaaacccgucaccggcgccgugaacuacgcucggaaguuccaggggcgcguuucuuuuuauagaacacgggaacucggaaucgccuacauggaucugcgcaaucuuagauucgacgauaccgcuguguauuuuugugcccggaaaacagcgggcgacgucagcggcgauaagcgcggguucuuuuucgaccuguggggaagaggcucccgggugauuguuucuagc

SEQ ID NO: 41570 - RNA, 381 nt, Artificial Sequence
  derived and/or modified sequence opt5 from anti-HIV-1_HeavyChain
cagguguacauggagcaagccggcgggggagucaagaaacccggcgcuagcgccacccuguccugcaagacagcggacgaagauguuuucgacgcugccuauaugcacugggugagacaggccccugggcagacguuugaguggcucggauggaugaaaccggugaccggcgcugucucuuacgcccggaaguuccaggggcgcgugagcuuuuauaugacaagagaacugggaauggcuuacauggaucuucggaaccugcgcuucgacgauaccgccguuuauuuuugugcgagaaaaacagccggcgacguguccggcgauaaucggggguacuucuuugaccucuggggacgcggcucuagagucaucgugagcucc

SEQ ID NO: 41571 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugagaugggugcggcaggccccugggcagacguuugaguggcucggauggaugaaaccggucaccggcgccgugaacuacgcucgcaaguuccaggggagaguuucuuuuuaucggacacgcgaacugggaaucgccuacauggaucuuagaaaucugcgguucgacgauaccgcuguguauuuuugugcccgcaaaacagcgggcgacgucagcggcgauaagagaggguucuuuuucgaccucuggggacggggcucccgcgugauuguuucuagc

SEQ ID NO: 41572 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcagagccagcggauacaccuucggcaaccacgcgaucuccuggguccggcaggcuccugggcagggacucgaauggaugggcuggauucgcccgaaaacaggggccagaaaucaagcccggcaguuucagccccgcaucucucugacgagagaccgggcucuuagcaccgccuaucuggaucucaacucccugacaucugcugacagcggaaccuacuucugugcccgccagacauuuaagccugauuucuauuuugcggaccaaggcugguccuucaaucuuuggggcagaggggcccauuuuauugugagcucu

SEQ ID NO: 41573 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacccggcucucgcgugaucguuagcucc

SEQ ID NO: 41574 - RNA, 381 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugaacuacgcccggaaguuccagggccgcguuucuuuuuauagaacacgggaacuggggaucgcuuacauggaucuucgcaaucugagauucgacgauaccgccguguauuuuugugcgcggaaaacagccggagacgucagcggcgauaagcgcggcuucuuuuucgaccucugggggagaggaucccgggugauuguuucuagc

SEQ ID NO: 41575 - RNA, 381 nt, Artificial Sequence
  derived and/or modified sequence opt5 from anti-HIV-1_HeavyChain
caggugcacauggagcaagccggcgggggagucaagaaacccggcgcuagcguuacccuguccugcaagacagccgacgaagauguguucgacgcggcuuacaugcauugggugagacaggccccugggcagacguuugaguggcucggauggaugaaaccggucaccggcgccgugaacuaugcucggaaguuccaggggcgcguuucuuuuuacagaacacgggaacugggaaucgccuauauggaucuucgcaaucugagauucgacgauaccgcuguguacuuuugugcccggaaaacagcgggcgacgucagcggcgauaagcgcggguucuuuuucgaccucuggggaagaggcucccgggugauuguuucuagc

SEQ ID NO: 41576 - RNA, 381 nt, Artificial Sequence
  derived and/or modified sequence opt5 from anti-HIV-1_HeavyChain
cagguguacauggagcaagccggcgacgggaugaagaaacccggagcuagcaugaccgucuccugcaagacagccgaugaagacaucuucgaugcggcuuauaugcacuggguuagacaggccccuggccagacguuugaguggcugggguggaugaaaccggugaccggagccgugaacuacgcucggcaguuccaaggccgcgucucuuuuuauagaacacgggaacucgggauugccuacauggaccugcgcgaucuuaaguucgacgauaccgcuguguauuuuugugccagaaaaacaaagggagacguuagcggcgaugaccggggcuucuuuuucgaucugugggggcgcggaaccagagugaucgucuccucu

SEQ ID NO: 41577 - RNA, 381 nt, Artificial Sequence
  derived and/or modified sequence opt5 from anti-HIV-1_HeavyChain
caggugcaacugguccagagcggcgccgagguuaagaaacccggggcuuccgugacccucucuugcaagacagccgacgaagauguguucgacgcggcuuacaugcacugggucagacaggcccagggacaaacguuugaguggcugggcuggaugaaaccugugaccggggccguuaacuaugcucggaaguuccagggacgcgugagcuuuuacagaacacgggaacuuggcaucgccuauauggaucugcgcaaucucagauucgacgauaccgcugucuacuuuugugcccggaaaacagcgggggacguguccggagauaagcgcggcuucuuuuucgaccuguggggcagagggucucggguuauugugagcucc

SEQ ID NO: 41578 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccaagugauuguuucuagc

SEQ ID NO: 41579 - RNA, 381 nt, Artificial Sequence
  derived and/or modified sequence opt5 from anti-HIV-1_HeavyChain
caggugcaacugguccagagcggcgccgagguuagaaagcccggggcuuccgugaaagugucuugcaaggccagcggauacaccuucacaaacuauuacaugcacuggguccggcaggcgccuggccaggggcucgaauggaucggaugggugaaaauuguuuccggcacggugaauuuugcuucucuggacuuccgcaacagaaucagccuuucccgggaucgcgaccugucuaccgccuauauggauauuagagggcucacacaagacgauaccgccacauacuuuugugcucggcagaaguucgccagccgcuauuccggagaccagggcagcuacuuugaucuguggggcagagggacccuuaucgucgugucuucc

SEQ ID NO: 41580 - RNA, 381 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuacgcgagaaaauuucaggggcggguuucuuucuaucgcaccagagaacuuggaauugcuuacauggaucugcggaaucuccgcuuugacgauacagccguguauuucugugccagaaagaccgcuggcgacgucagcggcgauaaacggggguuuuucuuugaccuguggggacgcggcuccagagugaucguuucuagc

SEQ ID NO: 41581 - RNA, 381 nt, Artificial Sequence
  derived and/or modified sequence opt5 from anti-HIV-1_HeavyChain
cugauccaccucgcccagagcggcgcugaggugaagaaacccggggccuccgucacccugucuugcaagacagcggacgaagauguuuucgacgcugccuacaugcauugggugagacaagccccuggacagacguuugaguggcuuggcuggaugaaaccggugaccggggcugucagcuaugcccggaaguuccagggacgcguguccuuuuacaugacaagagaacugggcauggcuuauauggaucuccggaaccugcgcuucgacgauaccgccguuuacuuuugugcgagaaaaacagccggggacgugucuggagauaaucggggcuauuucuuugaccuuuggggccgcgggagcagagucauuguguccucu

SEQ ID NO: 41582 - RNA, 381 nt, Artificial Sequence
  derived and/or modified sequence opt5 from anti-HIV-1_HeavyChain
caggugcaacugguccagagcggcgccgagguuaagaaacccggggcuuccaugaccgugucuugcaagacagccgacgaagauaucuucgacgcggcuuacaugcacugggugagacaggccccuggacagacguuugaguggcucggcuggaugaaaccggucaccggggccgugaacuaugcucggcaauuccagggacgcguuagcuuuuacagaacacgggaacugggcauugccuauauggaucuucgcgaccugaaguucgaugacaccgcuguguacuuuugugccagaaaaacaaagggggaugucuccggagacgaucggggcuucuuuuucgaccucuggggccgcgggaccagagugaucguuucuagc

SEQ ID NO: 41583 - RNA, 381 nt, Artificial Sequence
  derived and/or modified sequence opt5 from anti-HIV-1_HeavyChain
cagguguacauggagcaaggcagagggggagucaagaaacccggcgccagcguuacccuguccugcaagacagcugacgaagauguguucgacgccgcguauaugcacugggugcggcaggcuccugggcagacguuugaguggcucggauggaugaaaccggucaccggcgccgugaacuacgcccgcaaguuccaggggagaguuucuuuuuaucggacacgcgaacugggaaucgcuuacauggaucuuagaaaucugcgguucgacgauaccgccguguauuuuugugcucgcaaaacagccggcgacgucagcggcgauaagagaggguucuuuuucgaccucuggggacggggcucccgcgugauuguuucuagc

SEQ ID NO: 41584 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauguuuucgacgcggcuuauaugcacugggugagacaggccccugggcagacguuugaguggcugggauggaugaaaccggugaccggcgccgucaacuacgcucggcaguuccaagggcgcgugucuuuuuauagaacacgggaacucggaaucgccuacauggaucugcgcgaccuuaagagcgaugacaccgcuguuuauuucugugccagaaaaacagcgggcgauguguccggcgacaagcggggguuuuucuuugaucuguggggacgcggcucuagagucauugugagcucc

SEQ ID NO: 41585 - RNA, 381 nt, Artificial Sequence
  derived and/or modified sequence opt5 from anti-HIV-1_HeavyChain
caggugcaacugguccagagcggcgccgagguuaagaaacccggguccucuaucaaggugagcugcaaggcuuccggagacaccauuucuagauacgccaucaacugggugcggcaggcgccuggccaggggcucgaauggauuggaugggucaaaacagugacgggcgcuguuaauuucgggagccuggauuuucgccacagaaucucccuuacccgggaccgcgaucuguucacagcccauaugggaauuagaggccucacccaaggcgacacagccaccuauuuuugugcucggcagaaauucgagucucgcuacacagggggacagggcugguauuuugaucugugggggagaggaacccacaucguggucagcucc

SEQ ID NO: 41586 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauaucuucgacgcggcuuauaugcacugggugagacaggccccugggcagacguuugaguggcucggauggaugaaaccggugaccggcgccgucaacuacgcucggaaguuccaggggcgcgugucuuuuuauagaacacgggaacugggaauugccuacauggaucuucgcaaucugagauucgacgauaccgcuguuuauuuuugugcccggaaaacagcgggcgacgugagcggcgauaagcgcggguucuuuuucgaccucuggggaagaggcucccgggucaucgugucuagc

SEQ ID NO: 41587 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaauuuccaggggcgcguuucuuuuuauagaacacgggaacugggaaucgccuacauggaucuucgcaaccugagauucgacgauaccgcuguguauuuuugugcccggcaaaaguucgagagccgcuacuccggcgaccagggcucuuauuuugaucucugggggagaggaacacugauuaucgucagcucc

SEQ ID NO: 41588 - RNA, 381 nt, Artificial Sequence
  derived and/or modified sequence opt5 from anti-HIV-1_HeavyChain
cagguguacauggagcaagccggcgggggagucaagagacccggcgcuagcguuacccuguccugcaaaacagccgacgaagauguguucgacgcggcuuauaugcacugggugcggcaggccccugggcagacguuugaguggcucggauggaugaagccggucaccggcgccgugaacuacgcucgcaaauuccaggggagaguuucuuuuuaucggacacgcgaacugggaaucgccuacauggaucuuagaaaucugcgguucgacgauaccgcuguguauuuuugugcccgcaagacagcgggcgacgucagcggcgauaaaagaggguucuuuuucgaccucuggggacggggcucccgcgugauuguuucuagc

SEQ ID NO: 41589 - RNA, 381 nt, Artificial Sequence
  derived and/or modified sequence opt5 from anti-HIV-1_HeavyChain
caggugcaacugguccagagcggcgacgagguuaagaaacccggggccuccgugacccucucuugcaagacagcugaugaagacguguucgaugccgcguacaugcacugggucagacaggcuccuggacagacguuugaguggcugggcuggaugaaaccggugaccggggccguuaacuaugcccggaaguuccaaggacgcgugagcuuuuacagaacacgggaacuuggcaucgcuuauauggaccugcgcaaucucagauucgaugacaccgccgucuacuuuugugcucggaaaacagccggggauguguccggagacaagcgcggcuucuuuuucgaucuguggggcagagggucucggguuauugugagcucc

SEQ ID NO: 41590 - RNA, 381 nt, Artificial Sequence
  derived and/or modified sequence opt5 from anti-HIV-1_HeavyChain
caggugcaacugguccagagcggcgccgggguuaagaaacccggauccucugugaaggugagcugcaaggcuuccggcgggaccuucucuagcuacgccaucaacuggcucagacaggucccuggacagcggccggaguggaugggcuggauucgccccaaaacaggggcgagaaaucaagcucggcaguuucagccucgcaucucccugacgagagaccgggcccuuucuaccgccuaucuggaucucaacagccugacauccgcugacagcggaaccuacuucugugcccgccagacauuuaaacccgauuucuauuuugcugaccaaggcuggucuuucaaucuuuggggcagaggggcccacuuuauuguguccagc

SEQ ID NO: 41591 - RNA, 381 nt, Artificial Sequence
  derived and/or modified sequence opt5 from anti-HIV-1_HeavyChain
cagguguacauggagagagccggcgggggagucaagaaacccggcgcuagcguuacccuguccugcgaaacagccgacgaggauguguucgacgcggcuuauaugcacugggugcggcaagccccugggcagacguuugaauggcucggauggaugaagccggucaccggcgccgugaacuacgcucgcaaauuccaggggagaguuucuuuuuaucggacacgcgagcugggaaucgccuacauggaucuuagaaaucugcgguucgacgauaccgcuguguauuuuugugcccgcaagacagcgggcgacgucagcggcgauaaaagaggguucuuuuucgaccucuggggacggggcucccgcgugauuguuucuagc

SEQ ID NO: 41592 - RNA, 381 nt, Artificial Sequence
  derived and/or modified sequence opt5 from anti-HIV-1_HeavyChain
cagguguacauggagcaagccggcgcugggaugaagaaacccggagccagcaugaccgucuccugcaagacagcggacgaagauaucuucgacgcugccuauaugcacuggguuagacaggccccuggccagacguuugaguggcugggguggaugaaaccggugaccggagcugugaacuacgcccggcaguuccaaggccgcgucucuuuucuccaggaucaggggauuagaaucgcuuauauggaccugcgggaucuuaaguucgacgauacagccguguacuuuugugcgcgcaaaaccaagggagacguuagcggcgaugacagaggcuucuuuuucgaucugugggggcggggaacacgcgugauugucuccucu

SEQ ID NO: 41593 - RNA, 381 nt, Artificial Sequence
  derived and/or modified sequence opt5 from anti-HIV-1_HeavyChain
cagguguacaugggcgccgggagaggaggcgucaagaaacccggggcuagcguuacccuguccugcaagacagccgacgaggauguguucgacgcggcuuauaugcacugggugcggcaagccccuggacagacguuugaauggcucggcuggaugaaaccggucaccggggccgugaacuacgcucgcaaguuccagggaagaguuucuuuuuaucggacacgcgagcugggcaucgccuacauggaucuuagaaaucugcgguucgacgauaccgcuguguauuuuugugcccgcaaaacagcgggcgacgucagcggggauaagagaggauucuuuuucgaccucuggggccgggggucccgcgugauuguuucuagc

SEQ ID NO: 41594 - RNA, 381 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagccguuugaguggcucggguggaugaaacccgucacgggagcugugucuuacgcccggaaguuccagggccgcguuagcuuuuauaugaccagagaacuggggauggcuuacauggaucuucggaaccugcgcuucgacgauacagccguguauuuuugugcgagaaaaaccgccggagacgucuccggcgauaaucggggcuacuucuuugaccucugggggcgcggaucuagagugaucguuagcucc

SEQ ID NO: 41595 - RNA, 381 nt, Artificial Sequence
  derived and/or modified sequence opt5 from anti-HIV-1_HeavyChain
caggugcaacugguccagagcggcgccgagguuaagaaacccggggcuuccgugaagaucucuugcaaagccagcggauacaccuucauuagacacggcauccauuggcuccgccaggugccugggcagcggccggaauggaugggauggauuagacccaagacaggcgcgcggaaccaagcucgccaguuucagccuagaaucucccuggcccgggaccgcgcccuuucuacggcuuaucuggaucucaauagccugaccuccgccgacucugggacauacuucugugcuagacagaccuuuaaacccgauuucuauuuugccgaccaaggauggagcuucaaccuuuggggccggggcgcgcacuuuauugucuccagc

SEQ ID NO: 41596 - RNA, 381 nt, Artificial Sequence
  derived and/or modified sequence opt5 from anti-HIV-1_HeavyChain
caggugcugcucguccaaagcggcgccgagguuaagaaacccggguccucugugaaggugagcugcaaggcuuccggagacucucugaccaaauacgccuucagcugggucagacaggcgccuggccaggggccggaauggaugggauggauccggcccaaaacaggcgcucgcaacagagcccggcaguuucaaccucgcauuucccuuacgagagaucgggcccugucuaccgcuuaucucgaccugaauagccuuacauccgccgauagcgggaccuacuucugugcucgccagacauuuaagcccgacuucuauuuugccgaucagggauggucuuucaaccuguggggcagaggcgcgcacuuuaucguguccagc

SEQ ID NO: 41597 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggcccgggggcagacguuugaguggcucggauggaugaaaccugucaccggcgccgugaacuacgcucgcaaguuccaggggagaguuucuuuuuaucggacacgcgaacugggaaucgccuacauggaucuuagaaaucugcgguucgacgauaccgcuguguauuuuugugcccgcaaaacagcgggcgacgucagcggcgauaagagaggguucuuuuucgaccucuggggacggggcucccgcgugauuguuucuagc

SEQ ID NO: 41598 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaaccgcggguacuucuuugaccucuggggaagaggcucccgggugauuguuucuagc

SEQ ID NO: 41599 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggacccggcuccagagugauuguuucuagc

SEQ ID NO: 41600 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugagauggguucggcaggccccugggcagacguuugaguggcugggauggaugaaaccggugaccggcgccgugaacuacgcucgccaguuccaagggagagucucuuuuuaucggacacgcgaacucggaauugccuacauggaucugagagaccuuaaguucgaugacaccgcuguguauuuuugugcccggaaaacaaagggcgauguuagcggcgacgaucgcggguucuuuuucgaccuguggggaagaggcacccgggugaucgucuccucu

SEQ ID NO: 41601 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuaccuugaucugcggaaccuccgcuucgacgauaccgcuguguauuuuugugccagaaaaacagcgggcgacgucuccggcgauaaucggggguacuucuuugaccuguggggacgcggcucuagagugaucguuagcucc

SEQ ID NO: 41602 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacaggcuauuacaugcacugggucagacaggcgccugggcagggacucgaauggaucggcugggugaagacgguuaccggggcugugaacuuuggaucccuggacuuccggcaucgcauuucucuuacaagagaucgggaccuguuuaccgcccacauggauauccgcggccucacacaaggcgacaccgccacauauuucugugcuagacagaaauuugagagccgguacaccgggggacagggcugguauuucgaucugugggggcgcggaacgcauauugucguguccucu

SEQ ID NO: 41603 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaucaaaccggucaccggcgccgugaacuacgcucggaaguuccaggggcgcguuucuuuuuauagaacacgggaacugggaauugccuacauggaucuucgcaaucugagauucgacgauaccgcuguguauuuuugugcccggaaaacagcgggcgacgucagcggcgauaagcgcggguucuuuuucgaccucuggggaagaggcucccgggugaucguuucuagc

SEQ ID NO: 41604 - RNA, 381 nt, Artificial Sequence
  derived and/or modified sequence opt5 from anti-HIV-1_HeavyChain
cagguguacauggagcaagccggcgggggaaugaagaaacccggcgcuagcgucaccguuuccugcaagacagccgacgaagauaucuucgacgcggcuuauaugcacugggugagacaggccccugggcagacguuugaguggcugggauggaugaaaccggugaccggcgccgucaacuacgcucggcaguuccaagggcgcgugucuuuuuauagaacacgggaacucggaauugccuacauggaucugcgcgaccuuaaguucgaugacaccgcuguuuauuuuugugccagaaaaacaaagggcgaugugagcggcgacgaucggggguucuuuuucgaccuguggggacgcggcaccagagucaucguguccucu

SEQ ID NO: 41605 - RNA, 381 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucagcaaggccgagcucauucauugggugcggcaggcgccuggccaggggcuggaauggaucggaugggugaaaaccgucacaggcgcugugaacuucgggucccuugauuuucgccacagaauuucucugacgcgggaccgcgaucucuucaccgcccauauggacaucagaggacugacacagggcgauaccgccacauacuuuugugcucggcaaaaguucgagagccgcuauaccggcgggcagggaugguacuuugaccuuuggggcagagggacacacauuguuguguccagc

SEQ ID NO: 41606 - RNA, 381 nt, Artificial Sequence
  derived and/or modified sequence opt5 from anti-HIV-1_HeavyChain
cagguguacauggaggccggcagagggggagucaagaaacccggcgcuagcgccacccuguccugcaagacagcggacgaagauguuuucgacgcugccuauaugcacugggugcggcaagccccugggcagacguuugaguggcucggauggaugaaaccggugaccggcgcugucucuuacgcccgcaaguuccaggggagagugagcuuuuauaugacacgggaacugggaauggcuuacauggaucuucgcaaccugagauucgacgauaccgccguuuauuuuugugcgcggaaaacagccggcgacguguccggcgauaaucgcggguacuucuuugaccucuggggaagaggcucucgggucaucgugagcucc

SEQ ID NO: 41607 - RNA, 381 nt, Artificial Sequence
  derived and/or modified sequence opt5 from anti-HIV-1_HeavyChain
agaugcaucuggcggcaggccggcgggggagugaagaaacccggcgcuagcgucacccuguccuguaagacagccgacgaggauguuuucgacgcggcuuacaugcacugggugcgccaagccccugggcagacguuugaauggcucggauggaugaaaccggugaccggcgccgucucuuaugcuagaaaguuccaggggcgggugagcuuuuacaugacacgcgagcugggaauggccuauauggaucuuagaaaccugcgguucgacgauaccgcuguuuacuuuugcgcccgcaaaacagcgggcgacguguccggcgauaauagaggguauuucuuugaccucuggggacggggcucucgcgucauugugagcucc

SEQ ID NO: 41608 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaucaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuagagugauuguuagcucc

SEQ ID NO: 41609 - RNA, 384 nt, Artificial Sequence
  derived and/or modified sequence opt5 from anti-HIV-1_HeavyChain
cagagccaccuggagcaauccggcucugccaugaagaaacccggggcuagcgugaaguccucuugcuggaccagcgaagacaucuucgauacaacggagcucauuuacugggucagacaggccccuggacagggccuggaauggaucggguggguuaaaauuguguccggaaccgugaacuuugcgucucuugacuuccggaaucgcaucagccuguccagagaucgggaccucagcacagcuuauauggauauucgcggccugacccaggacgauacagccaccuacuuuugugccagacaaaaguucgcuucucgguauuccggggaccagggaagcuacuuugaucuuuggggccgcggcacacugaucgucgugucuucc

SEQ ID NO: 41610 - RNA, 381 nt, Artificial Sequence
  derived and/or modified sequence opt5 from anti-HIV-1_HeavyChain
agaugccuguggcggcaggccggcgggggaaugaagaaacccggcgcuagcaugaccguguccuguaagacagccgacgaggaugucuucgacgcggcuuacaugcacuggguucgccaagccccugggcagacguuugaauggcucggauggaugaaaccggugaccggcgccgugaacuaugcuagaaaguuccaggggcgggucucuuuuuaccgcacaagagagcugggaaucgccuauauggaucuucggaaucugcgcuucgacgauaccgcuguguacuuuugcgccagaaaaacagcgggcgacguuagcggcgauaagcggggguucuuuuucgaccucuggggacgcggcuccagagugauugucucuagc

SEQ ID NO: 41611 - RNA, 381 nt, Artificial Sequence
  derived and/or modified sequence opt5 from anti-HIV-1_HeavyChain
agaugcaucugggagcgggccggcgggggaaugaagaaacccggcgcuagcaugaccguguccuguaagacagccgacgaagauauuuucgacgcggcuuacaugcacuggguccgccaggccccugggcaaacguuugaguggcugggauggaugaaaccgguuaccggcgccgugaacuaugcuagacaguuccaggggcgggugucuuuuuaccgcacaagagaacucggaaucgccuauauggaucugcgggaccuuaaguucgaugacaccgcugucuacuuuugcgcccgcaaaacaaagggcgaugugagcggcgacgauagaggguucuuuuucgaccuguggggacggggcacccgcguuauuguguccucu

SEQ ID NO: 41612 - RNA, 381 nt, Artificial Sequence
  derived and/or modified sequence opt5 from anti-HIV-1_HeavyChain
caggugcaacuggagcaggccggcgggggagucaagaaacccggcgcuagcguuacccucuccugcaagacagccgacgaagauguguucgacgcggcuuacaugcacugggugagacaggccccugggcagacguuugaguggcugggauggaugaaaccggucaccggcgccgugaacuaugcucggaaguuccaagggcgcguuucuuuuuacagaacacgggaacuuggaaucgccuauauggaucugcgcaaucucagauucgacgauaccgcuguguacuuuugugcccggaaaacagcgggcgacgucagcggcgauaagcgcggguucuuuuucgaccuguggggaagaggcucccgggugauuguuucuagc

SEQ ID NO: 41613 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauguuuucgacgcggcuuauaugcacugggugagacaggccccugggcagacguuugaguggcugggauggaugaaaccggugaccggcgccgucaacuacgcucggaaguuccaggggcgcgugucuuuuuauagaacacgggaacucggaaucgccuacauggaucugcgcaaucuuagauucgacgauaccgcuguuuauuuuugugcccggaaaacagcgggcgacgugagcggcgauaagcgcggguucuuuuucgaccuguggggaagaggcucccgggucauugugucuagc

SEQ ID NO: 41614 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugagaugggugcggcaggccccugggcagacguuugaguggcucggauggaugaaaccggucaccggcgccgugucuuacgcucgcaaguuccaggggagaguuagcuuuuauaugacacgggaacugggaauggccuacauggaucuucgcaaccugagauucgacgauaccgcuguguauuuuugugcccggaaaacagcgggcgacgucuccggcgauaaucgcggguacuucuuugaccucuggggaagaggcucucgggugaucguuagcucc

SEQ ID NO: 41615 - RNA, 381 nt, Artificial Sequence
  derived and/or modified sequence opt5 from anti-HIV-1_HeavyChain
cagguguacauggagcaacccggcgggggagucaagaaaccuggcgccagcguuacccuguccugcaagacagcugacgaagauguguucgacgccgcguauaugcacugggugagacaggcuccggggcagacguuugaguggcucggauggaugaaacccgucaccggcgccgugucuuacgcccggaaguuccaggggcgcguuagcuuuuauaugacaagagaacugggaauggcuuacauggaucuucggaaccugcgcuucgacgauaccgccguguauuuuugugcuagaaaaacagccggcgacgucuccggcgauaaucggggguacuucuuugaccucuggggacgcggcucuagagugaucguuagcucc

SEQ ID NO: 41616 - RNA, 381 nt, Artificial Sequence
  derived and/or modified sequence opt5 from anti-HIV-1_HeavyChain
cagguguacauggagcaagccggcggggaagucaagaaacccggagcuagcguuacccuguccugcaagacagccgacgaggauguguucgacgcggcuuauaugcacugggugagacaggccccuggccagacguuugaauggcucggguggaugaaaccggucaccggagccgugucuuacgcucggaaguuccagggccgcguuagcuuuuauaugacaagagagcuggggauggccuacauggaucuucggaaccugcgcuucgacgauaccgcuguguauuuuugugccagaaaaacagcgggagacgucuccggcgauaaucggggcuacuucuuugaccucugggggcgcggaucuagagugaucguuagcucc

SEQ ID NO: 41617 - RNA, 381 nt, Artificial Sequence
  derived and/or modified sequence opt5 from anti-HIV-1_HeavyChain
caggugcaacugguccagagcggcgccgagguuaagaaacccggggcuuccgugagagugucuugccaggccagcggauacaucuucaccggcuauuuugucaacuggcuccggcagcugccugggcaacgcccggaauggaugggauggauuagacccaaguccggcgcgcggaaucaggcucgccaguuccagccuagaaucucucuuacacgggaccgcgcccugagcacggccuaccucgauuccaacucucugaccagcgcugacuccgggacauauuuuugugccagacaaaccuucaaacccgauuuuuacuucgcugaccagggauggagcuuuaaucuuuggggccggggcgcccacuucauugugucuucc

SEQ ID NO: 41618 - RNA, 381 nt, Artificial Sequence
  derived and/or modified sequence opt5 from anti-HIV-1_HeavyChain
ggcugcaucuggacccaggccgggggaggcgugaagaaacccggggcuagcgucacacuguccuguaagacggccgacgaggauguuuucgacgcggcuuacaugcacugggugagacaagccccuggacagaccuuugaauggcucggcuggaugaaaccggugacaggggccgucucuuaugcucggaaguuccagggacgcgugagcuuuuacaugaccagagagcugggcauggccuauauggaucuucggaaccugcgcuucgacgauacagcuguuuacuuuugcgccagaaaaaccgcgggcgacguguccggggauaaucggggauauuucuuugaccucuggggccgcgggucuagagucauugugagcucc

SEQ ID NO: 41619 - RNA, 381 nt, Artificial Sequence
  derived and/or modified sequence opt5 from anti-HIV-1_HeavyChain
agaugcaucuggcggcaggccggcgggggaaugaagaaacccggcgcuagcaugaccguguccuguaagacagccgacgaggauauuuucgacgcggcuuacaugcacuggguccgccaagccccugggcagacguuugaauggcugggauggaugaaaccgguuaccggcgccgugaacuaugcuagacaguuccaggggcgggugucuuuuuaccgcacaagagagcucggaaucgccuauauggaucugcgggaccuuaaguucgaugacaccgcugucuacuuuugcgcccgcaaaacaaagggcgaugugagcggcgacgauagaggguucuuuuucgaccuguggggacggggcacccgcguuauuguguccucu

SEQ ID NO: 41620 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugagugggucggauggaugaaaccggugaccggcgccguuucuuacgcucggaaguuccaggggcgcgugagcuuuuauaugacaagagaacucggaauggccuacauggaucugcggaaccuucgcuucgacgauaccgcugucuauuuuugugccagaaaaacagcgggcgacguguccggcgauaaucggggguacuucuuugaccuguggggacgcggcucuagaguuaucgugagcucc

SEQ ID NO: 41621 - RNA, 381 nt, Artificial Sequence
  derived and/or modified sequence opt5 from anti-HIV-1_HeavyChain
cagguguacauggagcaagccggcgggggagucaaggaacccggcgcuagcguuacccuguccugcaaaacagccgacgaggauguguucgacgcggcuuauaugcacugggugagacaggccccugggcagacguuugaauggcucggauggaugaagccggucaccggcgccgugaacuacgcucggaaauuccaggggcgcguuucuuuuuauagaacacgggagcugggaaucgccuacauggaucuucgcaaucugagauucgacgauaccgcuguguauuuuugugcccggaagacagcgggcgacgucagcggcgauaaacgcggguucuuuuucgaccucuggggaagaggcucccgggugauuguuucuagc

SEQ ID NO: 41622 - RNA, 381 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucaagaccgagcucauucauugggugcggcaggccccuggccaggggcuggaauggaucggaugggugaaaacagucacgggcgcggugaacuuugggagccuugauuuccgccacagaauuucccugacccgggaccgcgaucucuuuacagcucauauggacaucagaggacugacccagggcgauacagccaccuacuucugugcccggcaaaaguuugagucucgcuauacaggcgggcagggaugguacuucgaccuuuggggcagagggacccacauuguugugagcucc

SEQ ID NO: 41623 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggauggaugaagacagugacgggcgcggucaacuuugggagccuugauuucagacaccggauuucccugacccgcgacagagaucucuuuacagcucauauggacauccggggacuggcccagggcgauaccgccacauacuucugugcucgccaaaaauuugaaucuagauauaccggcgggcagggaugguacuucgaccuuuggggccgggggacacacauugugguuagcucc

SEQ ID NO: 41624 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcacauuguugugucuagc

SEQ ID NO: 41625 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucgugguuagcucu

SEQ ID NO: 41626 - RNA, 384 nt, Artificial Sequence
  derived and/or modified sequence opt5 from anti-HIV-1_HeavyChain
agccacaccuggaacaauagaggcuccgccaugaagaaacccggggcuucugugcgggucagcugcuggacauccgaggacaucuucgauacgaccgaacugauuuacuggguucgccaggccccuggacaaggccucgaguggaucgggugggugaagauugugucuggaacagucaacuuugcgagccuggacuucagaaaucggaucucccuuucucgcgauagagaccugagcaccgcuuauauggauauucggggccucacacaggacgauaccgccacauacuuuugugcccgccagaaauucgcuuccagauauagcggggaccagggaucuuacuuugaucuguggggccggggcacccuuaucgugguuuccagc

SEQ ID NO: 41627 - RNA, 381 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuuccauaacgagcucauuuacuggguucggcaggccccuggacagggccuggaauggaucgggugggugaagauugugagcggaacagucaauuuugcgucccuugauuuccgcaacagaaucucucugagccgggaccgcgaucucuccacggcuuauauggacauuagaggccugacccaggaugacacagccaccuacuuuugugcccggcaaaaauucgcuagccgcuauucuggggaucagggauccuacuuugaccuuuggggcagaggcacacugaucgugguuagcucu

SEQ ID NO: 41628 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggauggaugaagacggugaccggcgcggucaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcacauugugguuucuagc

SEQ ID NO: 41629 - RNA, 381 nt, Artificial Sequence
  derived and/or modified sequence opt5 from anti-HIV-1_HeavyChain
cagguguucauggagcaagccggcggggaagucaagaaacccggagcuagcaugaccguuuccugcaagacagccgacgaggauguguuugacgcggcuuacaugcacugggugagacaggccccuggccagacguucgaauggcugggguggaugaaaccggucaccggagccgugaacuaugcucggcaguuucaaggccgcguuucuuucuacagaacacgggagcucgggaucgccuauauggaucugcgcgaccuuaaguuugaugacaccgcuguguacuucugugccagaaaaacaaagggagaugucagcggcgacgaucggggcuuuuucuuugaccugugggggcgcggaaccagagugauuguuuccucu

SEQ ID NO: 41630 - RNA, 381 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgaggaugaacugauucauugggugcggcaggcccccggccaggggcuugaguggaucggaugggugaagauugucucuggcacagugaacuuugcgagccuggacuuccgcaauagaaucucccucucucgggaucgcgaccugagcacggcuuacauggauauuagagggcuuacccaggacgauacagccaccuauuuuugugcccggcaaaaauucgcuucccgcuacagcggagaccagggcucuuauuuugaucuguggggcagagggacacucaucguuguguccagc

SEQ ID NO: 41631 - RNA, 381 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacauccucaaggccgagcugauuuacuggguucggcaggcgccuggacgcggccuugaauggaucgggugggugaaaacagugagcggaacggucaacuucggcuccucugauuuuagaaaucggauuagccugacccgcgacagagaucucuccacagcucauauggacauccgggggcugacccaggaugacacagccaccuauuucugugcccgccagaaguuugagagccuuuacucugaugaccaaggauccuauuucgaucuguggggcagaggcacacucauuaucgugagcucu

SEQ ID NO: 41632 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacuccuucaccgacuauuacauccacuggcucagacagguccagggccaacggccugaauggaugggguggauucgcccgagaacaggagcgcggaaccaggcucgccaguuucagcccagaaucucucugacgcgggaucgcgcccuuagcaccgccuaucuggaccucaauucccugacaucugcugauagcggcaccuacuucugugccagacaaacauuuaagccugacuucuauuuugcugaucaggggugguccuucaaccuuuggggacggggcgcccauuuuauugugagcucu

SEQ ID NO: 41633 - RNA, 381 nt, Artificial Sequence
  derived and/or modified sequence opt5 from anti-HIV-1_HeavyChain
cagguguucauggagcaagccggcggggaagucaagaaacccggagcuagcaugaccguuuccugcaagacagccgacgaggauguguuugacgcggcuuacaugcacugggugagacaggccccuggccagacguucgaauggcugggguggaugaaaccggucaccggagccgugaacuaugcucggaaguuucagggccgcguuucuuucuacagaacacgggagcucgggaucgccuauauggaucugcgcgaccuuaaauuugaugacaccgcuguguacuucugugccagaaagacaaagggagaugucagcggcgacgaucggggcuuuuucuuugaccugugggggcgcggaaccagagugauuguuuccucu

SEQ ID NO: 41634 - RNA, 384 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucaccggcgcugugaacuuugggucccuugauuucagacaccggauuucucugacacgcgacagagaucucuuuaccgcccauauggacauccggggacugacacagggcgauaccgccacauacuucugugcucgccaaaaauuugaaagcagauauaccggcgggcagggaugguacuucgaccuuuggggccgggggacgcacauuguuguguccucu

SEQ ID NO: 41635 - RNA, 384 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggagcuccgaagacaucuucgagcggaccgaacucauucauugggugcgccaggcgccuggccaggggcuggaguggaucggaugggugaagacagucacgggcgcugugaacuuugggucucuugauuucagacaccggauuagccugacccgcgacagagaucucuuuacagcccauauggacauccggggacugacccagggcgauacagccaccuacuucugugcucgccaaaaauuugaauccagauauacaggcgggcagggaugguacuucgaccuuuggggccgggggacccacauuguugugucuagc

SEQ ID NO: 41636 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcugggccucugaagacaucuucgauaccacagagcucauuuacuggguucggcaggcgccuggacagggccuggaauggaucgggugggugaagauugugagcggaacggucaacuuugcuucccuugacuuccgcaauagaaucucucugagccgggaucgcgaccucuccaccgccuauauggauauuagaggccugacacaggacgauaccgccacauacuuuugugcucggcaaaaauucgccagccgcuauucuggggaccagggauccuacuuugaucuuuggggcagaggcacccugaucgugguuagcucu

SEQ ID NO: 41637 - RNA, 381 nt, Artificial Sequence
  derived and/or modified sequence opt5 from anti-HIV-1_HeavyChain
agaugccggcuggugcagagcggcgccgaggucaagaaacccggggcuuccguucgcgugucuugucaagccagcggauacaccuucuccgcguauggcgugaacugggucagacaggcuccugggcaggaacucgaguggaucggaugggugaagacaguuacgggcgccgugaauuuugggucuccgaacuuccggcaccgcauuagccugaccagagaccgggaucuuuuuacagcccauauggacauccgcggacugacccagggcgauacagcuaccuacuucugcgccagacaaaaauuugaaucccgguauacaggcgggcagggaugguacuucgaccucuggggccgcgggacccacauugucgugucuagc

SEQ ID NO: 41638 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugugucaggccccuggccaggggcuggaguggaucggaugggugaagacagucacgggcgcggugaacuuugggagccuugauuuccgccacagaauuucccugacccgggaccgcgaucucuuuacagcucauauggacaucagaggacugacccagggcgauacagccaccuacuucugcgcccggcaaaaauuugaaucucgcuauacaggcgggcagggaugguacuucgaccuuuggggcagagggacccacauuguugugagcucc

SEQ ID NO: 41639 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagauugucacaggcgcggugaacuuugggagccuugauuucagacaccggaucucccugacgcgcgacagagaucucuuuaccgcucauauggacauucggggacugacacagggcgauaccgccacauacuucugugcccgccaaaaauuugaaucuagauauaccggcgggcagggaugguacuucgaccuuuggggccgggggacacacaucguugugagcucc

SEQ ID NO: 41640 - RNA, 384 nt, Artificial Sequence
  derived and/or modified sequence opt5 from anti-HIV-1_HeavyChain
caggugcaacugguccagagcggccucgagguuaagaaacccggggccuccgugagagugucuugcuggaccagcgaagacaucuucgauacaacggagcugauuuacuggguccggcaggcuccuggacagggccuugaauggaucgggugggugaagauuguuuccggaaccgugaacuuugccucucuggacuuccgcaauagaaucagccucucccgggaucgcgaccugucuacagcgcacauggauauuagaggccuuacccaagacgauacagcuaccuauuuuugugcccggcagaaauucgccagccgcuacuccggggaccagggaagcuauuuugaucuguggggcagaggcacacucaucaucgucucuucc

SEQ ID NO: 41641 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugcggcaggacgauaccgccacauauuuuugugcccgccaaaaauucgagagcagauacucuggggaccagggauccuauuuugaucuuuggggccggggcacccugaucaucgugagcucu

SEQ ID NO: 41642 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugcuagccgcuauuccggcgaccaggggagcuacuucgaucuguggggaagaggcacacuuaucguggucucuucc

SEQ ID NO: 41643 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaauccagauauaccggcgggcagggaugguacuucgaucuguggggccgggggacgcacaucguggucucuagc

SEQ ID NO: 41644 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagaagucugaacugauucauugggugcgccaagcuccuggccaggggcucgaguggaucggaugggugaaaacggucaccggcgccgugaacuuugggagcuccgauuucagacagcggguuucucugacacgcgacagagaucuuagcaccgcguacauggacauucggggacugacacaggaugacaccgcuacauauuuuugugcccgccaaaaguucgccuccagauacagcggcgaucagggcucuuauuuugaccucugggggcggggaacccugaucguggucuccagc

SEQ ID NO: 41645 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgagagccgcuauacagggggacagggcugguacuuugaccuuuggggcagagggacccauaucgugguuucuucc

SEQ ID NO: 41646 - RNA, 384 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcucacauggauauuagaggccugacccaagacgauacagccaccuauuuuugugcccggcagaaauucgagagccgcuacacagggggacagggcugguauuuugaccuuuggggcagagggacccauaucgucguguccagc

SEQ ID NO: 41647 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccagggggacacagccaccuacuuuugugcccggcaaaaauucgagagccgcuauacaggaggccagggcugguacuuugaucuuugggggagaggaacccauaucgugguuucuucc

SEQ ID NO: 41648 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccggauuucagacaccggauuucccuuucucgcgacagagaucugagcaccgcucauauggacauccggggacucacacaggaugacaccgccacauacuuuugugcccgccaaaaauucgcuuccagauauagcggcgaucagggcucuuacuuugaccugugggggcggggaacccuuauuaucguuuccagc

SEQ ID NO: 41649 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggcagagggcuggaguggaucggaugggugaagacggucucuggcaccgugaacuuugggagcuccgauuuccggaaucgcguuucucuuacaagagaccgggaucugagcaccgcgcacauggacauucgcggacucacacaggaugacaccgcuacauacuuuugugccagacagaaauucgaaucccuguauagcgaugaccaaggcucuuacuuugaucuuuggggccgggggacccugaucauuguguccagc

SEQ ID NO: 41650 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagaaaccggauuagccuuacacgcgauagagaccuguccaccgcucacauggauauccggggacucacacaggacgauaccgccacauacuuuugugcccgccaaaaauucgaaucucuguauagcgacgaucagggcuccuacuuugaccuuuggggcagagggacccugauuaucguuagcucu

SEQ ID NO: 41651 - RNA, 384 nt, Artificial Sequence
  derived and/or modified sequence opt5 from anti-HIV-1_HeavyChain
cagagccaccuggagcaauccggcucugccaugaagagacccggggcuagcgugcgggucuccugcuggaccucugaagacaucuucgauacaacggagcucauuuacuggguucgccaggccccuggacagggccuggaauggaucgggugggugaaaauugugagcggaaccgucaacuuugcgucccuugacuucagaaaucggaucucucugagccgcgauagagaccucuccacagcuuauauggauauucggggccugacccaggacgauacagccaccuacuuuugugcccgccaaaaguucgcuagcagauauucuggggaccagggauccuacuuugaucuuuggggccggggcacacugaucgugguuagcucu

SEQ ID NO: 41652 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagaaaucggauuucccucucucgcgacagagaucugagcacggccuauauggacauccggggacuuacccaggaugacacagccaccuacuucugugcucgccaaaaauuugccuccagauauagcggcgaucagggcucuuacuucgaccugugggggcggggaacacucauuguuguguccagc

SEQ ID NO: 41653 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagacuuuuucaccgcucauauggauauccggggacucacacagggcgauaccgccacauacuuuugugcccgccaaaaauucgaauccagauauaccggcgggcagggaugguacuuugaccuguggggccgggggacgcacauuguugugucuagc

SEQ ID NO: 41654 - RNA, 381 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuuccggaccgagcucauucauugggugcgccaggccccuggccaggggcuggaauggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugagucuagauauacaggcgggcagggaugguacuucgaccuuuggggccgggggacccacauuguugugagcucc

SEQ ID NO: 41655 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaucccuguauucugaugaccagggcagcuacuucgaucuuugggggagaggaacccugaucauuguguccagc

SEQ ID NO: 41656 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucu

SEQ ID NO: 41657 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauauggauauuagaggccucacccaggacgauacagccaccuauuuuugugcccggcaaaaauucgcuucucgcuacuccggggaccagggaagcuauuuugaucuguggggcagaggcacacuuaucgugguuucuucc

SEQ ID NO: 41658 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauuuacugggugcgccaggccccuggcagagggcuggaguggaucggaugggugaagacggucucuggcaccgugaacuuugggagcuccgauuuccggaaucgcauuucucuuacaagagaccgggaucugagcaccgcgcauauggacauccgcggacucacacaggaugacaccgcuacauauuuuugugccagacagaaauucgaaucccuguacagcgaugaccaaggcucuuauuuugaucuuuggggccgggggacccugauuaucguuuccagc

SEQ ID NO: 41659 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauucauuggguucggcaggccccuggacagggccuggaauggaucgggugggugaagaccgugacaggagcggucaacuuuggcagccuugacuuccgccacagaauuucccugacccgggaucgcgaccucuuuacagcucauauggauaucagagggcugacccagggagacacagccaccuacuucugugcccggcaaaaauuugagucucgcuauacgggcggccaggggugguacuucgaucuuuggggaagaggcacccacauugugguuagcucc

SEQ ID NO: 41660 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucggaacaacggagcucauuuacuggguucggcaggccccuggccaggggcuggaauggaucggaugggugaagauugugagcggcaccgucaacuuugcgucccuugauuuccgcaauagaaucucucugagccgggaccgcgaucucuccacagcuuauauggacauuagagggcugacccaggaugacacagccaccuacuuuugugcccggcaaaaauucgcuagccgcuauucuggagaucagggcuccuacuuugaccuuuggggcagagggacacugaucgugguuagcucu

SEQ ID NO: 41661 - RNA, 384 nt, Artificial Sequence
  derived and/or modified sequence opt5 from anti-HIV-1_HeavyChain
caggugcaacugguccagagcggcuccgccaugaagaaacccggggcuucuguuagagugagcugcuggaccuccgaggacaucuucgauacaacggaacucauuuacugggugcggcaggccccuggacagggccuggaguggaucgggugggucaagauugugucuggaaccguuaacuuugcgagccuugacuuccgcaauagaaucucccugucucgggaucgcgaccucagcacagcuuauauggauauuagaggccugacccaagacgauacagccaccuacuuuugugcccggcagaaauucgcuucccgcuauagcggggaccagggaucuuacuuugaucuuuggggcagaggcacacugaucguggucuccagc

SEQ ID NO: 41662 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaaggcaucuucgagcggacagaacucauucauugggugcgccaggccccugggcagggacuggaguggaucggcugggugaagacggucaccggggcggugaacuuuggaucucuugacuucagacaccggauuagccugacacgcgauagagaccucuuuaccgcucauauggauauccggggccugacacagggcgacaccgccacauacuucugugcccgccaaaaauuugaauccagauauaccgggggacagggcugguacuucgaucuuugggggcggggaacgcacauuguugugucuagc

SEQ ID NO: 41663 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggcccgccaggcgccuggccaggggcuggaguggaucggaugggugaagacggugaccggcgcugucaacuuugggucuccgaauuucagacaccgggccagccuuacacgcgauagagaccuguuuaccgcccauauggauauucggggacucacagaaggcgacaccgcuacauacuucugugcccgccagaaauuugcuuccagauauucuggcgaucaagggagcuacuucgaccuguggggacggggcacccuuaucauuguguccagc

SEQ ID NO: 41664 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacagccgagcucauuuacuggguucggcaggcgccuggacagggccuggaauggaucgggugggugaagauugugagcggaacggucaacuuugcuucccuugacuuccgcaauagaaucucucugagccgggaucgcgaccucuccaccgcccauauggauauuagaggccugcggcaggacgauacagccaccuauuuuugugcucgccaaaaauucgagagcagauacucuggggaccagggauccuauuuugaucuuuggggccggggcacacugaucaucgugagcucu

SEQ ID NO: 41665 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucgaaugggugaaggcggucucuggagcugugaacuacggcagccuggauuuuagacaccggguuucccucacgcgcgacagagaucuguucaccgcccauauggacauucgggggcuuacacaggaugacaccgccacauauuuuugugcucgccaaaaauucgagucuagauacaccggaggccagggcugguauuuugaucugugggggcggggaacacacaucguggucagcucc

SEQ ID NO: 41666 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacuggacugcgugagcucu

SEQ ID NO: 41667 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggagcggucaacuuugcuucccuugacuuccgcaauagaaucucucugagccgggaucgcgaccucuccaccgcccauauggauauuagaggccugacacaggacgauaccgccacauauuuuugugcucggcaaaaauucgccagccgcuacucuggggaccagggauccuauuuugaucuuuggggcagaggcacccugaucaucgugagcucu

SEQ ID NO: 41668 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacagggcgauaccgccacauauuucugugcucgccaaaaauuugaaagcagauacaccggcgggcagggaugguauuucgaccuguggggccgggggacacacaucguggucuccagc

SEQ ID NO: 41669 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucugagcacagcucacauggacauuagaggacucacccaagaugacacagccaccuacuuuugugcccggcagaaguucgaaucccuguauagcgaugaccagggcucuuacuuugaucuuuggggccgcgggacacugaucauuguguccagc

SEQ ID NO: 41670 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacaccggauuagccugacccgcgauagagaccucuuuacagcgcauauggauauccggggacugacccagggcgacacagcuaccuacuucugugcccgccaaaaauuugaauccagauauacgggcgggcagggaugguacuucgaucuuuggggccgggggacccacauuguugugucuagc

SEQ ID NO: 41671 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagauugugagcggaacggucaacuuugcgucccuugauuuccggaaucgcaucucucugagcagagaccgggaucucuccaccgcucauauggacauucgcggccugacacaggaugacaccgccacauauuuuugugccagacagaaauucgcuagccgguacucuggggaucaaggauccuauuuugaccuuuggggccgcggcacccugaucaucgugagcucu

SEQ ID NO: 41672 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucaucgugagcucu

SEQ ID NO: 41673 - RNA, 384 nt, Artificial Sequence
  derived and/or modified sequence opt5 from anti-HIV-1_HeavyChain
caggccagacuggagcaaagcggcuccggggugaagaaacucggagcuucuguccggguuagcugcuggaccuccgaagacaucuucgagcgcacagaacugauucacugggugagacaggcccccggccaggggcuugaguggaucggaugggugaaggcggucucuggcgcugugaacuacgggagccuggauuuucggaaucgcauuucccucucuagagaccgggaucugagcacggccuauauggacauccgcggacuuacccaggaugacacagccaccuacuucugugcuagacaaaaauuugccucccgguauagcggcgaucagggcucuuacuucgaccugugggggcgcggaacacucauuguuguguccagc

SEQ ID NO: 41674 - RNA, 384 nt, Artificial Sequence
  derived and/or modified sequence opt5 from anti-HIV-1_HeavyChain
caggcccaccuggagcaaagcggcuccgcuaugaagaaacccggggccucugugagagucagcugcuggaccuccgaagacaucuucgauacaacggagcucauuuacuggguucggcaggcgccuggacagggccuggaauggaucgggugggugaagauugugucuggaaccgucaacuuugcuagccuugacuuccgcaauagaaucucccugucucgggaucgcgaccucagcacagcccauauggauauuagaggccugacccaggacgauacagccaccuauuuuugugcucggcaaaaauucgccucccgcuacagcggggaccagggaucuuauuuugaucuuuggggcagaggcacacugaucaucguguccagc

SEQ ID NO: 41675 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucucuacagcuuacauggacauccggggacugacccaggaugacacagccaccuauuuuugugcccgccaaaaauucgcuagcagauacuccggcgaucagggcagcuauuuugaccuuugggggcggggaacacugauuguugugucuucc

SEQ ID NO: 41676 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggcuaacuuugggagccuugauuucagacaccggauuucccugacccgcgacagagaucucuuuacagcccauauggacauccggggacugacccagggcgauacagccaccuacuucugugcucgccaaaaauuugaaucuagauauacaggcgggcagggaugguacuucgaccuuuggggccgggggacccacauugugguuagcucc

SEQ ID NO: 41677 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcucc

SEQ ID NO: 41678 - RNA, 381 nt, Artificial Sequence
  derived and/or modified sequence opt5 from anti-HIV-1_HeavyChain
agaugcaucuggcggcaggccggcgggggagugaagaaacccggcgcuagcgucacccuguccuguaagacagccgacgaggauguuuucgacgcggcuuacaugcacugggugcgccaagccccugggcagacguuugaauggcucggauggaugaaaccggugaccggcgccgucucuuaugcuagaaaguuccaggggcgggugagcuuuuacaugacacgcggaauuagaauggccuauauggaucugcggaaccuucgcuucgacgauaccgcuguuuacuuuugcgccagaaaaacagcgggcgacguguccggcgauaaucggggguauuucuuugaccuguggggacgcggcucuagagucaucgugagcucc

SEQ ID NO: 41679 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagauugugagcggaacggucaacuuugcgucccuugauuuccggaaucgcaucucucugagcagagaccgggaucucuccaccgcuuauauggacauucgcggccugacacaggaugacaccgccacauacuuuugugccagacagaaauucgcuagccgguauucuggggaucaaggauccuacuuugaccuuuggggccgcggcacccugaucgugguuagcucu

SEQ ID NO: 41680 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauucauuggguucgccaggccccuggacagggccuggaguggaucgggugggugaagacggugaccggagcggucaacuuuggcagccuugauuucagacaccggauuucccugacacgcgacagagaucucuuuaccgcucauauggacauccgggggcugacacagggagauaccgccacauacuucugugcccgccaaaaauuugaaucuagauauaccggcggccaggggugguacuucgaccuuuggggacggggcacgcacauugugguuagcucc

SEQ ID NO: 41681 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccgcugcccauauggauauuagaggccugacacaggacgauaccgccacauauuuuugugcucggcaaaaauucgccagccgcuacucuggggaccagggauccuauuuugaucuuuggggcagaggcacccugaucaucgugagcucu

SEQ ID NO: 41682 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugcuucuagauauagcggcgaucagggguccuacuucgaccuguggggacggggcacccuuauuguggucagcucu

SEQ ID NO: 41683 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucuguacacgccaaaaauuugaaucuagauauaccggcgggcagggaugguacuucgaccuuuggggccgggggacgcacauuguugugagcucc

SEQ ID NO: 41684 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggccggaguggaucggaugggugaagacagucacgggcgcggugaacuuugggagccuggauuucagacaccggauuucccuuacccgcgacagagaucuguuuacagcucauauggacauccggggacucacccagggcgauacagccaccuacuucugugcccgccaaaaauuugaaucuagauauacaggcgggcagggaugguacuucgaccuguggggccgggggacccacauuguugugagcucc

SEQ ID NO: 41685 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggccgcuugauuucagacaccggauuagccugacccgcgacagagaucucuuuacagcucauauggacauccggggacugacccagggcgauacagccaccuacuucugugcccgccaaaaauuugaauccagauauacaggcgggcagggaugguacuucgaccuuuggggccgggggacccacauuguugugucuagc

SEQ ID NO: 41686 - RNA, 384 nt, Artificial Sequence
  derived and/or modified sequence opt5 from anti-HIV-1_HeavyChain
cagagccaccuggagcaauccggccccgccaugaagaaaccuggggcuucugugagagucagcugcuggaccuccgaagacaucuucgagcggacagaacucauuuacuggguucgccaggccccgggaagaggccuggaguggaucgggugggugaagacggugucuggaaccgucaacuuuggcagcuccgauuuccggaaucgcauuucucuuacaagagaccgggaucugagcaccgcgcauauggacauccgcgggcucacacaggaugacaccgcuacauauuuuugugccagacagaaauucgaaucccuguacagcgaugaccaaggaucuuauuuugaucuuuggggccggggcacccugauuaucguguccagc

SEQ ID NO: 41687 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcggccucuccacagcucauauggacauuagagggcugacccaggaugacacagccaccuauuuuugugcccggcaaaaauucgcuagccgcuacucuggagaucagggcuccuauuuugaccuuuggggcagagggacacugaucaucgugagcucu

SEQ ID NO: 41688 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugcuucuagauauagcggcgaucagggguccuacuucgaccuguggggacggggcacacuuaucauugugagcucu

SEQ ID NO: 41689 - RNA, 384 nt, Artificial Sequence
  derived and/or modified sequence opt5 from anti-HIV-1_HeavyChain
cagagccaccuggagcauuccggcucugccaugaagaaacccggggcuagcgugagagucuccugcuggaccucugaagacaucuucgauacaacggagcucauuuacuggguucggcaagccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcagaaauucgcuagccgcuauucuggggaccaaggauccuacuuugaucuuuggggcagaggcacacugaucgugguuagcucu

SEQ ID NO: 41690 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaucucuguauagcgaugaccagggcuccuacuucgaucuuugggggagaggaacccugauuaucgugagcucu

SEQ ID NO: 41691 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggauuucccuuacccgcgauagagaccuguuuacagcucauauggauauccggggacucacccagggcgacacagccaccuacuucugugcccgccaaaaauuugaaucuagauauacaggcgggcagggaugguacuucgaucuguggggccgggggacccacauuguugugagcucc

SEQ ID NO: 41692 - RNA, 384 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaaacuugugagcggagcugucaacuuuggcuccguggauuucagaaaucggaucucucugagccgcgacagagaucucuccacagcccauauggacauucgggggcugcgccaggaugacacggccaccuauuuuugugcuagacagaaguucgaaagccgguacucuggagaucaaggcuccuauuuugaccuuuggggccgcgggacacugaucaucguuagcucu

SEQ ID NO: 41693 - RNA, 384 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcacagaacucauuuacugggugagacaggcgccuggacagggccuggaguggaucgggugggugaaaacggucucuggagcugugaacuuuggcagccaggauuuccgggaccgcuuuucccuuaccagagaucgggaccugucuacagcccauauggauauucgcgggcucacccaagacgauacagccaccuauuucugugcuagacagaaguuugccagccgguacuccggagaccagggcagcuauuucgaucuguggggccgcgggacacuuaucauuguuucuucc

SEQ ID NO: 41694 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagccuugauuuccgccacagaauuucccugacccgggaccgcgaucucuuuacagcucauauggacaucagaggacugacccagggcgauacagccaccuacuucugugcccggcaaaaguuugaaucucgcuauacaggcgggcagggaugguacuucgaccuuuggggcagagggacccacauuguugugagcucc

SEQ ID NO: 41695 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccaggacgauacagccaccuacuucugugcccgccaaaaauuugaaucucuguauagcgacgaucagggcuccuacuucgaccuuuggggcagagggacacugaucauugugagcucu

SEQ ID NO: 41696 - RNA, 384 nt, Artificial Sequence
  derived and/or modified sequence opt5 from anti-HIV-1_HeavyChain
cagagccaccugaagcaauccggcucugccaugaaaaagcccggggcuagcgugagagucuccugcuggaccucugaggacaucuucgaacggacagagcucauuuacuggguucgccaggccccuggaagaggccuggaauggaucgggugggugaaaacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaguucgagagccuguacucugaugaccaaggauccuauuuugaucuuuggggccggggcacccugauuaucgugagcucu

SEQ ID NO: 41697 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucucuacagcucauauggacauccggggacugacccaggaugacacagccaccuacuuuugugcccgccaaaaauucgcuagcagauauuccggcgaucagggcagcuacuuugaccuuugggggcggggaacacugauuaucguuucuucc

SEQ ID NO: 41698 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgaaucuagauacaccggcggccaggggugguauuuugaucuguggggacggggcacacacaucguggucagcucc

SEQ ID NO: 41699 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacaggacgauaccgccacauacuucugugcccgccaaaaauuugaaucccuguauucugacgaucagggcagcuacuucgaccuuuggggcagagggacccugaucauuguguccagc

SEQ ID NO: 41700 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacauccucgagcggacagaacugauuuacuggguucgccaggccccuggaagaggccuugaguggaucgggugggugaagacggugagcggaaccgucaacuucggcuccucugauuuucggaaucgcauuagccugacaagagaccgggaucucuccaccgcgcauauggacauccgcgggcugacacaggaugacaccgcuacauauuucugugccagacagaaauuugaaagccuuuacucugaugaccaaggauccuauuucgaucuguggggccggggcacccucauuaucgugagcucu

SEQ ID NO: 41701 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuugcuuccagauauucuggcgaucaggggagcuacuucgaccuguggggacggggcacccuuaucguggucuccagc

SEQ ID NO: 41702 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggauuagccuuacacgcgauagagaccuguuuaccgcucauauggauauccggggacucacacagggcgacaccgccacauacuucugugcccgccaaaaauuugaauccagauauaccggcgggcagggaugguacuucgaucuguggggccgggggacgcacauuguugugucuagc

SEQ ID NO: 41703 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgacgauaucuucgaacggacagagcucauucauugggugcgccaggccccuggccaggggcuggaauggaucggaugggugaagacggucaccggcgcggugaacuuugggucuccgaauuucagacagcggguuagccuuacacgcgacagagaucuguuuaccgcucacauggacauucggggacucacacaaggcgauaccgccacauacuucugugcccgccagaaauuugaguccagauauaccggcgggcagggaugguacuucgaccuguggggccgggggacgcauaucguggucucuagc

SEQ ID NO: 41704 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucgugguuagcucu

SEQ ID NO: 41705 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagaaaccggauuagccuuucccgcgauagagaccugucuacagcucacauggauauccggggacucacccaggacgauacagccaccuacuuuugugcccgccaaaaauucgcuagcagauauuccggcgaccagggcagcuacuuugaucugugggggcggggaacacuuauuaucguuucuucc

SEQ ID NO: 41706 - RNA, 384 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcacagaacucauuuacugggugagacaggcgccuggacagggccuggaguggaucgggugggugaaaacggucaccggagcugugaacuuuggcucucuugauuuccggcaucgcauuagccugacaagagaccgggaucucuuuaccgcccacauggacauccgcgggcugacacagggagauaccgccacauauuucugugcuagacaaaaguuugaaucccgguacaccggcggccaggggugguauuucgaccuuuggggacgcggcacgcauauuguugugucuagc

SEQ ID NO: 41707 - RNA, 384 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaaacuugugagcggagcugucaacuuuggcuccguggauuucagagaccggguuucucugacacgcgauagagaccucuuuacggcccauauggauauccgggggcugacccaggacgauacagccaccuauuucugugcucgccagaaguuugccagcagauacuccggagaccaaggcagcuauuucgaucuuuggggccgggggacacugauuaucgugucuucc

SEQ ID NO: 41708 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcaccgugaacuuugcgagccuugauuucagaaaucggauuucccugucucgcgacagagaucucagcacagcuuacauggacauccgggggcugacccaggaugacacagccaccuauuuuugugcccgccaaaaauucgcuuccagauacagcggagaucagggcucuuauuuugaccuuuggggccgggggacacugauuguuguguccagc

SEQ ID NO: 41709 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggauuucccuuucucgcgauagagaccugagcaccgcuuacauggauauccggggacucacacaggacgauaccgccacauauuuuugugcccgccaaaaauucgcuuccagauacagcggcgaccagggcucuuauuuugaucugugggggcggggaacccuuauuguuguguccagc

SEQ ID NO: 41710 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuuccccgacccgcgacagagaucuguuuacagcucauauggacauccggggacucacccagggcgauacagccaccuacuucugugcccgccaaaaauuugaaucuagauauacaggcgggcagggaugguacuucgaccuguggggccgggggacccuuauuguugugagcucc

SEQ ID NO: 41711 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucccgacagcuuauauggauauuagaggccugacccaggacgauacagccaccuacuuuugugcccggcaaaaauucgcuucccgcuauagcggggaccagggaucuuacuuugaucuuuggggcagaggcacacugaucgugguuuccagc

SEQ ID NO: 41712 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugcgagcggaaccgugaacuuugcuucccuugacuuccgcaauagaaucucucugagccgggaucgcgaccucuccacagcccauauggauauuagaggccugacccaggacgauacagccaccuauuuuugugcucggcaaaaauucgccagccgcuacucuggggaccagggauccuauuuugaucuuuggggcagaggcacacugaucgucgugagcucu

SEQ ID NO: 41713 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagaccgugacaggagcggucaacuuuggcagccuugacuuccgccauagaauuucccugacccgggaucgcgaccucuuuacagcucacauggauaucagagggcugacccagggagacacagccaccuauuucugugcccggcaaaaauuugagucucgcuacacgggcggccaggggugguauuucgaucuuuggggaagaggcacccauauugugguuagcucc

SEQ ID NO: 41714 - RNA, 384 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcucacauggauauuagaggccugcggcaagacgauaccgccacauauuuuugugcccgccagaaauucgagagcagauacuccggggaccagggaagcuauuuugaucuuuggggccggggcacccugaucaucgucucuucc

SEQ ID NO: 41715 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgccauagaaucucucugacacgggaucgcgaccucuuuaccgcucacauggauauuagaggccugacacagggggacaccgccacauauuucugugcccggcaaaaauuugagagccgcuacaccggaggccagggcugguauuucgaucuuugggggagaggaacgcauaucgugguuuccagc

SEQ ID NO: 41716 - RNA, 384 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucacgggagcugugaacuuuggcagccuugauuuccggcaucgcauuucccugaccagagaccgggaucucuuuacagcccacauggacauccgcgggcugacccagggagauacagccaccuauuucugugcuagacaaaaguuugaaucucgguacacaggcggccaggggugguauuucgaccuuuggggacgcggcacccauauuguugugagcucc

SEQ ID NO: 41717 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccuguauuccgacgaucagggcagcuacuucgaccuuugggggcgcggaacacugaucauugugucuucc

SEQ ID NO: 41718 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauugugguuagcucu

SEQ ID NO: 41719 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucgaaucuagauacaccggcgggcagggaugguauuuugaccuguggggccgggggacacacaucguggucagcucc

SEQ ID NO: 41720 - RNA, 381 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacauccuccggaagucugagcugauucauugggugcgccaggccccuggccaggggcuugaauggaucggaugggugaaaacagucacgggcgcggugaacuucgggcaccagauuagcgauagaguuucccugacccgggaccgcgaucucucuacagcucauauggacaucagaggacugacccaagaugacacagccaccuacuuuugugcccggcagaaguucgagagccuuuauuccgaugaccagggcagcuacuuugaucuguggggccgcgggacacucauuaucgugucuucc

SEQ ID NO: 41721 - RNA, 384 nt, Artificial Sequence
  derived and/or modified sequence opt5 from anti-HIV-1_HeavyChain
cccgcccaccuggagcagagcggcuccggggugaagaaaccuggagcuucugucagaguuagcugcugggccuccgaagacaucuucgagcggaccgaacucauucauugggugcgccaagcgccgggccaggggcuggaguggaucggaugggugaagacagucacgggcgcugugaacuuugggucucuugauuucagacaccggauuagccugacccgcgacagagaucucuuuacagcccauauggacauccggggacugacccagggcgauacagccaccuacuucugugcucgccagaaauuugaauccagauauacaggcgggcaaggaugguacuucgaccuuuggggccgggggacccacauuguugugucuagc

SEQ ID NO: 41722 - RNA, 384 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucagcggagcugugaacuuuggcuccacggauuuccgggaacgcauuucucuuagcagagaccgggaucuguccaccgccuauauggacauccgcgggcucacacaggaugacgccgcuaccuacuuuugugccagacaaaaguucgcuagccgguauucuggagaucagggcuccuacuuugaccuguggggccgcgggacacuuauuguugugagcucu

SEQ ID NO: 41723 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugaucugagacaccggauuucccucacccgcgacagagaucuguucacagcucauauggacauccggggacuuacccagggcgauacagccaccuacuuuugugcccgccaaaaauucgaaucuagauauacaggcgggcagggaugguacuuugaccuguggggccgggggacccacauuguugugagcucc

SEQ ID NO: 41724 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcugauuguugugucuagc

SEQ ID NO: 41725 - RNA, 384 nt, Artificial Sequence
  derived and/or modified sequence opt5 from anti-HIV-1_HeavyChain
agccacgaccuggagcaguccggcucugccaugaagaaacccggggcuagcgugagagucuccugcuggaccucugaagauaucuucgacacaacggagcucauuuacuggguucggcaagccccuggacagggccuggaauggaucgggugggugaagauugugagcggaaccgucaacuuugcgucccuugauuuccgcaauagaaucucucugagccgggaccgcgaucucuccacagcuuauauggacauuagaggccugacccaggaugacacagccaccuacuuuugugcccggcagaaauucgcuagccgcuauucuggggaucaaggauccuacuuugaccuuuggggcagaggcacacugaucgugguuagcucu

SEQ ID NO: 41726 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucacgggcgcugugaacuuugggucucuggauuucagacaccggauuagccucacccgcgacagagaucuguuuacagcccauauggacauccggggacuuacccagggcgauacagccaccuacuucugugcucgccaaaaauuugaauccagauauacaggcgggcagggaugguacuucgaccuguggggccgggggacccacauuguugugucuagc

SEQ ID NO: 41727 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugcuuccagauauucuggcgaucaggggagcuacuucgaccuguggggacggggcacccuuaucguggucuccagc

SEQ ID NO: 41728 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcucauaugggcauuagagggcuccggcaggaugacaccgccacauauuuuugugcccgccaaaaauucgagucuagauacuccggagaucagggcagcuauuuugaccuguggggccgggggacccuuaucaucgugucuucc

SEQ ID NO: 41729 - RNA, 384 nt, Artificial Sequence
  derived and/or modified sequence opt5 from anti-HIV-1_HeavyChain
gaggugcagcugguccaaagcggcgccgacguuaagaaacccggggcuuccgugagagugucuugcuggaccagcgaagauaucuucgacacaacggagcucauuuacuggguccggcaggccccuggacagggccuggaauggaucgggugggugaagauuguuuccggaaccgugaacuuugcgucucuugauuuccgcaauagaaucagccugucccgggaccgcgaucucucuacagcuuauauggacauuagaggccugacccaggaugacacagccaccuacuuuugugcccggcaaaaauucgcuagccgcuauuccggggaucagggaagcuacuuugaccuuuggggcagaggcacacugaucgucgugucuucc

SEQ ID NO: 41730 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcaccaggccccuggccaggggcuggaguggaucggaugggugaagacagucacgggcgcggugaacuuugggagccuugauuuccgccauagaauuucccugacccgggaccgcgaucucuuuacagcucacauggacaucagaggacugacccagggcgauacagccaccuacuucugugcccggcaaaaauuugaaucucgcuauacaggcgggcagggaugguacuucgaccuuuggggcagagggacccauauuguugugagcucc

SEQ ID NO: 41731 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgcucucuccacagcccauauggacauuagaggccugacccaggaugacacagccaccuauuuuugugcucggcaaaaauucgccagccgcuacucuggggaucagggauccuauuuugaccuuuggggcagaggcacacugaucaucgugagcucu

SEQ ID NO: 41732 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugcuagccuugauuucagaaaucggauuucccugucucgcgacagagaucucagcaccgccuacauggacauccgggggcugacacaggaugacaccgccacauauuuuugugcucgccaaaaauucgccuccagauacagcggagaucagggcucuuauuuugaccuuuggggccgggggacccugauuguuguguccagc

SEQ ID NO: 41733 - RNA, 384 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaaacuugugagcggagcugucaacuuugccucccuggauuucagaaaucggaucucucucagccgcgacagagaucuguccacagccuauauggacauucggggccuuacgcaggaugacaccgcuacauacuuuugugcccgccagaaguucgcuagcagauauucuggggaucaaggauccuacuuugaccuguggggccggggcacccucaucgugguuagcucu

SEQ ID NO: 41734 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccaggaugacacagccaccuacuucugugcccgccaaaaauuugcuucuagauauagcggcgaucagggcuccuacuucgaccuuugggggcggggaacacugauuaucguuagcucu

SEQ ID NO: 41735 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccugggguggaucggaugggugaagauugugagcggcaccgucaacuuugcgucccuugacuuccgcucuagaaucagccugucccgggaucgcgaccucagcacagcuuauauggauauuagagggcugacccaggacgauacagccaccuacuuuugugcccggcaaaaauucgcuucucgcuauuccggagaccagggcagcuacuuugaucuuuggggcagagggacacugaucgugguuucuucc

SEQ ID NO: 41736 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggcgaagacggugaccggcgcugucaacuuugggucucuugauuucagacaccggauuagccugacacgcgacagagaucucuuuaccgcccauauggacauccggggacugacacagggcgauaccgccacauacuucugugcucgccaaaaauuugaauccagauauaccggcgggcagggaugguacuucgaccuuuggggccgggggacgcacauugugguuucuagc

SEQ ID NO: 41737 - RNA, 384 nt, Artificial Sequence
  derived and/or modified sequence opt5 from anti-HIV-1_HeavyChain
caggcccaccuggagcaaagcggcuccgcuaugaagaaacccggggccucugugagagucagcugcuggaccuccgaagacaucuucgagcggacagaacucauuuacuggguucgccaggcgccuggaagaggccuggaguggaucgggugggugaagacggugucuggaaccgucaacuuuggcagcuccgauuuccggaaucgcauuucucuuacaagagaccgggaucugagcaccgcucauauggacauccgcgggcucacacaggaugacaccgccacauauuuuugugccagacagaaauucgaaucccuguacagcgaugaccaaggaucuuauuuugaucuuuggggccggggcacccugauuaucguguccagc

SEQ ID NO: 41738 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuuggcucccuugacuuccgccauagaaucucucugacacgggaucgcgaccucuuuaccgcgcacauggauauuagagggcugacacagggagacaccgcuacauauuucugugcccggcaaaaauuugagagccgcuacaccggcggccaggggugguauuucgaucuuuggggaagaggcacgcauaucgugguuuccagc

SEQ ID NO: 41739 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgauacaacggagcugauuuacugggugcggcaggcccccggccaggggcuugaauggaucggaugggugaagauugucucuggcaccgugaacuuugcgagccuggacuuccgcaauagaaucucccucucucgggaucgcgaccugagcacagcuuauauggauauuagagggcuuacccaggacgauacagccaccuacuuuugugcccggcaaaaauucgcuucccgcuauagcggagaccagggcucuuacuuugaucuguggggcagagggacacucaucguuguguccagc

SEQ ID NO: 41740 - RNA, 384 nt, Artificial Sequence
  derived and/or modified sequence opt5 from anti-HIV-1_HeavyChain
agccacaaccuggagcaguccggcucugccaugaagaaacccggggcuagcgugagagucuccugcuggaccucugaagacaucuucgauacaacggagcucauuuacuggguucggcaagccccuggacagggccuggaauggaucgggugggugaagauugugagcggaaccgucaauuuugcgucccuugacuuccgcaacagaaucucucugagccgggaucgcgaccucuccacagcuuauauggauauuagaggccugacccaggacgauacagccaccuacuuuugugcccggcagaaauucgcuagccgcuauucuggggaccaaggauccuacuuugaucuuuggggcagaggcacacugaucgugguuagcucu

SEQ ID NO: 41741 - RNA, 384 nt, Artificial Sequence
  derived and/or modified sequence opt5 from anti-HIV-1_HeavyChain
agccacaccuggaacaauagaggcuccgccaugaagaaacccggggcuucugugcgggucagcugcuggacauccgaggacaucuucgaacgcacggagcugauuuacuggguuagacaggccccuggacggggccucgaauggaucgggugggugaagaccgugucuggaacagucaacuuuggcagcuccgauuuccgcaauagaauuucucugagccgggaccgcgaucuuuccaccgcgcauauggacaucagagggcugacacaagaugacaccgcuacauauuuuugugcccggcagaaauucgccagccgcuacucuggagaucagggcuccuauuuugaccucuggggcagagggacccugauuaucgugagcucu

SEQ ID NO: 41742 - RNA, 384 nt, Artificial Sequence
  derived and/or modified sequence opt5 from anti-HIV-1_HeavyChain
agccacaccuggaacgaguccggcucugccaugaagaaacccggggcuagcgugagagucuccugcuggacaucugaagacaucuucgagcggacggaacugauuuacuggguucgccaggccccuggaagaggccucgaguggaucgggugggugaagauugugagcggaaccgucaauuuugcgucccuggauuuccggaaccgcaucucucuuagcagagaccgggaucuguccacagcuuauauggacauucgcggccucacccaagaugacacagccaccuacuuuugugccagacagaaauucgcuagccgguauucuggggaucagggauccuacuuugaccuguggggccgcggcacacuuaucgugguuagcucu

SEQ ID NO: 41743 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaacuacgggucucugaauuuucggagccgcauuucccuuaccagagaucgggaccuguucacagcgcacauggauauccgcggacucacccagggcgacacagcuaccuauuuuugugccagacagaaauucgaaucucgguacacgggcgggcaaggaugguauuuugaucuguggggccgcgggacccauauuguugugagcucc

SEQ ID NO: 41744 - RNA, 384 nt, Artificial Sequence
  derived and/or modified sequence opt5 from anti-HIV-1_HeavyChain
caggcccaccuggagcaaagcggcuccggggugaagaaacccggagcuucugucaagguuagcugcuggaccuccgaagacaucuucgagagaacagaacucauucauugggugcggcaggccccuggccaggggcuggaguggaucggaugggugaaaacggucaccggcgcggugaacuuugggucucuugauuuccgccacagaauuagccugacacgggaccgcgaucucuuuaccgcucauauggacaucagaggacugacacagggcgauaccgccacauacuucugugcccggcaaaaguuugaaucccgcuauaccggcgggcagggaugguacuucgaccuuuggggcagagggacgcacauuguugugucuagc

SEQ ID NO: 41745 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccugucuacagccuauauggauauuagaggccucacccaggacgauacagccaccuacuuuugugcucggcaaaaauucgccagccgcuauuccggcgaccaggggagcuacuuugaucuguggggaagaggcacacuuaucguggucucuucc

SEQ ID NO: 41746 - RNA, 384 nt, Artificial Sequence
  derived and/or modified sequence opt5 from anti-HIV-1_HeavyChain
ggccacgaccuggagcagagcggguccggagugaagaaacccggcgccucugucagaguuagcugcuggaccuccgaagauaucuucgaggggucugaacucauucauugggugcggcaagcuccuggacagggccuggaguggaucgggugggugaagacagucacgggagccgugaacuuuggcagcgcguacuuccgccacagaauuucccuuucucgggaccgcgaucugagcaccgcuuauauggacaucagaggccucacacaggaugacaccgccacauacuuuugugcccggcagaaauucgcuucccgcuauagcggggaucaaggaucuuacuuugaccuguggggcagagggacccuuauuguuguguccagc

SEQ ID NO: 41747 - RNA, 384 nt, Artificial Sequence
  derived and/or modified sequence opt5 from anti-HIV-1_HeavyChain
agccacaccuggaacaauagaggcuccgccaugaagaaacccggggcuucugugcgggucagcugcuggacauccgaggacaucuucgauacgaccgaacugauuuacuggguucgccaggccccuggacaaggccucgaguggaucgggugggugaagacagugucuggaaccgucaacuuuggcagcuccgacuucagaaaucggauuucucugacacgcgauagagaccuuagcaccgcgcauauggauauccgggggcugacacaggacgauaccgcuacguauuuuugugcccgccagaaauucgaaucccucuacagcgacgaucagggaucuuauuuugaccuguggggcagaggcacccuuauuaucguguccagc

SEQ ID NO: 41748 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucucuggcgccgugaacuuugggagcccgaauuuccggcaccgcguuucccugacaagagaucgggaccuuuuuaccgcgcauauggauauucgcggacugacacagggcgacaccgcuacauacuucugugccagacagaaauuugaaucucgguauaccggcgggcaaggaugguacuucgaucucuggggccgcgggacgcacaucguggucagcucc

SEQ ID NO: 41749 - RNA, 384 nt, Artificial Sequence
  derived and/or modified sequence opt5 from anti-HIV-1_HeavyChain
agccacaccuggaacaauagaggcuccgccaugaagaaacccggggcuucugugcgggucagcugcuggacauccgaggacaucuucgaacgcacggagcugauuuacuggguuagacaggccccuggacggggccucgaauggaucgggugggugaagaccgugucuggaacagucaacuuuggcagcuccgauuuccgcaauagaauuucucugacccgggaccgcgaucuuagcacagcgcauauggacaucagagggcugacccaagaugacacagcuaccuauuuuugugcccggcagaaauucgagucccucuacagcgaugaccagggaucuuauuuugaucuguggggccgcggcacgcuuauuaucguguccagc

SEQ ID NO: 41750 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugccucgccucugaagacaucuucgauaccacagagcugauuuacuggguucggcaggcgccuggacagggccuugaauggaucgggugggugaagauugugagcggaacggucaacuuugcuucccuggacuuccgcaauagaaucucucucagccgggaucgcgaccuguccaccgccuauauggauauuagaggccuuacacaggacgauaccgccacauacuuuugugcucggcaaaaauucgccagccgcuauucuggggaccagggauccuacuuugaucuguggggcagaggcacccucaucgugguuagcucu

SEQ ID NO: 41751 - RNA, 384 nt, Artificial Sequence
  derived and/or modified sequence opt5 from anti-HIV-1_HeavyChain
cagagccaccuggagcaauccggcgccgcuaugaagaaacccggggccucugugagagucagcugcuggaccuccgaagacaucuucgauacaacggagcucauuuacuggguucggcaggcgccuggacagggccuggaauggaucgggugggugaagauugugucuggaaccgucaacuuugcuagccuugacuuccgcaauagaaucucccugucucgggaucgcgaccucagcacagcccauauggauauuagaggccugcggcaggacgauaccgccacauauuuuugugcucgccaaaaauucgaguccagauacagcggggaccagggaucuuauuuugaucuuuggggccggggcacccugaucaucguguccagc

SEQ ID NO: 41752 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagaagucugaacugauucauugggugcgccaagcuccuggccaggggcucgaguggaucggaugggugaaaacggucaccggcgccgugaacuuugggagcuccgauuucagacagcggguuucucugacacgcgacagagaucuuuuuaccgcgcacauggacauucggggacugacacagggcgauaccgcuacauacuucugugcccgccaaaaguuugaaagcagauauaccggcgggcagggaugguacuucgaccucuggggccgggggacgcauaucguggucuccagc

SEQ ID NO: 41753 - RNA, 384 nt, Artificial Sequence
  derived and/or modified sequence opt5 from anti-HIV-1_HeavyChain
agccacaccuggaacgaguccggcucugccaugaagaaacccggggcuagcgugagagucuccugcuggacaucugaagacaucuucgauacgaccgagcugauuuacuggguucggcaggccccuggacaaggccucgaauggaucgggugggugaagauugugagcggaacagucaauuuugcgucccuggacuuccgcaacagaaucucucuuagccgggaucgcgaccuguccaccgcuuauauggauauuagaggccucacacaggacgauaccgccacauacuuuugugcccggcagaaauucgcuagccgcuauucuggggaccagggauccuacuuugaucuguggggcagaggcacccuuaucgugguuagcucu

SEQ ID NO: 41754 - RNA, 384 nt, Artificial Sequence
  derived and/or modified sequence opt5 from anti-HIV-1_HeavyChain
agacacaccuggaacgagagcggcuccggggugaagaaacccggagccucuguccggguuagcugcugguccucugaagacaucuucgagcgcacagaacugauucauugggugagacaggcuccuggccgggggcucgaguggaucggaugggugaagacggucagcggcaccgugaauuuuggguccucugauuuccgcaacagaauuagccugacacgggaccgcgaucuuuccaccgcccacauggacaucagaggacugacacaagaugacaccgcgacauacuuuugugcucggcagaaauucgaaagccucuauucugaugaccagggcuccuacuuugaucuguggggccgcgggacccuuauuaucguuagcucu

SEQ ID NO: 41755 - RNA, 384 nt, Artificial Sequence
  derived and/or modified sequence opt5 from anti-HIV-1_HeavyChain
cagagccaccuggagcaauccggcucugaaaugaagaaacccggggccagcgugagagucuccugcuggaccucugaggacaucuucgauacaacggaacucauuuacuggguucggcaggcuccuggacagggccuggaguggaucgggugggugaagauugugagcggaaccgucaacuuugccucccuugacuuccgcaauagaaucucucugagccgggaucgcgaccucuccacagcguauauggauauuagaggccugacccaggacgauacagcuaccuacuuuugugcccggcaaaaauucgccagccgcuauucuggggaccagggauccuacuuugaucuuuggggcagaggcacacugaucgugguuagcucu

SEQ ID NO: 41756 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcaccgugaacuuugggucucugaauuuccggcagcgcguuagccuuacaagagaucgggaccuguuuaccgcccacauggauauucgcggacucacacagggcgacaccgcgacguacuucugugcuagacaaaaauuugaaucccuguauucugaugaccagggcagcuacuucgaucuuugggggcggggaacccugaucauuguguccagc

SEQ ID NO: 41757 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagccagauuuucagacaccggaucucccuuacccgcgauagagaccuguuuacagcucauauggauauucggggacucacccaaggcgacacagccaccuacuucugugcccgccagaaauuugaaucuagauauacaggcgggcagggaugguacuucgaucuguggggccgggggacccacaucguugugagcucc

SEQ ID NO: 41758 - RNA, 384 nt, Artificial Sequence
  derived and/or modified sequence opt5 from anti-HIV-1_HeavyChain
agccacaccuggaacaaguccggcucugccaugaaaaagcccggggcuagcgugagagucuccugcuggacaucugaggacaucuucgaacggacggagcugauuuacuggguucgccaggccccuggaagaggccucgaauggaucgggugggugaaaaccgugagcggaacagucaauuuuggcuccucugauuuccggaaccgcauuagccugaccagagaccgggaucuuuccacagcgcauauggacauccgcgggcugacccaagaugacacagcuaccuauuuuugugccagacagaaguucgagagccucuacucugaugaccagggauccuauuuugaucuguggggccggggcacgcuuauuaucgugagcucu

SEQ ID NO: 41759 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccagauuuucagacaccggaucucccuuacccgcgauagagaccuguuuacagcucauauggauauucggggacucacccaaggcgacacagccaccuacuucugugcccgccagaaauuugaaucuagauauacaggcgggcagggaugguacuucgaucuguggggccgggggccgacccuuuuuguuagcucc

SEQ ID NO: 41760 - RNA, 384 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaagacauguagcggagcugugaacuuuggcuccgucgauuucagagaccgggugucucuuacgcgcgauagagaccuguuuaccgcccauauggauauccgggggcucacacagggagacaccgccacauauuucugcgcucgccagaaauuugaaagcagauacaccggcggccaagggugguauuucgaucuguggggacggggcacacacauuguuguguccagc

SEQ ID NO: 41761 - RNA, 384 nt, Artificial Sequence
  derived and/or modified sequence opt5 from anti-HIV-1_HeavyChain
agccacaccguggagcaguccggcucugccaugaagaaacccggggcuagcgucagaguuuccugcuggacaucugaagacaucuucgauacgaccgagcugauuuacugggugcggcaagccccuggacagggccucgaauggaucgggugggugaagauugucagcggaacagugaacuuugcgucccuggacuuccgcaauagaaucucucuuagccgggaucgcgaccuguccaccgcuuauauggauauuagaggccucacacaggacgauaccgccacauacuuuugugcccggcagaaauucgcuagccgcuauucuggggaccaaggauccuacuuugaucuguggggcagaggcacccuuaucguugugagcucu

SEQ ID NO: 41762 - RNA, 384 nt, Artificial Sequence
  derived and/or modified sequence opt5 from anti-HIV-1_HeavyChain
agacacaccuggaacaagagcggcuccggggugaaaaagcccggagccucuguccggguuagcugcugguccucugaggacaucuucgaacgcacagagcugauucauugggugagacaggcuccuggccaagggcucgaauggaucggaugggugaaaacggucaccggcgccgugaauuuugggagccuggauuuccggcaccgcauuucccuuacaagagaccgggaucuguuuaccgcgcauauggacauccgcggacucacacagggcgauaccgcuacauacuucugugccagacagaaguuugagucucgguauaccggcgggcagggaugguacuucgaccuguggggccgcgggacgcacauuguugugagcucc

SEQ ID NO: 41763 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccagagacuggaguggaucgggugggugaagacggucaccggagcggugaacuuuggcucuccgaauuuccggcaccgcguuagccuuacaagagaucgggaccuguccaccgcuuacauggauauucgcgggcucacacaggacgauaccgccacauauuuuugugccagacaaaaauucgcuucucgguacagcggagaccagggcuccuauuuugaucuguggggccgcgggacccuuaucguggucagcucu

SEQ ID NO: 41764 - RNA, 384 nt, Artificial Sequence
  derived and/or modified sequence opt5 from anti-HIV-1_HeavyChain
agccacgaccuggagcaguccggcucugccaugaagaaacccggggcuagcgugagagucuccugcuggaccucugaagauaucuucgacacaacggagcucauuuacuggguucggcaagccccuggacagggccuggaauggaucgggugggugaagauugugagcggaaccgucaacuuugcgucccuugauuuccgcaauagaaucucucugagccgggaccgcgaucucuccacagcucauauggacauuagaggccugcggcaggaugacaccgccacauauuuuugugcccgccagaaauucgagagcagauacucuggggaucaaggauccuauuuugaccuuuggggccggggcacccugaucaucgugagcucu

SEQ ID NO: 41765 - RNA, 384 nt, Artificial Sequence
  derived and/or modified sequence opt5 from anti-HIV-1_HeavyChain
agacacaccuggaacgagagcggcuccggggugaagaaacccggagccucuguccggguuagcugcugguccucugaagacaucuucgagcgcacagaacugauucauugggugagacaggcuccuggccaagggcucgaguggaucggaugggugaagacggucaccggcgccgugaauuuugggagccuggauuuccggcaccgcauuucccuuacaagagaccgggaucuguuuaccgcgcauauggacauccgcggacucacacagggcgauaccacaaccuacuucugugcuagacagaaauuugaaucucgguauacgggcgggcagggaugguacuucgaccuguggggccgcgggacccacauuguugugagcucc

SEQ ID NO: 41766 - RNA, 384 nt, Artificial Sequence
  derived and/or modified sequence opt5 from anti-HIV-1_HeavyChain
agacacaccugggaacagguguggagcggcgucaagaaacccggggccuccguucgggugucuugcuggagcuccgaggacaucuucgagcgcacagaacugauucauugggugagacaagcuccuggacagggccucgaguggaucgggugggucaagacggugaccggagccguuaacuuuggcucucuggauuuccggcaccgcauuagccuuacaagagaccgggaucuguuuaccgcgcauauggacauccgcgggcucacacagggagauaccgcuacauacuucugugccagacagaaauuugaaucccgguauaccggcggccaagggugguacuucgaccuguggggacgcggcacgcacauuguggucucuagc

SEQ ID NO: 41767 - RNA, 384 nt, Artificial Sequence
  derived and/or modified sequence opt5 from anti-HIV-1_HeavyChain
cagagccaccuggagcaauccggcucugccaugaagaaacccggggcuagcgugaccgucuccugcuggacaucugaagacaucuucgauacgaccgagcucauuuacuggguuagacaggccccuggacagggccuggaauggaucgggugggugaagauugugagcggaacagucaacuuugcgucccuugacuuccggaaucgcaucucucugagcagagaucgggaccucuccaccgcuuauauggauauucgcggccugacacaggacgauaccgccacauacuuuugugccagacaaaaauucgcuagccgguauucuggggaccagggauccuacuuugaucuuuggggccgcggcacccugaucgugguuagcucu

SEQ ID NO: 41768 - RNA, 384 nt, Artificial Sequence
  derived and/or modified sequence opt5 from anti-HIV-1_HeavyChain
agacacgaccuggagcagagcggcuccggggugaagaaacccggagccucuguccggguuagcugcugguccucugaagauaucuucgagcgcaccgaacucauucauugggugagacaagcuccuggccaggggcuggaguggaucggaugggugaagacagucacgggcgccgugaacuuugggagccuugacuuccggcaccgcauuucccugaccagagaucgggaccucuuuacagcgcauauggauauccgcggacugacccagggcgacacagcuaccuacuucugugccagacagaaauuugaaucucgguauacaggcgggcaaggaugguacuucgaucuuuggggccgcgggacccacauuguugugagcucc

SEQ ID NO: 41769 - RNA, 384 nt, Artificial Sequence
  derived and/or modified sequence opt5 from anti-HIV-1_HeavyChain
gugaccacauggaacaagagcggcuccgccaugaaaaagcccggggcuucugucagaguuagcugcuggacguccgaggacaucuucgauaccacagaacugauuuacugggugcggcaggccccuggacgcggccucgaguggaucgggugggugaaaaccgucucuggaacagugaauuuuggcagcuccgacuucagaaaccggauuucucugacccgcgauagagaccuuagcacagcgcacauggauauccgggggcugacccaagacgauacggcuaccuauuuuugugcccgccagaaguucgaaucccucuacagcgacgaucagggaucuuauuuugaccuguggggcagaggcacacuuauuaucguuuccagc

SEQ ID NO: 41770 - RNA, 384 nt, Artificial Sequence
  derived and/or modified sequence opt5 from anti-HIV-1_HeavyChain
agacacaccuggaacaauacaggcagcggggugaagaaacccggagccuccguccggguuucuugccuggcuagcgaggacaucuucgaacgcacggagcucauucauugggugagacaggccccuggccaagggcuggaauggaucggaugggugaagaccgucacaggcgcggugaacuuugggucccuugauuuccggcaccgcauuucucugaccagagaccgggaucucuuuacagcucauauggacauccgcggacugacccagggcgauacagccaccuacuucugugccagacagaaauuugagagccgguauacgggcgggcagggaugguacuucgaccuuuggggccgcgggacccacauuguuguguccucu

SEQ ID NO: 41771 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugccucgccucugaagacaucuucgagcggaccgaacugauuuacuggguucgccaggcgccuggaagaggcccggaguggaucgggugggugaagacagugagcggaacggucaacuuuggcuccucugauuuccggaaucgcauuagccuuaccagagaccgggaucuguccacagcucauauggacauccgcgggcucacccaggaugacacagccaccuauuuuugugccagacagaaauucgaaagccuguacucugaugaccaaggauccuauuuugaucuuuggggccggggcacacugauuaucgugagcucu

SEQ ID NO: 41772 - RNA, 384 nt, Artificial Sequence
  derived and/or modified sequence opt5 from anti-HIV-1_HeavyChain
agacacaccuggaacaauacaggcagcggggugaagaaacccggagccuccguccggguuucuugcuggacgagcgacgauaucuucgagcgcaccgaacugauucauugggugagacaggcuccuggccaagggcucgaguggaucggaugggugaagacagucuccggcaccgugaacuuugccucucuggacuuccggaaucgcauuagccuuuccagagaucgggaccugucuacagcguacauggauauccgcgggcucacccaggacgauacagcuaccuauuuuugugccagacagaaauucgccagccgguacuccggagaccagggcagcuauuuugaucuguggggccgcgggacgcuuauuguugugucuucc

SEQ ID NO: 41773 - RNA, 384 nt, Artificial Sequence
  derived and/or modified sequence opt5 from anti-HIV-1_HeavyChain
ggcacccccgggaacaagagcggauccggcgugaaaaagccuggggccucugucagaguuagcugcugguccucugaggacaucuucgaacggacagagcugauucacugggugcgccaggcuccgggacaaggccucgaauggaucgggugggugaaaacggucaccggagccgugaauuuuggcagccuggauuucagacaucggauuucccuuacacgcgacagagaucuguuuaccgcgcacauggacauccggggccucacacagggggauaccgcuacauacuucugugcccgccagaaguuugagucuagauauaccggaggccaggggugguacuucgaccuguggggacggggcacgcauauuguugugagcucc

SEQ ID NO: 41774 - RNA, 384 nt, Artificial Sequence
  derived and/or modified sequence opt5 from anti-HIV-1_HeavyChain
ggcacccccgggagcgaguccggaucuggcgugaagagaccuggggccagcguccggguuuccugcuggacaucugaagacaucuucgagacgaccgaacugauucacugggugcgccaggcuccgggacaaggccucgaguggaucgggugggugaaaacagucagcggagccgugaacuuuggcucccugaauuucagacaucggguuucucuuacccgcgauagagaccuguuuacagcgcacauggauauucggggccucacccagggggacacagcuaccuacuucugugcccgccagaaguuugaaagcagauauacgggaggccaggggugguacuucgaucuguggggacggggcacccauaucguggucuccagc

SEQ ID NO: 41775 - RNA, 384 nt, Artificial Sequence
  derived and/or modified sequence opt5 from anti-HIV-1_HeavyChain
gugacccccggcacaaaccuggggcucagaaugaagaaaccuggagccagcguccggguuuccugcuggacgucugaggacaucuucgauaccacagaacugauuuacugggugcgccaggcuccgggccaagggcuugaguggaucggaugggugaagauugucagcggcaccgugaauuuugccucccuggacuucagaaaccggaucucucucagccgcgauagagaccuguccacagcguauauggauauucgggggcuuacccaggacgauacagcuaccuacuuuugugcccgccagaaauucgccucuagauauagcggagaccagggcuccuacuuugaucuguggggccgggggacgcucaucguugugagcucu

SEQ ID NO: 41776 - RNA, 384 nt, Artificial Sequence
  derived and/or modified sequence opt5 from anti-HIV-1_HeavyChain
agacacgaccuggagcagagcggcgccggggugaagaaacccggagcuuccguccggguuucuugcuggagcuccgaagauaucuucgagcgcaccgaacucauucauugggugagacaagccccuggccaggggcuggaguggaucggaugggugaagacagucacgggcgcggugaacuuugggucucuugacuuccggcaccgcauuagccugaccagagaucgggaccucuuuacagcucauauggauauccgcggacugacccagggcgacacagccaccuacuucugugccagacagaaauuugaaucccgguauacaggcgggcaaggaugguacuucgaucuuuggggccgcgggacccacauuguugugucuagc

SEQ ID NO: 41777 - RNA, 384 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagaagucugaacucauucauugggugcggcaggcuccuggccaggggcuggaguggaucggaugggucaaaacagugacgggcgccguuaacuuugggagcuccgauuuccgccagagagugucucuuaccccggaccgggaucuguuuacagcgcacauggacauucgcggacucacccaaggcgauacagcuaccuacuucugugccagacagaaguuugaaagccgguauacaggcgggcagggaugguacuucgaccuguggggccgcgggacccauaucgucguguccagc

SEQ ID NO: 41778 - RNA, 384 nt, Artificial Sequence
  derived and/or modified sequence opt5 from anti-HIV-1_HeavyChain
ggcaccacaugggagcagagcggguccggagugaagaaacccggcgccucugucagaguuagcugcuggacguccgaagacaucuucgagaagucugaacugauucacugggugcggcaagcuccugggcagggacucgaguggaucggcugggugaaaaccgucacaggggccgugaacuuuggaagccuggauuuccgccauagaauuucccuuacccgggaccgcgaucuguuuacagcgcacauggacaucagaggccucacccagggcgauacagcuaccuacuucugugcccggcagaaguuugaaucucgcuauaccgggggacaaggcugguacuucgaccugugggggagaggaacgcauauuguugugagcucc

SEQ ID NO: 41779 - RNA, 384 nt, Artificial Sequence
  derived and/or modified sequence opt5 from anti-HIV-1_HeavyChain
agccacgaccuggagcaguccggcucugaauggaagaaacccggggccagcgugagagucuccugcuggaccucugaggauaucuucgacacaacggaacucauucauuggguucggcaagcuccuggacagggccuggaguggaucgggugggugaagaccgugacaggagccgucaacuuuggcagccuugauuuccgccacagaauuucccugacccgggaccgcgaucucuuuacagcgcauauggacaucagagggcugacccagggagauacagcuaccuacuucugugcccggcagaaauuugaaucucgcuauacgggcggccaagggugguacuucgaccuuuggggaagaggcacccacauugugguuagcucc

SEQ ID NO: 41780 - RNA, 384 nt, Artificial Sequence
  derived and/or modified sequence opt5 from anti-HIV-1_HeavyChain
cagagcagacccggcaacaaguccgggucugccaugaaaaagccuggagcuagcgugcgggucuccugcuggaccucugaggacaucuucgaacgcacagagcugcucuggguuagacaagccccgggccgggggcuggaauggauuggaugggugaaaacggugagcggcaccgucaauuuuggguccucugauuuccgcaacagaaucagccuuacacgggaccgcgaucuguccaccgcgcacauggacauuagaggacucacacaggaugacaccgcuacauacuuuugugcccggcagaaguucgagagccuguauucugaugaccagggcuccuacuuugaucuuuggggccgcgggacccugaucauugugagcucu

SEQ ID NO: 41781 - RNA, 384 nt, Artificial Sequence
  derived and/or modified sequence opt5 from anti-HIV-1_HeavyChain
ggcaccacauggagcaaguccgggucuggagugaaaaagcccggcgccagcgucagaguuuccugcuggacgucugaggacaucuucgaacggaccgagcugauuuacugggugcgccaggcuccugggcaaggacucgaauggaucggcugggugaaaauugucagcgggacagugaacuuugccucccuggauuucagaaaucggaucucucuuagccgcgacagagaucuguccaccgcgcacauggacauucggggacucacacaggaugacaccgcuacauauuuuugugcccgccagaaguucgccagcagauacucuggcgaucagggcuccuauuuugaccugugggggcggggaacccuuaucaucguuagcucu

SEQ ID NO: 41782 - RNA, 387 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacauccuccggaagaaacgcguggauucugugggcugugacacagccccugggcagggacuggaguggauuggcugggucaagacggugaccggggcgguuaacuucggaagcuccgauuuuagacagcgggugucucuuacacgcgacagagaucuguucaccgcucauauggacauccggggccucacacaggaugacaccgccacauacuuuugcgcccgccaaaaauucgcuagcagauauuccggcgaucaggggagcuacuuugaccuguggggacggggcacccuuauugucgugucuucc

SEQ ID NO: 41783 - RNA, 387 nt, Artificial Sequence
  derived and/or modified sequence opt5 from anti-HIV-1_HeavyChain
aaggcccaccugggcaacaaaagcggguccggagugaagaaacccggcgcuucugucagaguuagcugcugguccucugaggacaucuucgaacggaccgagcucauucauugggugcgccaggccccugggcaaggacuggaauggaucggcugggugaagacagucacgggggcggugaauuuuggaagccuugauuucagacaccggauuucccugacccgcgacagagaucucuuuacagcucauauggacauccggggccugacccagggcgauacagccaccuacuucugugcccgccagaaauuugagucuagauauacagggggacagggcugguacuucgaccuuugggggcggggaacccacauuguugugagcucc

SEQ ID NO: 41784 - RNA, 384 nt, Artificial Sequence
  derived and/or modified sequence opt5 from anti-HIV-1_HeavyChain
accacagugggcacgauccuggggagagccaugaagaaacccggagcuagcguccggguuuccugcuggaccucugaggacauuuucgauacaaccgaacucaucuacugggugcgccaggccccuggccaagggcuggaguggauuggaugggugaagaucgucagcggcacagugaacuuugcgucccuugacuucagaaaucggauuucucugagccgcgauagagaccucuccaccgcuuauauggauauccgggggcugacacaggacgauaccgccacguacuuuugugcccgccagaaauucgcuucuagauauagcggagaccagggcuccuacuuugaucuuuggggccgggggacccugaucguugugagcucu

SEQ ID NO: 41785 - RNA, 384 nt, Artificial Sequence
  derived and/or modified sequence opt5 from anti-HIV-1_HeavyChain
cagagccaccuggagcaauccggcucugccaugaagaaacccggggcuagcgugaaggucuccugcuggaccucugaagacaucuucgauacaacggagcucauuuacuggguuagacaggccccuggacagggccuggaauggaucgggugggugaaaauugugagcggaaccgucaacuuugcgucccuugacuuccggaaucgcaucucucugagcagagaucgggaccucuccacagcuuauauggauauucgcggccugacccaggacgauacagccaccuacuuuugugccagacaaaaguucgcuagccgguauucuggggaccagggauccuacuuugaucuuuggggccgcggcacacugaucgugguuagcucu

SEQ ID NO: 41786 - RNA, 387 nt, Artificial Sequence
  derived and/or modified sequence opt5 from anti-HIV-1_HeavyChain
cagagccaccuggagcaagugugggucugccaguccaagaaacccggcgccucuguuagagugagcuguuggaccuccgaagacaucuucgauacaacggagcucauuuacugggugcggcaggcuccugggcagggacuggaauggaucggcugggucaagauugugucugggaccguuaacuuugccagccuugacuuccgcaauagaaucucccugucucgggaucgcgaccucagcacagcgcauauggauauuagaggacugacccaagacgauacagcuaccuauuuuugcgcccggcagaaauucgccucccgcuacagcggcgaccaggggucuuauuuugaucuuuggggaagaggcacacugaucaucguguccagc

SEQ ID NO: 41787 - RNA, 384 nt, Artificial Sequence
  derived and/or modified sequence opt5 from anti-HIV-1_HeavyChain
agacacaccguggagcagagcggcuccggggucaagaaacccggagccucuguucgggugagcugcugguccucugaagacaucuucgagcgcacagaacugauucauugggugagacaagcuccuggccaggggcucgaguggaugggaugggucaagacggugaccggcgccguuaacuuugggagccuggauuuccggcaccgcaucucccuuacaagagaccgggaucuguuuaccgcgcauauggacauucgcggacucacacagggcgauaccgcuacauacuucugugccagacagaaauuugaaucucgguauaccggcgggcaaggaugguacuucgaccuguggggccgcgggacgcacaucguggucagcucc

SEQ ID NO: 41788 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcucugcccgggaagacaucuucgauaccacagagcucauuuacuggguucgccaggcgccuggacagggccuggaauggaucgggugggugaagauuguguguggaacggucaacuuugcuagccuugacuucagaaaucggaucucccugucucgcgauagagaccucagcaccgcccauauggauauucggggccugacacaggacgauaccgccacauauuuuugcgcucgccaaaaauucgccuccagauacagcggggaccagggaucuuauuuugaucuuuggggccggggcacccugaucaucguguccagc

SEQ ID NO: 41789 - RNA, 387 nt, Artificial Sequence
  derived and/or modified sequence opt5 from anti-HIV-1_HeavyChain
gaggugcagagaggcgggcgggucguuggacgcgacgugaagaaacccggcgccagcgugagagucuccugcuggaccucugaagauaucuuccacacagagcugauuuacugggugcggcaagcuccugggcagggacucgaauggaucggcuggguuaagauugugagcgggacggucaacuuugccucccuggacuuccgcaauagaaucucucuuagccgggaucgcgaccuguccaccgcguauauggauauuagaggacucacacaggacgauaccgcuacauacuuuugugcccggcagaaauucgccucucgcuauagcggcgaccaaggcuccuacuuugaucugugggggagaggaacccuuaucgugguuagcucu

SEQ ID NO: 41790 - RNA, 384 nt, Artificial Sequence
  derived and/or modified sequence opt5 from anti-HIV-1_HeavyChain
ggcaccacauggaacgagagcggguccggagugaagaaacccggcgccucugucagaguuccuugcuggagcuccgaagacaucuucgagcggacggaacugauucaccgcgugagacaggcuccggggcaaggacucgaguggaucggcugggugaagaccgucacaggggccgugaauuuuggaucucccaacuuccggcaucgcauuagccugaccagagaucgggaccuuuuuacagcgcacauggauauccgcggccugacccagggcgacacagcuaccuacuucugugccagacagaaauuugaaucccgguauaccgggggacagggcugguacuucgaucucugggggcgcggaacgcauauuguugugucuagc

SEQ ID NO: 41791 - RNA, 384 nt, Artificial Sequence
  derived and/or modified sequence opt5 from anti-HIV-1_HeavyChain
agaagcaacugggugcaguccggcgccgacgucaagaaacccggggcuucuguuaagagcuccugcuggaccucugaggauaucuucgacacaacggaacugauuuacugggugcggcaagccccuggacagggccucgaguggaucgggugggugaaaauugucagcggaaccgugaauuuugcgucccuggauuuccgcaacagaaucucucuuagccgggaccgcgaucuguccacagcuuauauggacauuagaggccucacccaggaugacacagccaccuacuuuugugcccggcagaaguucgcuagccgcuauucuggggaucaaggauccuacuuugaccuguggggcagaggcacacuuaucguugugagcucu

SEQ ID NO: 41792 - RNA, 384 nt, Artificial Sequence
  derived and/or modified sequence opt5 from anti-HIV-1_HeavyChain
cccgugcagcugguccaaagcggcgccgagguuaagaaaccuggggcuuccgugaaggugucuugcuggaccagcgaagacaucuucgagagaacagaacucauucacuggguccggcaggccccgggacagggccuggaguggaucgggugggugaaaacgguuaccggagcggugaacuuuggcucccuugauuuccgccauagaauuucucugacacgggaccgcgaucucuuuaccgcucacauggacaucagagggcugacacagggagauaccgccacauacuucugugcccggcaaaaguuugaaagccgcuauaccggcggccaggggugguacuucgaccuuuggggaagaggcacgcauauugucguguccucu

SEQ ID NO: 41793 - RNA, 399 nt, Artificial Sequence
  derived and/or modified sequence opt5 from anti-HIV-1_HeavyChain
agagaguaccuggaacagagcggcgggggagugaagaaacucggcgccuccguccggguuucuugccgcgcuagcgaggaccuguucggggaugaagccaucuaugacgaugagcuuauucacuggcugagacaagugcccggacagcggccugaauggaugggcuggauccgcccgaagaccggggcgagaaaccaggcucggcaguuucaaccccgcauuaaucucuccagagaccgggcccugaacacagccuaccuugaucugucuagccucacguccgcugacucugccaccuauuucugugcucgccagacauuuaaaccugauuucuacuuugccgaccagggauggagcuucaaucuguggggcagaggcgcgcgggugaucgucuccagc

SEQ ID NO: 41794 - RNA, 399 nt, Artificial Sequence
  derived and/or modified sequence opt5 from anti-HIV-1_HeavyChain
caggugcaacugguccagagcggcaccgagguuaagaaacccggggccucccucagagugucuugccgggcuagcgaagaccuguucggagauaagaucauuuacgacgaugaggugauccacuggcuucgccagcugccuggccagagaccggaauggaugggguggauucggcccaaauccggagcccgcaaccaagcgagacaguuucagccucggaucucucucacacgcgacagagcucugagcacggccuaucuugaucucaauucccugaccucugccgacagcggcacauacuucugugcucggcagaccuuuaagcccgauuucuauuuugccgaccaagggugguccuucaaccuguggggacgcggcgcucauuuuauugucagcucu

SEQ ID NO: 41795 - RNA, 399 nt, Artificial Sequence
  derived and/or modified sequence opt5 from anti-HIV-1_HeavyChain
caggcccaccuggagcaaagcggcuccggggugaagaaacccggagcuucugucagaguuagcugccgggccuccgaagaccucuucggcgaugagaucauuuacgacgaugaagugauccauuggcugcgccaggugccugggcagagaccggaguggaugggauggauucggcccaagaccggcgcgcgcaaccaggcuagacaauuucagccucggaucucucuuacacgcgacagagcccugagcacggccuaucucgaucuuaauucccugaccucugcugacagcgggacauacuucugugcccggcagaccuuuaaacccgauuucuauuuugcugaccagggaugguccuucaaccuguggggccgcggcgcccacuuuauugucagcucu

SEQ ID NO: 41796 - RNA, 399 nt, Artificial Sequence
  derived and/or modified sequence opt5 from anti-HIV-1_HeavyChain
ggcaacaucuggagcgaguccgggggaggcgugaagaaacccggggccucugucagaguuagcugccgggcuuccgaagaccuguucggagaugagauuaucuacgacgaugaagugauucacuggcuccgccaggugccuggccaaagaccggaguggaugggguggauccggcccaagaauggaggccgcaaccaggccagacaguuucagccucggauuucucugacccgcgacagagcgcuuaauacagcuuaucuggaucucaacagccugacguccgccgacucuggcaccuacuucugugcccggcaaacauuuaaacccgauuucuauuuugcugaccagggguggagcuucaaucuuuggggacgcggcgccagagucaucguguccagc

SEQ ID NO: 41797 - RNA, 399 nt, Artificial Sequence
  derived and/or modified sequence opt5 from anti-HIV-1_HeavyChain
caggugcaacugguccagagcggcgccgagguuaagaaacccggggcuucccucagagugccuugccgggccucugaagaccuguucggagaugagaucauuuacgacgaugaagugauccacuggcuucgccaggucccgggccagagacccgaguggaugggguggauucggccuaagaccggagcgcgcaaccaagcuagacaguuucagccccggaucagccugacacgcgacagagcccucuccacggccuaucuggaucuuaauucucugaccagcgcugacuccggcacauacuucugugcccggcagaccuuuaaaccugauuucuauuuugcugaccaaggguggucuuucaaccucuggggacgcggcgcccauuuuauugugagcucc

SEQ ID NO: 41798 - RNA, 390 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccucccgcagcgcu

SEQ ID NO: 41799 - RNA, 393 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacacgcucuacc

SEQ ID NO: 41800 - RNA, 414 nt, Artificial Sequence
  derived and/or modified sequence opt5 from anti-HIV-1_HeavyChain
caggugcaacugguccagagcggcgccgagguuaagaaacccggggcuuccgugaccgugucuugcaaggccagcagauacacauucaucaacuauuacauucacuggguccggcaggcgccuggacagggccucgaauggaucgggugggugaaaccgguuuccggagcugugaauuuuggcucucccaacuuccgccauagagucagccugacgcgggaccgcgaucuuuuuaccgcccacauggacauuagagggcugacacaaggagauaccgccacauauuucugugcucggcagaaguuugcccgcggcgaccagggcugguucuuugaucucugggggagaggaacccugaucgugguuuccucugcuagcacaaaaggcccuuccguguucccccaugaccuucgg

SEQ ID NO: 41801 - RNA, 414 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccaucacaagacacuauaugcauuggguccggcaggcgccuggccaggggcucgaauggauuggaugggugaagacgguuaccggcgcugugaacuucggguccccgaauuuucgccacagagucucucugacacgggaccgcgaucuuuucaccgcccauauggacaucagaggacugacacaaggcgauaccgccacauacuuuugugcucggcagaaauucgagcgcggcgggcagggaugguauuuugaccucuggggcagagggacccugauugugguuagcuccgccucuacgaagggacccagcguguucccucacgaucuucgg

SEQ ID NO: 41802 - RNA, 408 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcccgaauuuccgccacagaguuucccuuacccgggaucgcgaccuguuuacagcucauauggauauuagaggacucacccagggcgacacagccaccuacuucugugcccggcaaaaguauuacgcuggcgggcagggaugguauuuugaucuguggggccgcgggacacuuaucguggucucuagcgccuccaccaaaggacccagcgacgaucugaga

SEQ ID NO: 41803 - RNA, 411 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccuccacaaagggacccagcgucuaugaccugcgc

SEQ ID NO: 41804 - RNA, 417 nt, Artificial Sequence
  derived and/or modified sequence opt5 from anti-HIV-1_HeavyChain
caggugcaacugguccagagcggcuccgggguuaagaaacccggagccucugugagagugagcugcuggaccuccgaggacaucuucgaacggacagagcucauucacuggguccgccaggcuccuggccaggggcuggaauggaucggaugggugaagacgguuucuggcgccgugaacuuugggagcccgaauuucagacaucgggucucccuuacccgcgauagagaccuguuuacagcgcacauggauauucggggacucacccaaggcgacacagcuaccuacuucugugcccgccagaaauuugagagaggcgggcagggaugguauuucgaucuguggggccgggggacacuuaucgugguuucuagcgccuccaccaagggacccagcguguuuccucaugaccugcgc

SEQ ID NO: 41805 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcccgaauuuccgccacagaguuucccuuacccgggaucgcgaccuguuuacagcucauauggauauuagaggacucacccagggcgacacagccaccuacuucugugcccggcaaaaguuugaacgcggcgggcagggaugguauuucgaucuguggggcagagggacacuuaucguggucucuagcgcuuccaccaaaggacccagcguguuuccuacgauuuacguu

SEQ ID NO: 41806 - RNA, 417 nt, Artificial Sequence
  derived and/or modified sequence opt5 from anti-HIV-1_HeavyChain
caggugcaacuggagcagagcggcuccggggucaagaaacucggagccucuguuagagugagcugcuggaccuccgaagacaucuucgaggaugaacugauucacugggugcggcaggcucccggccaggggcuugaguggaucggaugggucaaggccgugucuggcgcgguuaacuacgggagccuggacuuucgccauagagugucccucacacgggaucgcgaccuguucacggcucacauggauauuagaggacuuacccaagacgauacagccaccuauuuuugugcccggcagaaauucgcucgcggcgaccagggcugguuuuucgaucugugggggagaggaacacucaucgucgugucuagcggccugcaucaggggccuauuggacugccgccccggcucucccgc

SEQ ID NO: 41807 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccagcccccgcgcucauagauccucuccuacaaucugcguc

SEQ ID NO: 41808 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuagcgauuucagacagcggguuucccuuacacgcgacagagaucuguuuaccgcucacauggacauucggggacucacacaaggcgauaccgccacauacuucugugcccgccagaaauuuuaugcuggcgggcagggaugguacuucgaccuguggggcagagggacccuuaucguggucucuagcgccuccacgaagggaccgagcguguuuccccaugaucugcgg

SEQ ID NO: 41809 - RNA, 414 nt, Artificial Sequence
  derived and/or modified sequence opt5 from anti-HIV-1_HeavyChain
caggugcaccugguccaaagcggcgccgagguuaagagacccggggcuuccgugaaagugucuugcaaggccagcggauacaccuucacagacuauuuuauccauuggguccggcaggcgccuggccaggggcucgaauggauuggaugggugaaaacgguuuccggcgcugugaacuucgggucucugaauuuucgccacagagucagccuuacccgggaucgcgaccuguucacagcccauauggauaucagaggacucacccagggcgacacagccaccuacuuuugugcucggcaaaaguucgcccgcggcgaucaggggugguuuuucgaccuguggggaagaggcacacuuauugugguuuccucugcuagcaccaaagggccguccguguuuccccacgaucugcgg

SEQ ID NO: 41810 - RNA, 420 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaucuucaccggcuccuauaugcacugggucagacaggcgccugggcagacauuugaauggcucggauggaugaagccggugacgggcgcuguuaacuacgcccggcaauuccaggggcgcgugucuuuuuauagaacccgggagcugggaauugccuacauggaccuucgcgaucugaaauucgacgauacagcugucuauuuuugugccagaaagaccaagggcgacgugagcggcgaugaccggggguucuuuuucgaucucuggggacgcggcacaagaguuaucguguccucugcuagcaccaaagggcccuccgucuuuccucaugaccugcgg

SEQ ID NO: 41811 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcccgaauuuccgccacagaguuucccuuacccgggaucgcgaccuguuuacagcucauauggauauuagaggacucacccagggcgacacagccaccuacuucugugcccggcaaaaguuugaacgcggcgggcagggaugguauuucgaucuguggggcagagggacacuuaucguggucucuagcgcuuccaccaaaggacccagcguguuuccucacgaccugcgg

SEQ ID NO: 41812 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcccgaauuuccgccacagaguuucccuuacccgggaucgcgaccuguuuacagcucauauggauauuagaggccucacccagggcgacacagccaccuacuucugugcccggcaaaaauuugaacgcgggggacagggcugguauuucgaucugugggggagaggaacacuuaucguggucucuagcgcuuccaccaagggccccagcguguuuccucacgaccugcgg

SEQ ID NO: 41813 - RNA, 420 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacaggcuauuacauccacugggucagacaggcgccugggcagggacucgaauggaugggcuggauuaaccccaauuccggggcuacgaacuaugcccaaaaguuucagggacggcugaccaucgcccgcgacacaucuauuagcaccgcuuacauggaucuuagaaaucugcgguucgacgauacagccguguauuuuugugcucgcaaaaccgccggcgacguuuccggcgauaacagaggguacuucuuugaccucuggggacggggcucucgcgugaucgucagcuccgcgagcacaaaggggccgucuguguucccucaugaucugaga

SEQ ID NO: 41814 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuucaugaucugaga

SEQ ID NO: 41815 - RNA, 414 nt, Artificial Sequence
  derived and/or modified sequence opt5 from anti-HIV-1_HeavyChain
caggccacccuggagcaaagcggcuccggggugaagaaacccggagcuucugucagaguuagcugcugguccucugaagacaucuucaagacagagcucauucacugggugcggcaggccccuggccaggggcuggaauggaucggaugggugaaagcggucagcggcgcugugaacuacgggucccuugauuuucgccauagaguuucucugacgcgggaccgcgaucucagcaccgcccacauggacauuagaggacugacacaggaugacaccgccacacauuucugugcucggcaaaaguuugcccgcggcgaucagggcugguucuuugaccuuugggggagaggaacccugaucguggucuccagcgcuucuacaaaaggcccguccguguuccccaccauuuauguu

SEQ ID NO: 41816 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucugcuagcacgaagggacccuccguguuuccuaccauuugcguu

SEQ ID NO: 41817 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggauggaucuucgaucuguggggccgggggacacuuauugcugugucuagcgccagcccccgcgcucacagauccucuccucgguccgcc

SEQ ID NO: 41818 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugagcgcggcgggcagggauggaucuucgaccuguggggcagagggacacuuauugcugugagcuccgccagcaccaaaggaccgucugucuuucccacgaucugcgug

SEQ ID NO: 41819 - RNA, 414 nt, Artificial Sequence
  derived and/or modified sequence opt5 from anti-HIV-1_HeavyChain
caggcccaccuggagcaaagcggccccggggugaagaaacucggagcuuccgucagaguuucuugcuggaccagcgaagacaucuucgagcggacagaacugauucauugggugcgccaggccccuggccaggggcuugaguggaucggaugggugaaggcggucuccggcgcugugaacuacgggucucuggauuuuagacaccggguuagccucacgcgcgacagagaucuguucaccgcccauauggacauucggggacuuacacaggaugacaccgccaucuauuuuugugcucgccaaaaauucgccagaggcgaucagggcugguuuuucgaccugugggggcggggaacacucauuguggucuccucugcuagcaccaaggcccaccgcuccagcccgagaucuaca

SEQ ID NO: 41820 - RNA, 420 nt, Artificial Sequence
  derived and/or modified sequence opt5 from anti-HIV-1_HeavyChain
caggugcaacugguccagagcggcgccgagaugaagaaacccggggcuuccguuaagcucucuugcaugaccagcggauacguguucacagacuuuuauauccacugggugagacaggccccuggccaggggcuggaauggaugggauggauuaacccgggcaccgggggaacgaucuccgcgccccgguuccuuggccgcgucacacugaccagagauacaucuauuagcgcugccuacaucgagauuaaucgggugaccaucgacgauacagccaccuauuuuugugcucgccaaaaauucgccuccagauacucuggcgaccaggggagcuauuuugaucucuggggacggggcacgcugaucguuguguccagcgcuucuaccaaggggccucuuggacugcccccucgcuccgcc

SEQ ID NO: 41821 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccccugaagacaucuucgagcggacagaacucauucauugggugcgccaggccccgggccaggggcuggaguggaucggaugggugaagauugucuccggcgcggugaacuuugggucucccaauuucagacagcggguuagccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcuguguccucugccagcccucgcgcucauagauccagcccccggucugcc

SEQ ID NO: 41822 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagccggucacgggcgcggugaaccuugcucccaauuuuagacaccggguuucucugacccgcgauagagaccucuucacagcccauauggauauucgggggcugacccagggagacacagccaccuacuuuugugcucgccaaaaauucgaaagaggcggccaggggugguauuuugaucuuuggggacggggcacacugaucguggucagcuccgccucuaccaaggggccuagcguguucccccacgaccuccgc

SEQ ID NO: 41823 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucagcacggcccauauggacauucggggacugacccaggaugacacagccaccuauuucugugcucgccaaaaauuugccagaggcgaucagggcugguucuuugaccuuugggggcggggaacacugaucguggucuccagcgcuucuaccaagggcccguccguguucccccacgaucuccgc

SEQ ID NO: 41824 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacagcggguuucccuuacccgcgauagagaccuguuuacagcucacauggauauucggggacucacccaaggcgacacagccaccuacuucugugcccgccagaaauuuuaugcuggcgggcagggaugguacuucgaucuguggggcagagggacacuuaucguggucucuagcgccuccaccaaggcucaucggagcucuccccgcuccacg

SEQ ID NO: 41825 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuucccacgauuugcguu

SEQ ID NO: 41826 - RNA, 414 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucaagacagagcugauucauugggugcggcaggcccccggccaggggcuugaauggaucggaugggugaaagcggucucuggcgcugugaacuacgggagccuggauuuucgccacagaguuucccucacgcgggaccgcgaucugucuaccgcccauauggacauuagaggacuuacacaggaugacaccgccacauauuucugugcucggcaaaaguuugcccgcggcgaucagggcugguucuuugaccugugggggagaggaacccucaucguggucagcuccgcuagcacaaaaggcccuucuguguucccgcacgaucugcgg

SEQ ID NO: 41827 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuucccacgauuuauguu

SEQ ID NO: 41828 - RNA, 417 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugccagaggcgaucaggggugguucuuugaccuguggggacggggcacgcuuaucguggucuccucugcuagcaccaaggggcccuccguguucccuacaauuugcguu

SEQ ID NO: 41829 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuuccccagauuuauguu

SEQ ID NO: 41830 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcagacaccuggccaggggcuggaguggaucggaugggugaaaacggucaccggcgccgugaacuuugggagcuccgauuuccgccagagaguuucucuuacacgggaccgcgaucuguuuaccgcgcacauggacauuagaggacucacacaaggcgauaccgcuacauacuucugugcccggcagaaguuuuaugccggcgggcagggaugguacuucgaccuguggggccgcgggacccuuaucguggucagcuccgcuagcacgaaaggaccgucuguguuucccaccauuuauguu

SEQ ID NO: 41831 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacaugggaauccggggccucacacaaggcgauaccgccacauacuucugugcccgccagaaauuugaaagagggggacagggcuggauuuucgaccugugggggcggggaacccuuaucgcugugucuagcgccuccacaaagggccccagcgucuuuccuaccaucuaugug

SEQ ID NO: 41832 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcguguuuccgcacgaucugcgc

SEQ ID NO: 41833 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggauggaucuucgaucuguggggccgggggacccuuauugcuguguccucugccagcacgaagggacccuccgucuuuccucgcagcgcugug

SEQ ID NO: 41834 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggauggaugaagauugugucuggcgcggucaacuuugggagcccgaauuucagacagcgggugucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcuguuucuagcgccuccacaaagggacccagcguguuuccucaugaccugcgc

SEQ ID NO: 41835 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucucugagggcagcgaacucauucauugggugcggcaggccccugggcagggacuggaguggaucggcugggugaagacagucacgggggcggugaacuucggauccgcuuacuuucgccacagaguuucucuuacccgggaucgcgaccuguucacagcccauauggauauuagaggccucacccagggcgacacagccaccuauuuuugugcucggcaaaaauucuacaaagggggacagggcugguauuuugaucugugggggcgcggaacacuuaucguggucagcuccgccagcaccaagggcccgucuguguuccccacgauuugcguu

SEQ ID NO: 41836 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuugauuuuagacaccggguuagccugacacgcgacagagaucucuccaccgcucauauggacauucggggacugacacaggaugacaccgccacauauuucugugcccgccaaaaauuugcuagaggcgaucagggcugguucuuugaccuuugggggcggggaacccugaucguggucucuagcgccuccacgaagggcccgagcguguucccccacgaucuccgc

SEQ ID NO: 41837 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagauugucagcggcgcggugaacuuuggguccccgaauuucagacagcggguuucucuuacacgcgauagagaccuguuuacggcucacauggauauccggggacucacccaaggcgacacagccaccuacuucugugcccgccagaaauuugaaagaggcgggcagggauggauuuucgaucuguggggccgggggacacuuaucgcugugagcuccgccagcaccaagggacccucugucuuuccuacaaucuaugug

SEQ ID NO: 41838 - RNA, 417 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucucuggcgcggugaacuuugggagccuuaauuucagacaccggguuucccugacacgcgauagagaccucuuuaccgcucauauggauauucggggacugacacagggcgacaccgccacauacuucugugcccgccaaaaguuugcuagaggcgaucaggggugguucuuugaccuuuggggacggggcacccugaucguggucucuagcgccuccacgaaagggccgagcguguuccccaccauuugcguu

SEQ ID NO: 41839 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaaccuugggucuccgaauuuuagacaccggguuagccugacacgcgauagagaccucuucaccgcucauauggauauucggggacugacacagggcgacaccgccacauacuuuugugcccgccaaaaauucgaaagaggcgggcagggaugguauuuugaucuuuggggccgggggacccugaucguggucuccucugcuagcacgaagggacccuccguguucccucacgaccuccgc

SEQ ID NO: 41840 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagaggcggccagggguggaucuucgaucuguggggacggggcacccucauugccgugagcuccgcuagcacaaaggggccuucugucuuuccgaccaucugcgug

SEQ ID NO: 41841 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucugcuagcacgaagggacccuccguguuuccucacgaccugguu

SEQ ID NO: 41842 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucuucacggcccauauggacauucggggacugacccaggaugacacagccaccuauuuuugugcucgccaaaaauucgccagaggcgaucagggcugguuuuucgaccuuugggggcggggaacacugaucguggucagcuccgcuagcaccaagggcccgucuguguuucccacaauuuacguu

SEQ ID NO: 41843 - RNA, 420 nt, Artificial Sequence
  derived and/or modified sequence opt5 from anti-HIV-1_HeavyChain
caggugcaccucgagcaaagcggcuccggggucaagaaacccggagccccuguuagagugucuugcuggagcuccgaagacaucuucgagcggaccgaacucauucauugggugcgccaggcuccgggccaggggcuggaguggaucggaugggucaagacagugacgggcgccguuaacuuugggucucuugauuucagacaccggauuagccugacccgcgacagagaucucuuuacagcgcauauggacauccggggacugacccagggcgauacagcuaccuacuucugugcccgccaaaaauuuuaugccggcgggcagggaugguacuucgaccuuuggggcagagggacacugauuguggucuccucugcuagcaccaaggcccacuccgugcugcccccucggagccgcguu

SEQ ID NO: 41844 - RNA, 417 nt, Artificial Sequence
  derived and/or modified sequence opt5 from anti-HIV-1_HeavyChain
caggcccaccuggagcaaagcggcuccggggugaagaaacccggagcucucgucagaguuucuugcuggaccagcgaagacaucuucgagaaguccgaacugauucauugggugcggcaggccccuggccaggggcuugaguggaucggaugggugaaaacagucacgggcgcggugaacuuugggucuagcgauuuccgccagagaguuucccugacccgggaccgcgaucucuuuacagcucacauggacauuagaggacugacccaaggcgauacagccaccuacuucugugcccggcagaaguuuuaugcuggcgggcagggaugguacuucgaccuuuggggccgcgggacacugaucguggucucuagcgccuccaccaaaggaccgagcguguuuccccaugaucucaga

SEQ ID NO: 41845 - RNA, 414 nt, Artificial Sequence
  derived and/or modified sequence opt5 from anti-HIV-1_HeavyChain
caggugcaacugguccagagcggcgccgagguuaagaaacccggggcuuccgugaaggugucuugccaggucagcggauacacccucacagaacuguccaugcacugggugagacaggccccuggccaagggcuugaguggaucggauggguuaaaacggugaccggcgcggucaacuucgggucuccgaauuuucggcaucgcgugagccugacaagagaccgggaucucuucaccgcucacauggacauucgcggacugacacagggcgauaccgccacauauuuuugugccagacagaaguucgaacggggcgggcagggaugguacuuugaccuuuggggccgcgggacccugaucguuguguccucugcuagcacgaaaggacccuccgucuucccucaugaucucaga

SEQ ID NO: 41846 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagacagagcucauucauugggugcggcaggccccuggccaggggcuggaauggaucggaugggugaaaauugucucuggcgcggugaacuuugggagcccgaauuuccgccagagaguuucccuuacgcgggaucgcgaccuguuuaccgcucacauggauaucagaggacucacacaaggcgacaccgccacauacuucugugcccggcagaaguuugagcgcggcgggcagggauggauuuucgaucuguggggcagagggacccuuaucgcugugucuagcgccuccacaaaaggacccagcgucuuuccucaugaccugcgg

SEQ ID NO: 41847 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcguguuuccgaccauuugcguu

SEQ ID NO: 41848 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggagugggugggaugggucaaaacagugacgggcgcgguuaacuuugggagcuccgauuuccgccagagagugucucuuacccgggaccgcgaucuguuuacagcucacauggacaucagaggacucacccaaggcgauacagccaccuacuucugugcccggcagaaguuuuaugcuggcgggcagggaugguacuucgaccuguggggccgcgggacacuuauugucgugagcuccgccagcaccaaaggaccgucuguuuuuccccaugaucugaga

SEQ ID NO: 41849 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaacgcggcgggcagggaugguauuucgaccuguggggcagagggacacuuaucguggucagcuccgcuagcaccaaaggaccgucuguguuucccacgauuugcguu

SEQ ID NO: 41850 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuguguucccgcagauuugcguu

SEQ ID NO: 41851 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggcaccagauuagcgaucgcguuucccuuaccccggacagagaucuguucacagcucauauggacauccggggacucacccaaggcgauacagccaccuacuuuugugcccgccagaaguucuaugcuggcgggcagggaugguacuuugaccuguggggcagagggacacuuauuguggucucuagcgccuccaccaaaggacccagcguguucccuacgaucugcguu

SEQ ID NO: 41852 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcgcgccccuggccaggggcuggaguggaucggaugggugaaaacagucacgggcgcggugaacuuugggagcuccgauuucagacagcggguuucucuuacccgcgacagagaucuguuuacagcucacauggacauucggggacucacccagggcgauacagccaccuacuucugugcccgccaaaaguuuuaugcuggcgggcagggaugguacuucgaccuguggggcagagggacacuuaucguggucagcuccgccagcaccaaagcucaucggucuuccccgacgauuugcgug

SEQ ID NO: 41853 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuccuacaaagggcccguccguguuucccaccauuugcguu

SEQ ID NO: 41854 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuagcgauuucagacagcggguuucccuuacacgcgacagagaucuguuuaccgcucacauggacauucggggacucacacaaggcgauaccgccacauacuucugugcccgccagaaauuuuaugcuggcgggcagggaugguacuucgaccuguggggcagagggacccuuaucguggucucuagcgccuccacgaagggaccgagcguguuuccccagauuuauguu

SEQ ID NO: 41855 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccggggacgcgaccuguuuacagcucacauggauauuagaggccucacccaaggcgacacagccaccuacuucugugcccggcagaaguuuuaugcugggggacagggcugguacuucgaucugugggggcgcggaacacuuaucguggucagcuccgccagcaccaaaggcccgucuguguuucccacgauuugcguu

SEQ ID NO: 41856 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguccaccgcucauauggauauucggggacucacacaggacgauaccgccacauacuuuugugcccgccaaaaauucgcuagaggcgaccagggcugguuuuucgaucugugggggcggggaacccuuaucguggucucuagcgccuccacgaagggccccagcguguuuccucacgaccauguu

SEQ ID NO: 41857 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuuuaugcuggcgggcagggaugguacuucgaucuguggggcagagggacccuuaucguggucuccucugccagcacgaagggacccuccguguuuccucagauuugcguu

SEQ ID NO: 41858 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucguggucucuagcgcuuccacaaagggacccagcguguuuccuaccaucugcguu

SEQ ID NO: 41859 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugggccuccgaagacaucuucgagcggaccgaacucauucauugggugcgccaggcgccuggccaggggcuggaguggaucggaugggugaagacagucacgggcgcugugaacuuugggucuccgaauuucagacaccggguuagccuuacccgcgauagagaccuguuuacagcccauauggauauucggggacucacccagggcgacacagccaccuacuucugugcucgccaaaaauuuuaugccggcgggcagggaugguacuucgaucuguggggcagagggacacuuaucguggucuccucugcuagcaccaagggacccuccguguuuccucacgaccugcuc

SEQ ID NO: 41860 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaacgcggcgggcagggauggaucuucgaccuguggggcagagggacacuuauugcugugagcuccgccagcaccaaaggaccgucugucuuuccccaugaucugcgg

SEQ ID NO: 41861 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuacgggagccuugauuuuagacaccggguuucccugacgcgcgacagagaucucucuaccgcccauauggacauucggggacugacacaggaugacaccgccacauauuucugugcucgccaaaaauuugccagaggcgaucagggcugguucuuugaccuuugggggcggggaacccugaucguggucagcuccgcuagcacaaagggcccgucuguguucccccacgaucuccgc

SEQ ID NO: 41862 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauauuacgcuggcgggcagggaugguauuuugaucuguggggcagagggacacuuaucguggucucuagcgccuccaccaagggacccagcguguucccuacgauuugccgg

SEQ ID NO: 41863 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaacgcggcgggcagggaugguauuucgaccuguggggcagagggacacuuaucguggucagcuccgcuagcaccaaaggaccgucuguguuuccccaugaucugcgg

SEQ ID NO: 41864 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcguguuuccgaccauuuacguu

SEQ ID NO: 41865 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuauaaaggcgggcagggaugguacuucgaccuguggggccgcgggacacuuaucguggucagcuccgcuagcaccaagggaccgucuguguuuccccaugaucugaga

SEQ ID NO: 41866 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaagacgauacagcuaccuacuucugugcccgccagaaauuugccagaggcgaccagggcugguucuuugaucuuugggggcggggaacgcugaucguggucuccucugcuagcaccaagggcccguccguguucccccaugaccuccgc

SEQ ID NO: 41867 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggccuuccgaagacaucuucgagaagucugaacucauucauugggugcggcaggccccgggccaggggcuggaguggaucggaugggugaaaaccgucacaggcgcggugaacuuugggagcuccgauuuccgccagagaguuucucuuacgcgggaccgcgaucuguuuaccgcucacauggacauuagaggacucacacaaggcgauaccgccacauacuucugugcccggcagaaguuugaacgcggcgggcagggauggaucuucgaccuguggggcagagggacccuuauugcugugagcuccgccagcacaaaaggacccucugucuuuccucaugaucugcgg

SEQ ID NO: 41868 - RNA, 417 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucucuggcgcggugaacuuugggagccuuaauuucagacaccggguuucccugacacgcgauagagaccucuuuaccgcucauauggauauucggggacugacacagggcgacaccgccacauacuucugugcccgccaaaaguuugcuagaggcgaucaggggugguucuuugaccuuuggggacggggcacccugaucguggucucuagcgccuccacgaaagggccgagcguguucccccacgaucuccgc

SEQ ID NO: 41869 - RNA, 417 nt, Artificial Sequence
  derived and/or modified sequence opt5 from anti-HIV-1_HeavyChain
caggcccaccuggagcaaagcggcuccgggguggaaaagcccggagcuucugucagaguuagcugcuggaccuccgaggacaucuucgaacggucugagcucauucauugggugcgccaggccccuggccaggggcuggaauggaucggaugggugaaaacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaguauuacgcuggcgggcagggaugguauuuugaucuguggggcagagggacacuuaucguggucucuagcgccuccaccaaaggacccagcguguucccucacgaccugcgg

SEQ ID NO: 41870 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccuccacaaagggacccagcgucuuuccucaugaccugcgc

SEQ ID NO: 41871 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagaaaccuguuuaccgcucauauggacauucggggacucacacagggcgauaccgccacauacuucugugcccgccaaaaauuugaaagaggcgggcagggaugguauuucgaccuguggggccgggggacccuuaucguggucuccucugcuagcacgaagggacccuccguguuuccucacgaucugcgc

SEQ ID NO: 41872 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuuuaugcuggcgggcagggaugguacuucgaucuguggggcagagggacccuuauuguggucucuagcgccuccacaaagggacccagcguguuuccucaugaccugcgg

SEQ ID NO: 41873 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuuaauuuuagaagccggauuucccugacacgcgauagagaccucuucaccgcucacauggauauccggggacugacacagggcgacaccgccacauauuuuugugcccgccaaaaauucgaaagaggcgggcagggauggauuuuugaucuuuggggccgggggacccugaucgcuguuucuagcgccuccacgaagggaccgagcguguucccccaugaccuccgc

SEQ ID NO: 41874 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccagggggacacagccaccuauuuuugugcccggcaaaaauucuacgcuggaggccagggcugguauuuugaucuuugggggcgcggaacacugaucgugguuagcucugccuccaccaagggcccgagcguguucccccacgaccucaga

SEQ ID NO: 41875 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggauugaacucauccauugggugcgccaggccccuggccaggggcuggaguggauuggaugggugaagacagucacgggcgcggugaacuuugggucuccgaauuucagacaccggguuagccuuacccgcgauagagaccuguuuacagcucauauggauauccggggacucacccagggcgacacagccaccuacuucugugcccgccaaaaauuugaaagaggcgggcagggaugguauuucgaucuguggggccgggggacacuuauuguggucuccucugcuagcaccaagggacccuccguguuuccucacgaccugcgc

SEQ ID NO: 41876 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacagcggguuucccucacgcgcgacagagaucuguucaccgcccacauggacauucggggacuuacacaaggcgauaccgccacauauuuuugugcucgccagaaauucuacgccggcgggcagggaugguauuuugaccuguggggcagagggacccucaucguggucucuagcgcuuccacaaagggaccuagcguguucccgcaugaucugcgg

SEQ ID NO: 41877 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcgggccgaacucauucauugggugcgccaggcgccuggccaggggcuggaguggaucggaugggugaagaccgucacaggcgcugugaacuuugggagcccgaauuucagacagcggguuucccuuacgcgcgauagagaccuguuuaccgcccacauggauauucggggacucacacaaggcgacaccgccacauacuucugugcucgccagaaauuugaaagaggcgggcagggauggaucuucgaucuguggggccgggggacccuuauugccgugucuagcgcuuccacaaagggacccagcgucuuuccucaugaccugcgc

SEQ ID NO: 41878 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaaggcggucucuggcgcugugaacuacgggagccuugauuuuagacaccggguuucccugacgcgcgacagagaucucuucaccgcccauauggacauucggggacugacacaggaugacaccgccacauauuuuugugcucgccaaaaauucgccagaggcgaucagggcugguuuuucgaccuuugggggcggggaacccugaucguggucucuagcgcuuccacaaagggcccgagcguguuuccccacgaucuccgc

SEQ ID NO: 41879 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgagcgcgggggacagggcugguacuuugaccuuuggggcagagggacacugaucgugguuagcucugcuuccaccaagggaccgagcguguucccccacgaucuccgg

SEQ ID NO: 41880 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuuuaugcuggcgggcagggaugguacuucgaccuuuggggcagagggacacugauuguugugucuagcgccuccaccaagggaccgagcgucuuuccccacgaucuccgg

SEQ ID NO: 41881 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaagaugacacagccaucuacuucugugcccggcagaaguuugcucgcggcgaucagggcugguucuuugaccugugggggagaggaacccuuauuguggucagcuccgccagcacaaaaggcccgucuguguucccccaugaucugcgg

SEQ ID NO: 41882 - RNA, 417 nt, Artificial Sequence
  derived and/or modified sequence opt5 from anti-HIV-1_HeavyChain
caggcccaccuggagcaaagcggcuccggggugaagggacccggcgcuucugucagaguuagcugcuggaccuccgaagacaucuucgagacaacggaacucauucauugggugcggcaggccccugggcagggacuggaguggaucggcugggugaaaaccgucucuggggcggugaacuuuggaagccuuaauuuccgccacagaguuucccugacacgggaucgcgaccucuuuaccgcucauauggauauuagaggccugacacagggcgacaccgccacauacuucugugcccggcaaaaguuugcucgcggggaucagggaugguucuuugaccuuuggggcagagggacccugaucguggucucuagcgccuccacgaaaggaccgagcguguucccccacgaucuccgg

SEQ ID NO: 41883 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuccgcuuacccgggaucgcgaccuguuuacagcccauauggauauuagaggccucacccagggcgacacagccaccuauuucugugcucggcaaaaauuuuacaaagggggacagggcugguauuucgaucugugggggcgcggaacacuuaucguggucuccucugccagcaccaagggccccuccguguuuccucacgaccugaga

SEQ ID NO: 41884 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucugcuagcacgaagggacccuccguguuuccucacgaccugcgc

SEQ ID NO: 41885 - RNA, 417 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaaggcggugucuggcgcuguuaacuacgggagccuugauuuuagacaccgggugucccugacgcgcgacagagaucucuucaccgcccauauggacauucggggacugacacagggcgauaccgccacauauuuuugugcucgccaaaaauucuacgccggcgggcagggaugguauuuugaccuuuggggcagagggacccugaucgucgugucuagcgcuuccacaaagggaccuagcguuuucccgcacgaucuccgg

SEQ ID NO: 41886 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacaggacgauaccgccacauacuucugugcccgccaaaaauuugcuagaggcgaccagggcugguucuuugaucugugggggcggggaacccuuaucguggucuccucugccagcacgaagggccccuccguguucccucacgaccugcgc

SEQ ID NO: 41887 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgcccggggagaucaaggcugguuuuucgaccuguggggccgcgggacccuuauugugguuagcucugcuuccacgaagggaccgagcguguuuccccacgaucugaga

SEQ ID NO: 41888 - RNA, 417 nt, Artificial Sequence
  derived and/or modified sequence opt5 from anti-HIV-1_HeavyChain
caggcccaccuggagcaaagcgaauccggcgugaagaaacucggggcuucugucagaguuagcugcuggaccuccgaggacaucuucgaacggacagagcugauucauugggugcgccaggcccccggacagggccuugaauggaucgggugggugaaggcggucucuggagcugugaacuacggcagccuggauuuuagacaccggguuucccucacgcgcgacagagaucuguucaccgcccauauggacauucgggggcuuacacaggaugacaccgccacauauuuuugugcucgccaaaaauucgccagaggagaucagggcugguuuuucgaccuguggggccgggggacccucaucguggucucuagcgcuuccacaaagggaccuagcguguuuccgcacgaucugcgc

SEQ ID NO: 41889 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuucccacgacccugaga

SEQ ID NO: 41890 - RNA, 417 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaagacggugaccggcgcgguuaacuuugggucuagcgauuucagacagcgggugucccuuacacgcgacagagaucuguuuaccgcucacauggacauucggggacucacacaaggcgauaccgccacauacuucugugcccgccagaaauuuuaugcuggcgggcagggaugguacuucgaccuguggggcagagggacccuuaucgucgugucuagcgccuccacgaagggaccuagcguuuuuccgcaugaucugcgg

SEQ ID NO: 41891 - RNA, 420 nt, Artificial Sequence
  derived and/or modified sequence opt5 from anti-HIV-1_HeavyChain
caggccagacccggcgcuaaccgggggagcggagugaagaaaccuggcgccuccguccgcguuucuugcuggaccagcgaggacaucuucgaaagaacagagcugauucacugggugcggcaagcgccggggcagggacucgaauggaucggcugggugaagauugucuccggggcugugaauuuuggaucucccaacuuccgccagagaguuagccugacgcgggaucgcgaccuuuuuaccgcccauauggauaucagaggccugacacagggcgacaccgccacauacuucugugcucggcaaaaauuugagcgcgggggacagggcuggauuuucgaucucugggggagaggaacccugaucgccguguccucugcuagcacaaagggcccuuccgucuuuccccacgaccuucgg

SEQ ID NO: 41892 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauauuacgcuggcgggcagggaugguauuuugaucuguggggcagagggacacuuaucguggucucuagcgccuccaccaagggacccagcguguucccucacgaccugcgg

SEQ ID NO: 41893 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauuuuacaaagggggacagggcugguauuucgaucugugggggcgcggaacacuuaucguggucucuagcgccuccaccaagggcccgagcguguuuccccacgaccugaga

SEQ ID NO: 41894 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucugugcugccgccccgcuccgcc

SEQ ID NO: 41895 - RNA, 417 nt, Artificial Sequence
  derived and/or modified sequence opt5 from anti-HIV-1_HeavyChain
caggcccaccuggagcaaagcggcuccgggaugaagaaacccggagcuucugugagagucagcugcugguccucugaagacaucuucgagcggaccgaacucauucauuggguucgccaggccccuggccaggggcuggaguggaucggaugggugaagacagugacgggcgcggucaacuuugggagcuccgauuucagacagcgggugucucuuacccgcgacagagaucuguuuacagcucacauggacauucggggacucacccaaggcgauacagccaccuacuucugugcccgccagaaauuuuaugcuggcgggcagggaugguacuucgaccuguggggcagagggacacuuaucguugugagcuccgccagcaccaagggaccgucugucuuuccccaugaucugcgg

SEQ ID NO: 41896 - RNA, 417 nt, Artificial Sequence
  derived and/or modified sequence opt5 from anti-HIV-1_HeavyChain
caggcccaccuggagcaaagcggcuccggggugaaggaacccggaaccucugucagaguuagcugcuggacauccgaggacaucuucgaacggacggagcucauucauugggugcgccaggcuccuggccaggggcuggaauggaucggaugggugaaaaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaguuugagagaggcgggcagggauggaucuucgaucuguggggccgggggacgcuuauugccguguccucugcuagcaccaaaggacccuccgucuuuccucagacacugcgc

SEQ ID NO: 41897 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgccauagagugucucugacacgggaucgcgaccucagcaccgcucacauggauaucagaggccugacacaggacgauaccgccacauauuuuugugcccggcaaaaauucgcucgcggggaccagggaugguuuuucgaucuuuggggcagaggcacccugauuguuguguccagcgccucuacgaaggggccguccgucuuuccccaugaccuccgg

SEQ ID NO: 41898 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagacaacggaacucauucauugggugcggcaggccccuggccaggggcuggaguggaucggaugggugaagaccgucucuggcgcggugaacuuugggagccuuaauuuccgccacagaguuucccugacacgggaucgcgaccucuuuaccgcucauauggauauuagaggacugacacagggcgacaccgccacauacuucugugcccggcaaaaauuugcucgcggcgaucaggggugguucuuugaccuuuggggaagaggcacccugaucguggucucuagcgccuccacgaaggggccgagcguguucccccacgaucuccgg

SEQ ID NO: 41899 - RNA, 417 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaagacggugaccggcgcgguuaacuuugggucuccuaauuucagacaccgggugagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucgucguguccucugcuagcacgaagggaccguccguuuuuccccacgaccugcgc

SEQ ID NO: 41900 - RNA, 417 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucuccggcgcugugaacuuugggucuccgaauuucagacaccggguuagccuuacccgcgauagagaccuguuuacagcccauauggauauucggggacucacccagggcgacacagccaccuacuucugugcucgccaaaaauuugaaagaggcgggcagggaugguauuucgaucuguggggccgggggacacuuaucguggucuccucugccagcaccaagggacccuccguguuuccucacgaccugcgc

SEQ ID NO: 41901 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuuaauuuuagaagccggauuucccugacacgcgauagagaccucuucaccgcucacauggauauccggggacugacagaaggcgacaccgccacauauuuuugugcccgccagaaauucuacgcuggcgggcaaggaugguauuuugaucuuuggggcagagggacccugauuguugugucuagcgccuccacgaagggaccgagcgucuucccccaugaccuccgg

SEQ ID NO: 41902 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugccucgccuccgaagacaucuucgagcggaccgaacugauucauugggugcgccaggcgccuggccaggggcuugaguggaucggaugggugaagacagucacgggcgcugugaacuuugggucuccgaauuucagacaccggguuagccugacccgcgauagagaccucuuuacagcccauauggauauucggggacugacccagggcgacacagccaccuacuucugugcucgccaaaaauuugaaagaggcgggcagggaugguauuucgaucuuuggggccgggggacacugaucguggucuccucugccagcaccaagggacccuccguguuuccucacgaccuccgc

SEQ ID NO: 41903 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaagaggcgggcagggauggauuuucgaccuuuggggccgggggacacugaucgcuguuucuagcgccuccaccaagggaccgagcguguuuccccacgaucuccgc

SEQ ID NO: 41904 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuugaaagaggcgggcagggaugguauuucgaucuguggggccgggggacccuuaucguggucuccucugcuagcacgaagggacccuccguguuuccucaugaccugcgc

SEQ ID NO: 41905 - RNA, 417 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagcggacagaacucauucauugggugcgccaggcuccuggccaggggcuggaguggaucggaugggucaagacggugaccggcgccguuaacuuugggucuccgaauuucagacaccgggugagccuuacacgcgauagagaccuguuuaccgcgcauauggauauucggggacucacacagggcgacaccgcuacauacuucugugcccgccaaaaauuugaaagaggcgggcagggaugguauuucgaucuguggggccgggggacccuuaucgucguguccucugccagcacgaagggacccuccguuuuuccucacgaccugcgc

SEQ ID NO: 41906 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacagcggguuucccuuacccgcgauagagaccuguuuacagcucacauggauauucggggacucacccaaggcgacacagccaccuaccugugugcccgccagaaauucgaaagaggcgggcagggauggaucuuugaucuuuggggccgggggacacugauugcugugucuagcgccuccaccaagggacccagcgucuucccucaugaccuccgc

SEQ ID NO: 41907 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggcaucgcgugagccuuacaagagaccgggaucuguuuaccgcgcacauggacauucgcgggcucacacagggagauaccgcuacauauuucugugccagacagaaauuuuacaagggcggccaagggugguauuucgaccuguggggacggggcacccuuaucguuguguccagcgccucuacgaaagggccguccgucuuuccccaugaucugcgc

SEQ ID NO: 41908 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuaccccggaccgggaucuguuuacagcucacauggacauucgcggacucacccaaggcgauacagccaccuacuucugugccagacagaaguuuuaugcuggcgggcagggaugguacuucgaccuguggggccgggggacacuuaucguggucagcuccgccagcaccaaaggaucuuccguguuuccccaugaucugcgc

SEQ ID NO: 41909 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuaccccggaccgggaucuguuuacagcucacauggacauucgcggacucacccaaggcgauacagccaccuacuucugugccagacagaaguuuuaugcuggcgggcagggaugguacuucgaccuguggggccgggggacacuuaucguggucagcuccgccagcaccaaaggacccucuguguuuccucaugaucugcgc

SEQ ID NO: 41910 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuguguucccgcacgaucugcgc

SEQ ID NO: 41911 - RNA, 417 nt, Artificial Sequence
  derived and/or modified sequence opt5 from anti-HIV-1_HeavyChain
caggugcaccuggagcaaagcggcuccggggucaagaaacucggagccucuguuagagugagcugcuggaccuccgaagacaucuucgagcggacagaacugauucauugggugcgccaggcucccggccaggggcuugaguggaucggaugggucaaggccgugucuggcgcgguuaacuacgggagccuggauuuuagacaccgggugucccucacgcgcgacagagaucuguucaccgcucauauggacauucggggacuuacacaggaugacaccgccacauauuuuugugcccgccaaaaauucgcuagaggcgaucagggcugguuuuucgaccugugggggcggggaacccucaucgucgugucuagcgccuccacaaagggcccuagcguuuuuccgcaccgcucuacc

SEQ ID NO: 41912 - RNA, 420 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggauggcuuacauggaucuucggaaccugcgcuucgacgauaccgccguguauuuuugugcgagaaaaacagccggagacgucuccggcgauaaucggggcuacuucuuugaccucugggggcgcggaucuagagugaucguuagcuccgcuucuaccaagggccccagcguguucacaauuuauguc

SEQ ID NO: 41913 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcguguuuccgcacgaucccgcc

SEQ ID NO: 41914 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucugugcugccgccccgcuccacc

SEQ ID NO: 41915 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaaggcggucagcggcgcugugaacuacgggucccuugauuuuagacaccggguuucucugacacgcgacagagaucucuucacggcccauauggacauucggggacugacccaggaugacacagccaccuauuuuugugcucgccaaaaauucgccagaggcgaucagggcugguuuuucgaccuuugggggcggggaacacugaucguggucagcuccgcuagcaccaagggcccgucuguguuuccccacgaucuccgc

SEQ ID NO: 41916 - RNA, 417 nt, Artificial Sequence
  derived and/or modified sequence opt5 from anti-HIV-1_HeavyChain
caggcccaccuggagcaaagcggcuccgaauggaagaaacucggggcuucugugagagucagcugcuggaccuccgaggacaucuucgaacggacagagcugauucauuggguucgccaggcccccggacagggccuugaauggaucgggugggugaaggcggugucuggagcugucaacuacggcagccuggauuuuagacaccgggugucccucacgcgcgacagagaucugucuaccgcccauauggacauucgggggcuuacacaggaugacaccgccacauauuucugugcucgccaaaaauuugccagaggagaucagggcugguucuuugaccuguggggccgggggacccucaucguugugagcuccgcuagcacaaagggaccuucugucuucccgcacgaucugcgc

SEQ ID NO: 41917 - RNA, 417 nt, Artificial Sequence
  derived and/or modified sequence opt5 from anti-HIV-1_HeavyChain
caggcccaccuggagcaaagcggcuccgaagugaagaaacccggggcuucugucagaguuagcugcuggaccuccgaggacaucuucgaaaagucugagcucauucauugggugcggcaggccccuggacagggccuggaauggaucgggugggugaaaacagucacgggagcggugaacuuuggcagcuccgauuuccgccagagaguuucucuuacccgggaccgcgaucuguuuacagcucacauggacauuagagggcucacccaaggagauacagccaccuacuucugugcccggcagaaguuuuaugcuggcggccaggggugguacuucgaccuguggggacgcggcacacuuaucguggucagcuccgccagcaccaaagggccgucuguguuuccccaugaucugaga

SEQ ID NO: 41918 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucuccuaauuucagacaccggguuagccugacacgcgauagagaccucuuuaccgcucauauggauauucggggacugacacagggcgacaccgccacauacuucugugcccgccaaaaauuugaaagaggcgggcagggaugguauuucgaucuuuggggccgggggacccugaucguggucuccucugcuagcacgaagggaccguccguguuuccccacgaccuccgc

SEQ ID NO: 41919 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacauccuccggaagucugagcugauucauugggugcgccaggccccuggccaggggcuugaauggaucggaugggugaaaacagucacgggcgcggugaacuucgggagcuccgauuuuagacagcggguuucucugacccgcgacagagaucucuucacagcucacauggacauucggggacugacccaaggcgauacagccaccuacuuuugugcccgccagaaguucuaugcuggcgggcagggaugguacuuugaccuuuggggcagagggacacugaucguggucagcuccgccagcaccaaaggaccgucuguguucccccaugaucuccgg

SEQ ID NO: 41920 - RNA, 417 nt, Artificial Sequence
  derived and/or modified sequence opt5 from anti-HIV-1_HeavyChain
caggcccaccuggagcaaagcgcuuccggcgugaagagacccggggccucuguccggguuagcugccucgcguccgaagacaucuucgagcgcucugaacugauuuacugggugagacaggcuccuggacagggccuugaguggaucgggugggugaaaauugucagcggagccgugaacuuuggcuccccgaauuuccggcagcgcguuucucugaccagagaucgggaccucuuuacagcccauauggauauccgcgggcugacgcaaggagacaccgcuacauauuucugugccagacagaaguuugaacggggcggccagggguggauuuucgaucuuuggggacgcggcacccugaucgcugugagcuccgccagcacaaaagggcccucugucuuuccucacgaccucaga

SEQ ID NO: 41921 - RNA, 417 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagacaacggaacucauucauugggugcgccaggccccuggccaggggcuggaguggaucggaugggugaaaaccgucacaggcgcggugaacuuugggucugcuuacuucagacaccggguuagccuuacccgcgauagagaccuguuuacagcccauauggauauucggggacucacccagggcgacacagccaccuauuucugugcucgccaaaaguuuuacaaaggcgggcagggaugguauuucgaucuguggggcagagggacgcuuaucguggucuccucugccagcaccaagggaccguccguguuuccccacgaccugcgg

SEQ ID NO: 41922 - RNA, 417 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcucugaacucauuuacugggugagacaggcgccuggacagggccuggaguggaucgggugggugaaaacagucagcggagcugugaacuuuggcuccacggauuuccggcaucgcguuucucuuaccagagaccgggaucuguuuacagcccacauggacauucgcgggcucacccagggagauacagccaccuauuucugugcuagacaaaaguuugaacggggcggccaggggugguacuucgaccuguggggacgcggcacacuuaucguggucagcuccgccagcaccaaagggccgucuguguuuccccaugaucugaga

SEQ ID NO: 41923 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucugggcugccgccccgcuccgcc

SEQ ID NO: 41924 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccagggggacacagccaccuauuuuugugcccggcaaaaauucgagcgcggaggccagggcuggaucuuugaucuuugggggagaggaacacugaucgcugugagcucugccuccaccaagggcccgagcguuuucccccuccggucugcu

SEQ ID NO: 41925 - RNA, 423 nt, Artificial Sequence
  derived and/or modified sequence opt5 from anti-HIV-1_HeavyChain
caggugcaaauggagcaggccggcgcugggaugaagaaacccggagccagcaugaccgucuccugcaagacagcggacgaagauaucuucgacgcugccuacaugcacuggguuagacaggccccuggccagacguuugaguggcugggguggaugaaaccggugaccggagcugugaacuaugcccggcaauuccagggccgcgcuucuuuuuacagaacacgggaacucgggauugccuauauggaucugcgcgaccuuaaguucgaugacaccgcggucuacuuuugugccagaaaaacaaagggagaugugagcggcgacgaucggggcuucuuuuucgaccugugggggcgcggaaccagaguuaucguguccucugcuagcacaaagggccccuccgucuuuccucaugaucuccgg

SEQ ID NO: 41926 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuuuauaagggcgggcagggaugguacuucgaccuuuggggcagagggacacugauuguugugucuagcgcuuccaccaaaggaccgagcgucuuuccccagaucugccgg

SEQ ID NO: 41927 - RNA, 414 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagaaguccgaacucauucauugggugcggcaggcgccuggccaggggcuggaguggaucggaugggugaaaacagucacgggcgcugugaaccuuguucaccagauuucugaucgcgugagccugaccagagaccgggaucucuccacagcccauauggacauccgcgggcugacccaagaugacacagccaccuacuuuugugcuagacagaaguucgcccggggagaucagggcugguuuuucgaccuuuggggccgcgggacacugauugucgugucuagcgcuuccaccaaaggaccgagcguuuuuccccacgaucucaga

SEQ ID NO: 41928 - RNA, 420 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucugggcugccgccccgccugugcgug

SEQ ID NO: 41929 - RNA, 417 nt, Artificial Sequence
  derived and/or modified sequence opt5 from anti-HIV-1_HeavyChain
caggccagacuggagcaaagcggcuccggggugaagaaacccggagcuucuguccggguuagcugcuggaccuccgaagacaucuucgagggcucugaacucauucacugggugcgccaggccccugggcagggacuggaguggaucggcugggugaagacagucacgggggcggugaacuuuggaagcgcuuacuucagacaucggguuucccuuacccgcgauagagaccuguuuacagcccacauggauauucggggccucacccagggcgacacagccaccuauuucugugcucgccaaaaauuugccagaggggaucagggaugguucuuugaccuguggggccgggggacacuuaucguggucucuagcgcuuccaccaagggaccgagcguguucccccaugauucugcc

SEQ ID NO: 41930 - RNA, 414 nt, Artificial Sequence
  derived and/or modified sequence opt5 from anti-HIV-1_HeavyChain
caggugcaacugguccagagcggcgccgagguuaagaaacccggguccucugugaaggugagcugcaaagucuccggaggcguguucaccucuuacgcuguuacaugggugagacaggccccugggcagggacucgaauggaucggcugggucaaggcggugagcggggcuguuaacuauggaucccuggacuuucggcaccgcgugucucuuacgagagaucgggaccuguucaccgcccauauggauauucgcggccucacacaagacgauaccgccaucuacuuuugugcuagacagaaauucgcccggggcgaccaggggugguuuuucgaucuguggggacgcggcacacuuauugucgugagcuccgcuagcaccaaggggccgucuguguuuccccacgaccugaga

SEQ ID NO: 41931 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacagcggguuucccuuacccgcgauagagaccuguuuacagcucacauggauauucggggacucacccaaggcgacacagccaccuacuucugugcccgccagaaauuugaaagaggcgggcagggauggaucuucgaucuguggggccgggggacacuuauugcugugucuagcgccuccaccaagggacccagcgucuuuccucaugaccugcgc

SEQ ID NO: 41932 - RNA, 417 nt, Artificial Sequence
  derived and/or modified sequence opt5 from anti-HIV-1_HeavyChain
cagagccaccuggagcaauccggcucugccaugaagaaacccggggcuagcgugaccgucuccugcuggacaucugaagacaucuucgauacgaccgagcucauuuacuggguuagacaggccccuggacagggccuggaauggaucgggugggugaagauugugagcggaacagucaacuuugcgucccuugacuuccggaaucgcaucucucugagcagagaucgggaccucuccaccgcucauauggauauucgcggccugacacaggacgauaccgccacauauuuuugugccagacaaaaauucgcuagccgguacucuggggaccagggauccuauuuugaucuuuggggccgcggcacccugaucaucgugagcucugccuccacgaaggggccgagcgacgaucucaga

SEQ ID NO: 41933 - RNA, 414 nt, Artificial Sequence
  derived and/or modified sequence opt5 from anti-HIV-1_HeavyChain
caggugcaacugguccagagcggcgccgagguuaagaaacccggggcuuccgugaaggugucuugcaaaagcuccggauacucuuucaccagauuugacaucacauggguccggcaggccccuggccaggggcucgaauggauuggaugggugaagacgguuagcggcgcggugaacuucgggucccugaauuuucgccacagagucucucuuacccgggaucgcgaccuguucacagcucauauggauaucagaggacucacccaaggcgacacagccaccuauuuuugugcccggcagaaauucgcucgcggcgaucaggggugguuuuucgaccuguggggaagaggcacacuuauugugguuagcuccgccagcaccaaggggccgucuguguuuccccacgaucugcgg

SEQ ID NO: 41934 - RNA, 420 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgauuggccugcccccuagacucugcgug

SEQ ID NO: 41935 - RNA, 417 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucaccggcgcugugaacuuuggguccccgaauuucagacaccggguuucucuuacacgcgauagagaccuguuuaccgcccauauggauauucggggacucacacagggcgacaccgccacauacuucugugcucgccaaaaauuugaaagaggcgggcagggaugguauuucgaucuguggggccgggggacccuuaucguggucagcuccgccucuacgaagggacccagcguguuuccucacgaccugcgc

SEQ ID NO: 41936 - RNA, 420 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcggggaacccucaucguggucucuagcgcuuccacaaagggcccuagcgggccgucucccgaaauuugcgug

SEQ ID NO: 41937 - RNA, 417 nt, Artificial Sequence
  derived and/or modified sequence opt5 from anti-HIV-1_HeavyChain
caggcccaccuggagcaaagcggcgcuggggugaagagacccggagccuccguccggguuucuugcuggaccagcgaagacaucuucgagacaacggaacucauucauugggugcgccaggcgccuggccaggggcuggaguggaucggaugggugaaaaccgucuccggcgcugugaacuuugggucucuuaauuucagacaccggguuagccugacacgcgauagagaccucuuuaccgcccauauggauauucggggacugacacagggcgacaccgccacauacuucugugcucgccaaaaguuugccagaggcgaucaggggugguucuuugaccuuuggggacggggcacccugaucguggucuccucugcuagcacgaaagggccguccguguucccccacgaucuccgc

SEQ ID NO: 41938 - RNA, 417 nt, Artificial Sequence
  derived and/or modified sequence opt5 from anti-HIV-1_HeavyChain
agagcccaccuggagcagagcggcuccggggugaagaaacucggagcuucuguccggguuagcugcuggaccuccgaagacaucuucgagcgcacagaacugauucauugggugagacaagcccccggccaggggcuugaguggaucggaugggugaaggcggucucuggcgcugccaacuacgggagcccuaauuuucggcagcgcgugucccugacgagagaucgggaccucuucaccgcccacauggauauucgcggacugacacagggcgacaccgcuacauauuuuugugccagacaaaaauucgaacggggcgggcagggauggaucuuugaucuuuggggccgcgggacccugauugcuguuucuagcgccuccacaaagggaccgagcguguucccccaugaccucaga

SEQ ID NO: 41939 - RNA, 417 nt, Artificial Sequence
  derived and/or modified sequence opt5 from anti-HIV-1_HeavyChain
caggugcaccuggagcaaagcggcuccggggucaagaaacucggagccucuguuagagugagcugcuggaccuccgaagacaucuucgagcggacagaacugauucauugggugcgccaggcucccggccaggggcuugaguggaucggaugggucaaggccgugucuggcgcgguuaacuacgggagccuggauuuuagacaccgggugucccucacgcgcgacagagaucuguucaccgcucauauggacauucggggacuuacacaggaugacaccgccacauauuuuugugcccgccaaaaauucgcuagaggcgaucagggcugguuuuucgaccugugggggcggggaacccucaucgucgugucuagcgccuccacaaagggcccuagcguuuuuccgcacgaucugcgc

SEQ ID NO: 41940 - RNA, 417 nt, Artificial Sequence
  derived and/or modified sequence opt5 from anti-HIV-1_HeavyChain
agagcccaccuggagcagagcggcuccggggugaagaaacccggagcuucuguccggguuagcugcuggaccuccgaagacaucuucgagcgcacagaacucauucauugggugagacaagccccuggccaggggcuggaguggaucggaugggugaagauugucucuggcgcggugaacuuugggagcccgaauuuccggcagcgcgcuucccuuacgagagaucgggaccuguuuaccgcccacauggauauccgcggacucacacagggcgacaccgccacauacuucugugcuagacaaaaauuugaacggggcgggcagggauggauuuucgaucuguggggccgcgggacccuuaucgccguuucuagcgcuuccacaaagggacccagcguguuuccuaccaucuauguc

SEQ ID NO: 41941 - RNA, 414 nt, Artificial Sequence
  derived and/or modified sequence opt5 from anti-HIV-1_HeavyChain
caggugcaacugguccagagcgaggccgaaguuaagaaacccggcgcuuccgugaagaucucuugcgccaccagcggguacgcguucacacucuauuaccugcacugggugagacaggcuccuggacagggccuugaguggauugggugggucaaaacggugaccggagccguuaacuuuggcuccgccuauuuccggcaucgcgugucucugacaagagaccgggaucucuuuaccgcucacauggacauccgcgggcugacacaaggagauaccgccacauacuucugugcuagacagaaguuuuauaaaggcggccaggggugguacuucgaccuuuggggacggggcacccugauugucgugagcuccgccucuacgaaggggccgagcguuuuuccccaugaucuccgc

SEQ ID NO: 41942 - RNA, 420 nt, Artificial Sequence
  derived and/or modified sequence opt5 from anti-HIV-1_HeavyChain
caggcccaccccgagcaaagcggcuccggggugaagaaaccuggagcuucugucagaguuagcugcuggaccuccgaagacaucuucgagcggacagaacugauucauugggugcgccaggccccgggccaggggcucgaguggaucggaugggugaagauugucucuggcgcggugaacuuugggagccccaauuucagacagcggguuucccugacgcgcgauagagaccuuuuuaccgcucacauggauauccggggacugacacaaggcgacaccgccacauacuucugugcccgccagaaauuugaaagaggcgggcagggauggauuuucgaucucuggggccgggggacccugaucgcugugucuagcgccuccacaaagggaccuagcggccuucccccucgccugugcguc

SEQ ID NO: 41943 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagcgcuuccaccaagggacccagcguguuuccuccccgcucuacg

SEQ ID NO: 41944 - RNA, 417 nt, Artificial Sequence
  derived and/or modified sequence opt5 from anti-HIV-1_HeavyChain
caggcccaccuggagcaaagcggcuccggggugaagagacccggagcuucuguccggguuagcugcuggaccuccgaagacaucuucgagaaaucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagcgcuuccaccaagggacccagcguguuuccucacgaccugcgc

SEQ ID NO: 41945 - RNA, 417 nt, Artificial Sequence
  derived and/or modified sequence opt5 from anti-HIV-1_HeavyChain
ggcgcccaccuggagcagagcggguccggagugaagaaacccggcgcuucugucagaguuagcugcuggaccuccgaagacaucuucgagaagucugaacucauucauugggugcggcaagccccugggcagggacuggaguggaucggcugggugaaaacagucacgggggcggugaacuuuggaagcuccgauuuccgccagagaguuucucuuacccgggaccgcgaucuguuuacagcucacauggacauuagaggccucacccagggcgauacagccaccuacuucugugcccggcaaaaguuuuaugcugggggacagggcugguacuucgaccugugggggcgcggaacacuuaucguggucagcuccgccagcaccaaaggcccgucuguguuuccccaugaucugaga

SEQ ID NO: 41946 - RNA, 417 nt, Artificial Sequence
  derived and/or modified sequence opt5 from anti-HIV-1_HeavyChain
agacacgaccuggagcagagcggcuccggggugaagaaacccggagccucuguccggguuagcugcuggaccuccgaagauaucuucgagcgcacagaacucauucauugggugagacaagcuccuggccaggggcuggaguggaucggaugggugaagauugucucuggcgccgugaacuuugggagcccgaauuuccggcagcgcguuucccuuacgagagaccgggaucuguuuaccgcgcacauggacauccgcggacucacacagggcgauaccgcuacauacuucugugccagacaaaaauuugaacggggcgggcagggauggauuuucgaccuguggggccgcgggacccuuaucgccgugucuagcgcuuccacaaagggacccagcgucuuuccucaugaucugaga

SEQ ID NO: 41947 - RNA, 420 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucugucaccaucuaugug

SEQ ID NO: 41948 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcccgggacccauuggcccuucucccagauccgcu

SEQ ID NO: 41949 - RNA, 417 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcacagaacucauucauugggugagacaggcgccuggacagggccuggaguggaucgggugggugaaaacggucaccggagcugugaacuuuggcucuagcgauuuccggcagcgcguuucccuuacaagagaccgggaucuguuuaccgcccacauggacauucgcgggcucacacaaggagauaccgccacauacuucugugcuagacagaaguuuuaugccggcggccaggggugguacuucgaccuguggggacggggcacccuuaucguggucucuagcgcuuccacgaaagggccgagcguguuuccccaugaucugcgc

SEQ ID NO: 41950 - RNA, 417 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagaaguccgaacucauucacuggguccggcaggccccuggacagggccuggaguggaucgggugggugaaaacaguuacgggagcggugaacuuuggcucuagcgauuuccgccaaagagucucccuuacccgggaccgcgaucuguuuacagcucauauggacauuagagggcucacccagggagauacagccaccuacuucugugcccggcagaaguuuuaugcuggcggccaggggugguacuucgaccuguggggacgcggcacacuuaucgugguuucuagcgccuccaccaaagggccgagcguguuucccacgauuuauguc

SEQ ID NO: 41951 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggagagaaucggaugggugaagacggucaccggcgcggugaacuuugggucuccgaauuuccggcaccgcguuagccuuacaagagaucgggaccuguuuaccgcucauauggauauucgcggacucacacagggcgacaccgccacauacuucugugccagacaaaaauuugaacggggcgggcagggaugguauuucgaucuguggggccgcgggacccuuaucguggucuccucugcuagcacgaagggacccuccguguuuccuaccauuugcguu

SEQ ID NO: 41952 - RNA, 420 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauucauuggguucggcaggccccuggacagggccuggaauggaucgggugggugaagaccgugagcggagcggucaacuuuggcucccuuaauuuccgccacagagugucucugacacgggaccgcgaucucuuuaccgcucauauggacauuagagggcugacacagggagauaccgccacauacuucugugcccggcaaaaauuugcucgcggcgaccagggcugguucuuugaucuuugggggagaggaacccugaucguugugagcuccgccagcacgaacggcccgauugggcccucuccuaccgaccuccgg

SEQ ID NO: 41953 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucagugggugcgccaggcccccggccaggggcuugaguggaugggaugggugaaggcggucucuggcgcugugaacuacgggagccuggauuuuagacaucggguuucccucacgcgcgacagagaucuguucaccgcccacauggacauccggggacuuacacaagaugacaccgccacauauuuuugugcucgccagaaauucgccagaggcgaucagggcugguuuuucgaccugugggggcggggaacccucauuguggucucuagcgcuuccacaaagggcccuagcguguuuccgcaugaucugcgc

SEQ ID NO: 41954 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaaggcggugagcggagcugucaacuauggcucccuugacuuucgccauagagugucucugacccgggaucgcgaccucagcacagcccacauggauauuagagggcugacccaggacgauacagccaccuacuucugugcucggcaaaaauuugcccgcggagaccagggcugguucuuugaucuuuggggcagagggacacugaucguuguguccagcgcuucuaccaagggaccguccgucuucccccaugaccuccgg

SEQ ID NO: 41955 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuguguucccgaccauuuacguu

SEQ ID NO: 41956 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccgggggacccuuaucguggucuccucugcuagcacgaagggacccuccguguuuccucacgacccccgc

SEQ ID NO: 41957 - RNA, 423 nt, Artificial Sequence
  derived and/or modified sequence opt5 from anti-HIV-1_HeavyChain
cagguguacauggagcaagccggcgcugggaugaagaaacccggagccagcaugaccgucuccugcaagacagcggacgaagauaucuucgacgcugccuauaugcacuggguuagacaggccccuggccagacguuugaguggcugggguggaugaaaccggugaccggagcugugaacuacgcccggcaguuccaaggccgcgucucuuuuuauagaacacgggaacucgggauugcuuacauggaucugcgcgaccuuaaguucgaugacaccgccguguauuuuugugcgagaaaaacaaagggagauguuagcggcgacgaucggggcuucuuuuucgaccugugggggcgcggaaccagagugaucgucuccucugccagcacaaagggccccuccguguuuccucaugaucuccgg

SEQ ID NO: 41958 - RNA, 423 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggcccgggggcagacguuugaguggcugggauggaugaaaccugugaccggcgccgugaacuacgcucgccaguuccaagggagagucucuuuuuaucggacacgcgaacucggaauugccuacauggaucugagagaccuuaaguucgaugacaccgcuguguauuuuugugcccggaaaacaaagggcgauguuagcggcgacgaucgcggguucuuuuucgaccuguggggaagaggcacccgggugaucgucuccucugcgagcacaaaggggccguccguguuucccaccauuuacguu

SEQ ID NO: 41959 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggauggcuuacauggaucuucggaaccugcgcuucgacgauaccgccguguauuuuugugcgagaaaaacagccggagacgucuccggcgauaaucggggcuacuucuuugaccucugggggcgcggaucuagagugaucguuagcuccgcuucuaccaagggccccagcguguucccuacaauuuauguc

SEQ ID NO: 41960 - RNA, 423 nt, Artificial Sequence
  derived and/or modified sequence opt5 from anti-HIV-1_HeavyChain
cagguguacagcggcgccgggagaggaggcgucaagaaacccggggcuuccguuacccugucuugcaagacagccgacgaggauguguucgacgcggcuuauaugcacugggugcggcaagccccuggacagacguuugaauggcucggcuggaugaaaccggucaccggggccgugaacuacgcucgcaaguuccagggaagaguuagcuuuuaucggacacgcgagcugggcaucgccuacauggaucuuagaaaucugcgguucgacgauaccgcuguguauuuuugugcccgcaaaacagcgggcgacgucuccggggauaagagaggauucuuuuucgaccucuggggccgggggucucgcgugauuguuagcuccgccucuaccaagggacccagcguguuuccuacaaucuacguc

SEQ ID NO: 41961 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucucuagcgcuuuuaccaagggacccuccguguucccucacgaccugcgc

SEQ ID NO: 41962 - RNA, 414 nt, Artificial Sequence
  derived and/or modified sequence opt5 from anti-HIV-1_HeavyChain
caggugcaacugggccagagcggggccgagaugaagaaacccggauccucugucaagguuagcugcaaggcuuccggcgggaccuucagacacucuccuaucagcugggugcggcaggccccgggacagggccucgaauggauugggugggugaaagcggucuccggagcugugaacuacggcucucuggacuuucgccauagaguuagccuuacacgggaucgcgaccuguccacggcccacauggauaucagaggccucacccaagacgauacagccaccuauuucugugcucggcagaaauuugcccgcggggaccagggaugguucuuugaucuguggggcagagggacacuuauuguggucagcucugcuuccaccaagggacccagcguguucccucaugaccugcgg

SEQ ID NO: 41963 - RNA, 417 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagaccgugacaggagcggucaacuuuggcagcccgaauuuccgccauagagugucccuuacccgggaccgcgaucuguuuacagcucacauggacauuagagggcucacccagggagauacagccaccuauuucugugcccggcaaaaauuugagcgcggcggccaggggugguacuucgaccuguggggaagaggcacgcuuaucguugugucuagcgcuuccaccaaggggcccagcgucuuuccucaugaucugcgg

SEQ ID NO: 41964 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggauggcuuacauggaucuucggaaccugcgcuucgacgauaccgccguguauuuuugugcgagaaaaacagccggagacgucuccggcgauaaucggggcuacuucuuugaccucugggggcgcggaucuugggugaucguuagcuccgcuucuaccaagggccccagcguguucccucaugaucugaga

SEQ ID NO: 41965 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccgggugauuguuucuagcgccuccaccaaggggcccucuguguuuccuacaaucugcguc

SEQ ID NO: 41966 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuuuugugcuagacagaaauucgcccggggcgaucaaggcugguuuuucgaccugugggggcgcggaacccucaucguggucucuagcgcuuccacaaagggcccuagcguguuuccgcacgaucugaga

SEQ ID NO: 41967 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccgggugauuguuucuagcgccuccaccaaggggcccucuguguuuccuacaaucuacguc

SEQ ID NO: 41968 - RNA, 423 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauguuuuugacgcugccuacaugcacugggugagacaggccccuggccagacguucgaguggcugggguggaugaaaccggugaccggagcugucaacuaugcccggaaguuucagggccgcgugucuuucuacagaacacgggaacucgggaucgcuuauauggaucugcgcaaucuuagauuugacgauaccgccguuuacuucugugcgcggaaaacagccggagacgugagcggcgauaagcgcggcuuuuucuuugaccugugggggagaggaucccgggucauugugucuagcgcuuccaccaagggccccucuguuuucccucaugaucuccgc

SEQ ID NO: 41969 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugaacuacgcccggaaguuccagggccgcguuucuuuuuauagaacacgggaacuggggaucgcuuacauggaucuucgcaaucugagacucgacgauaccgccguguauuucugugcgcggaaaacagccggagacgucagcggcgauaagcgcggcuuuuucuuugaccugugggggagaggaucccgggugauuguuucuagcgcuuccaccaagggccccucuguguucccucaugaucuucgc

SEQ ID NO: 41970 - RNA, 420 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgugagcucugccuccacgaaggggccgagcguuuuccccaccauc

SEQ ID NO: 41971 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuagagugaucguuagcuccgccucuaccaaggggcccagcguguucccuacaauuugcguc

SEQ ID NO: 41972 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguauuacgcuggcgggcagggaugguauuuugaccuguggggccgcgggacacuuaucguggucagcuccgccagcaccaaaggaccgucuguguucccccaugaucugaga

SEQ ID NO: 41973 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucugucuuuccccaugaucugcgc

SEQ ID NO: 41974 - RNA, 423 nt, Artificial Sequence
  derived and/or modified sequence opt5 from anti-HIV-1_HeavyChain
cagguguacaugggcgccgggagaggaggcgucaagaaacccggggcuagcguuacccuguccugcaagacagccgacgaggauguguucgacgcggcuuauaugcacugggugcggcaagccccuggacagacguuugaauggcucggcuggaugaaaccggucaccggggccgugaacuacgcucgcaaguuccagggaagaguuucuuuuuaucggacacgcgagcugggcaucgccuacauggaucuuagaaaucugcgguucgacgauaccgcuguguauuuuugugcccgcaaaacagcgggcgacgucagcggggauaagagaggauucuuuuucgaccucuggggccgggggucccgcgugauuguuucuagcgccuccaccaagggacccucuguguuuccuacaaucuacguc

SEQ ID NO: 41975 - RNA, 423 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcaguuccaagggcgcgucucuuuuuauagaacacgggaacucggaauugccuacauggaucugcgcgaccuuaaguucgaugacaccgcuguguauuuuugugccagaaaaacaaagggcgauguuagcggcgacgaucggggguucuuuuucgaccuguggggacgcggcaccagagugaucgucuccucugcgagcacaaaggggcccuccguguuuccuaccauuugcguu

SEQ ID NO: 41976 - RNA, 423 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcaguuccaagggcgcgucucuuuuuauagaacacgggaacucggaauugccuacauggaucugcgcgaccuuaaguucgaugacaccgcuguguauuuuugugccagaaaaacaaagggcgauguuagcggcgacgaucggggguucuuuuucgaccuguggggacgcggcaccagagugaucgucuccucugcgagcacaaaggggcccuccguguuuccucaugaucuccgg

SEQ ID NO: 41977 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugaacuacgcccggaaguuccagggcaaaguuucuuuuuaucgcacaagagaacuggggaucgcuuacauggaucuucggaaucugcgcuucgacgauaccgccguguauuuuugugcgagaaagacagccggagacgucagcggcgauaagcggggcuucuuuuucgaccucugggggcgcggauccagagugauuguuucuagcgcuuccaccaaaggccccucuguguuuccucaugaucugcgg

SEQ ID NO: 41978 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugaacuacgcccggaaguuccagucucgcguuagcuuuuauggcacaagagaacuggggaucgcuuacauggaucuucggaaucugcgcuucgacgauaccgccguguauuuuugugcgagaaaaacagccggagacgucuccggcgauaagcggggcuucuuuuucgaccucugggggcgcggaucuagagugauuguuagcuccgcuucuaccaagggccccagcguguuuccucaugaucugcgg

SEQ ID NO: 41979 - RNA, 420 nt, Artificial Sequence
  derived and/or modified sequence opt5 from anti-HIV-1_HeavyChain
cagggccacaccguggagcaaagcggguccggagucaagaaacugggcgccucuguuagagugagcugcuggacauccgaagacaucuucgagacgaccgaacucauucauugggugcggcaggcucccgggcagggacuggaguggaucggcugggucaagacagugucuggggccguuaacuuuggaagccuuaauuuccgccacagagugucccugacccgggaucgcgaccucuuuacagcgcauauggauauuagaggccugacccagggcgacacagcuaccuacuucugugcccggcaaaaauuugcccgcggggaucagggaugguucuuugaccuuuggggcagagggacgcugaucgucgugucuagcgcuuccaccaagggaccuagcguuuucccgcacgaucuccgg

SEQ ID NO: 41980 - RNA, 420 nt, Artificial Sequence
  derived and/or modified sequence opt5 from anti-HIV-1_HeavyChain
caggccacccccuggagcaaccugggcagaggggugaagaaacucggagcuuccguccggguuucuugcuggacaagcgaggacaucuucgaacgcacggagcugauucacugggugagacaagccccuggccaggggcuugaauggaucggaugggugaagaccgucacaggcgcggugaauuuuggguccccgaacuuccggcaucgcguuucucugaccagagaucgggaccucuuuacagcucacauggauauucgcggacugacccagggcgacacagccaccuacuucugugccagacagaaauuugagcggggcgggcaaggaugguauuucgaucuuuggggccgcgggacgcugaucguggucagcuccgcuucuaccaagggacccagcguguuuccucaugaccucaga

SEQ ID NO: 41981 - RNA, 423 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauguuuuugacgcugccuauaugcacugggugagacaggccccuggccagacguucgaguggcugggguggaugaaaccggugaccggagcugucucuuaugcccggaaguuucagggccgcgugagcuucuacaugacaagagaacucgggauggcuuauauggaucugcggaaccuucgcuuugacgauaccgccguuuacuucugugcgagaaaaacagccggagacguguccggcgauaaucggggcuacuuuuucgaccugugggggcgcggaucuagagucaucgugagcuccgcuucuaccaagggccccagcguuuuuccucaugaucuccgg

SEQ ID NO: 41982 - RNA, 423 nt, Artificial Sequence
  derived and/or modified sequence opt5 from anti-HIV-1_HeavyChain
cagguguacauggagcaaagcggcgggggagucaagaaacccggcgccuccguuacccugucuugcaagacagcugacgaagauguguucgacgccgcguauaugcacugggugagacaggcuccugggcagacguuugaguggcucggauggaugaaaccggucaccggcgccgugagcuacgcccggaaguuccaggggcgcguuuccuuuuauagaacacgggaacugggaaucgcuuacauggaucuucgcaaccugagauucgacgauaccgccguguauuuuugugcucggaaaacagccggcgacgucucuggcgauaagcgcggguucuuuuucgaccucuggggaagaggcagccgggugauuguuuccucugcgagcaccaaggggcccuccguguuuccucaugaucugcgc

SEQ ID NO: 41983 - RNA, 423 nt, Artificial Sequence
  derived and/or modified sequence opt5 from anti-HIV-1_HeavyChain
cagguguacauggagagaggccgcgggggagucaagaaacccggcgccagcguuacccuguccugcaagacagcugacgaagauguguucgacgccgcguauaugcacugggugcggcaagcuccugggcagacguuugaguggcucggauggaugaaaccggucaccggcgccgugaacuacgccagaaaguuccaggggcggguuucuuuuuaucgcacaagagaacugggaaucgcuuacauggaucuucggaaucugcgcuucgacgauaccgccguguauuuuugugcuagaaaaacagccggcgacgucagcggcgauaagcggggguucuuuuucgaccucuggggacgcggcuccagagugauuguuucuagcgcguccaccaaggggcccucuguguuuccucaugaucugcgg

SEQ ID NO: 41984 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggcgcuuccaggggagaguuagcuuuuauaugacacgggaacugggaauggccuacauggaucuucgcaaccugagauucgacgauaccgcuguguauuuuugugcccggaagacagcgggcgacgucuccggcgauaaucgcggguacuucuuugaccucuggggaagaggcucucgggugaucguuagcuccgccucuaccaaagggcccagcguguucccuacaauuugcguc

SEQ ID NO: 41985 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuagagugaucguuagcuccgccucuaccaaggggcccagcguguucccucaugaucugcgg

SEQ ID NO: 41986 - RNA, 423 nt, Artificial Sequence
  derived and/or modified sequence opt5 from anti-HIV-1_HeavyChain
cagguguucauggagcaagccggcgggggaaugaagaaacccggcgcuagcaugaccgucuccugcaagacagccgacgaagauaucuuugacgcggcuuacaugcacuggguuagacaggccccugggcagacguucgaguggcugggauggaugaaaccggugaccggcgccgugaacuaugcucggcaguuucaagggcgcgucucuuucuacagaacacgggaacucggaauugccuauauggaucugcgcgaccuuaaguuugaugacaccgcuguguacuucugugccagaaaaacaaagggcgauguuagcggcgacgaucggggguuuuucuuugaccuguggggacgcggcaccagagugaucgucuccucugcgagcacaaaggggcccuccguguucccucaugaucuccgg

SEQ ID NO: 41987 - RNA, 423 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugcuuccagauauucuggcgaccaggggagcuacuucgaucuuuggggacggggcacccugauuguuguguccagcgccucuacgaaggggccguccgucuuuccccacgaccuc

SEQ ID NO: 41988 - RNA, 423 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauguuuuugacgcugccuacaugcacugggugagacaggccccuggcccggaucuggaguggcucggguggaugaaacccgugacgggagcugucaacuaugcccggaaguuccagggccgcgugucuuuuuacagaacccgggaacuggggaucgcuuauauggaccuucgcgaucugagauucgacgauacagccguuuacuuuugugcgcggaaaaccgccggagacgugagcggcgauaagcgcggcuucuuuuucgaccucugggggagaggaucccgggucauugugucuagcgcuuccacaaaggcccaucgcucuagcccuaccaucugcguu

SEQ ID NO: 41989 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggauuagccuuacacgcgauagagaccuguuuaccgcucauauggauauccggggacucacacagggcgacaccgccacauacuucugugcccgccaaaaauuugaauccagauauaccggcgggcagggaugguacuucgaucuguggggccgggggacgcacauuguugugucuagcgcuuccaccaagggacccagcgucuuuccucaugaccuucgc

SEQ ID NO: 41990 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucaaugacaccgcuguguauuuuugugccagaaaaacagcgggcgaugucuccggcgacaaccggggguacuucuuugaucucuggggacgcggcucuagagugaucguuagcuccgccucuaccaaggggcccagcguguucccucaugaccugcgg

SEQ ID NO: 41991 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaaccgcggguacuucuuugaccucuggggaagaggcucccgggugauuguuucuagcgccuccaccaaggggcccucuggacugccucaugaucuucgc

SEQ ID NO: 41992 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacggcaccgcuguguauuuuugugcccggaaaacagcgggcgaugucagcggggacaagcgcggauucuuuuucgaucucuggggcagagggucccgggugauuguuucuagcgccuccaccaagggacccucuguguuuccucaugaccugcgc

SEQ ID NO: 41993 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccgggugauuguuucuagcgccuccaccaaggggcccucuguguuuccucaugaucugcgc

SEQ ID NO: 41994 - RNA, 423 nt, Artificial Sequence
  derived and/or modified sequence opt5 from anti-HIV-1_HeavyChain
caggugcaacugguccagagcggcgccgagguuaagaaacccggggcuucccucaaggugucuugcaaagccagcggauacaccuucacagacuauuacauccacugggugagacaggcgccuggccaggggcuggaauggauuggaugggucaagaucguguccggcacgguuaacuuugcuucucuugauuuccggaaucgcauuagccuguccagagaccgggaucucucuaccgccuauauggacauccgcgggcugacacaagaugacaccgccacauacuuuugugcuagacagaaauucgccagccgguauuccggagaucagggcagcuacuuugaccuuuggggccgcgggacccugauuguggucucuuccgcuagcacaaagggaccgucuguguucccccaugaucucaga

SEQ ID NO: 41995 - RNA, 423 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccugauuguugugagcuccgcuagcacgcgcgcccacagaucuccgcaugaucuccgg

SEQ ID NO: 41996 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacagcggguuagccuuacacgcgauagagaccuguuuaccgcucacauggauauucggggacucacacaaggcgacaccgccacauacuucugugcccgccagaaauuugaauccagauauaccggcgggcagggaugguacuucgaucuguggggccgggggacgcauaucguggucucuagcgcuuccaccaagggacccagcguguuuccucacgaccuucgc

SEQ ID NO: 41997 - RNA, 426 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcuuauauggauauuagaggccugacccaagacgauacagccaccuacuuuugugcccggcagaaauucgcuagccgcuauuccggggaccagggaagcuacuuugaucuuuggggcagaggcacacugaucgucgugucuuccgccagcaccaaggggccgucuguuuucccccagaucugcgug

SEQ ID NO: 41998 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucggguggaugaagacggugagcggaaccgugaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgucagcucugccuccacgaaggcucaccgcagcucuccgaccacacucaga

SEQ ID NO: 41999 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcguuuucccccggucugcu

SEQ ID NO: 42000 - RNA, 423 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggcaccagauuagcgaucgcguuucccuuucuagagaccgggaucugagcaccgcuuacauggacauccgcggacucacacaagaugacaccgccacauauuucugugccagacagaaguuugcuucccgguacagcggcgaucagggcucuuauuucgaccugugggggcgcggaacccuuauuguggucuccagcgccucuacaaaaggcccguccguguuuccccaugaucugaga

SEQ ID NO: 42001 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccacccgggcucaccgcagcucuccgagauccgcc

SEQ ID NO: 42002 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccacagaauuucucuuacccgggaccgcgaucuguuuacagcucauauggacaucagaggacucacccagggcgauacagccaccuacuucugugcccggcaaaaguuugaaagccgcuauacaggcgggcagggaugguacuucgaccuguggggcagagggacccacauuguuguguccagcgcuucuacgaaaggaccguccgucuuuccccaugaucuucgg

SEQ ID NO: 42003 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuuggcuccucugacuuccgcaauagaaucagccuuacacgggaucgcgaccuguccaccgcgcauauggauauuagagggcucacacaggacgauaccgcuacauauuuuugugcccggcaaaaauucgagagccuguacucugacgaucagggauccuauuuugaccuuuggggccgcggcacccugaucaucgugagcucugccuccacgaaggggccgagcguuuuccccaccauuuacgug

SEQ ID NO: 42004 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucgugguuagcucugccuccaccaaggggccgagcguguucccccaugaccuccgg

SEQ ID NO: 42005 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcguuuuccccacgauuugc

SEQ ID NO: 42006 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguccaccgcucauauggauauucggggacucacacaggacgauaccgccacauacuuuugugcccgccaaaaauucgcuagaggcgaccagggcugguuuuucgaucugugggggcggggaacccuuaucguggucucuagcgcccugcaccagggccccauugggcucccuccccgcuccacg

SEQ ID NO: 42007 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaaguuccaggggcgcguuucuuuuuauagaacacgggaacugggaaucgccuacauggaucuucgcaaucugagauucgacgauaccgcuguguauuuuugugcccggaaaacagcgggcgacgucagcggcgauaagcgcggguucuuuuucgaccucuggggaagaggcucccgggugauuguuucuagcgccuccaccaaggggcccucugugcugccuccccgcagcgcu

SEQ ID NO: 42008 - RNA, 423 nt, Artificial Sequence
  derived and/or modified sequence opt5 from anti-HIV-1_HeavyChain
caggugcaacucguccagagcggcgccgagguuaagaaacccggggcuuccgugaagaucucuugcaaagccagcggauacaccuucauuagacacggcauccauuggcuccgccaggugccugggcagcggccggaauggaugggauggauuagacccaagacaggcgcgcggaaccaagcucgccaguuucagccuagaaucucccuggcccgggaccgcgcccuuucuacggcuuaucuggaucucaauagccugaccuccgccgacucugggacauacuucugugcuagacagaccuuuaaacccgauuucuauuuugccgaccaaggauggagcuucaaccuuuggggccggggcgcgcacuuuauugucuccagcgcccugcaucaggggccuaucggacugcccccucgcucuaca

SEQ ID NO: 42009 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggacagggccuggaguggaucgggugggugaagauugugagcggaacggucaacuuugcgucccuugauuucagaaaucggaucucucugagccgcgacagagaucucuccaccgcuuauauggacauucggggccugacacaggaugacaccgccacauacuuuugugcccgccaaaaauucgcuagcagauauucuggggaucagggauccuacuuugaccuuuggggccggggcacccugaucgugguuagcucugccuccacaaaggggccgagcguguucccccaugaucuccgc

SEQ ID NO: 42010 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauaccuuugugcccgccaaaaauucgaauccagauauaccggcgggcagggaugguacuuugaccuguggggccgggggacgcacauuguugugucuagcgcuuccaccaagggaccgagcgucuuccccacaaucugcgug

SEQ ID NO: 42011 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgauacaacggagcucauuuacugggugcggcaggccccuggccaggggcuggaauggaucggaugggugaagauugucucuggcaccgugaacuuugcgagccuugacuuccgcaauagaaucucccugucucgggaucgcgaccucagcacagcuuauauggauauuagagggcugacccaggacgauacagccaccuacuuuugugcccggcaaaaauucgcuucccgcuauagcggagaccagggcucuuacuuugaucuuuggggcagagggacacugaucguuguguccagcgccucuaccaagggaccguccgucuucccccagaucugcgug

SEQ ID NO: 42012 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcacauuguugugucuagcgcuuccaccaagggaccgagcgucuuucccacaaucugcgug

SEQ ID NO: 42013 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccuguauuccgacgaucagggcagcuacuucgaccuuugggggcgcggaacacugaucauugugucuuccgcuagcaccaaaggcccgucugucuuucccacgaucugcgug

SEQ ID NO: 42014 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaucuagauauacaggcgggcagggaugguacuucgaucuguggggccgggggacccacaucguggucagcuccgcuagcacgaagggacccucuguguuuccucaugaccuucgc

SEQ ID NO: 42015 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcguuuuccccacgauuugcgug

SEQ ID NO: 42016 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaagacgauacagcuaccuacuucugugcccgccagaaauuugccuccagauauucuggcgaccagggcagcuacuucgaucuuugggggcggggaacgcugaucguggucuccagcgcuucuaccaagggcccguccguguuucccacaauuugcguu

SEQ ID NO: 42017 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggcaccggagcucuccgacgauuugcguu

SEQ ID NO: 42018 - RNA, 423 nt, Artificial Sequence
  derived and/or modified sequence opt5 from anti-HIV-1_HeavyChain
cagguguacauggagcaagccggcgcugggaugaagaaacccggagccagcaugaccgucuccugcaagacagcggacgaagauguuuucgacgcugccuauaugcacugggugagacaggccccuggccagacguuugaguggcugggguggaugaaaccggugaccggagcugucaacuacgcccggaaguuccagggccgcgugucuuuuuauagaacacgggaacucgggaucgcuuacauggaucugcgcaaucuuagauucgacgauaccgccguuuauuuuugugcgcggaaaacagccggagacgugagcggcgauaagcgcggcuucuuuuucgaccugugggggagaggaucccgggucauugugucuagcgcuuccaccaagggccccucuguuuuuccuacaaucuacgug

SEQ ID NO: 42019 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucuacuggguucggcaggccccuggacagggccuggaauggauugggugggugaagaucgugagcggaaccgucaacuuugcgucccuugacuuccgcaauagaauuucucugagccgggaucgcgaccucuccacagcuuauauggauaucagaggccugacccaggacgauacagccaccuacuuuugugcccggcaaaaauucgcuagccgcuauucuggggaccagggauccuacuuugaucuuuggggcagaggcacacugauugugguuagcucugccuccaccaaggggccgagcguguucccccaugaccuccgg

SEQ ID NO: 42020 - RNA, 423 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgcgccaguuccaaggcagaguguccuuuuaucggacacgcgagcuugggaucgcuuacauggaccugagagaucucaaauucgacgauaccgccguuuauuuuugugcccggaagacaaaaggagacgugucuggcgaugaccgcggcuucuuuuucgaucugugggggagaggaacccgggucauugugagcuccgcuagcacaaagggcccgucuguuuuuccccaugacccugcc

SEQ ID NO: 42021 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccgcuauacaggcgggcagggaugguacuucgaccuguggggcagagggacccauaucguggucuccagcgcuucuacgaaaggaccguccguguuucccaccauuugcguu

SEQ ID NO: 42022 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacagcggguuucccuuacccgcgauagagaccugucuacagcucacauggauauucggggacucacccaagacgauacagccaccuacuuuugugcccgccagaaauucgaaagccuguauuccgacgaucagggcagcuacuuugaccuuuggggcagagggacacugaucauugugucuuccgcuagcaccaagggacccucugucuucccuacgaucugcgug

SEQ ID NO: 42023 - RNA, 426 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagcgcacagaacucauuuacugggugagacaggcgccuggacagggccuggaguggaucgggugggugaaaacggucucuggagcugugaacuuuggcagccaggauuuccgggaccgcuuuucccuuaccagagaucgggaccuguucacagcccauauggauauucgcgggcucacccaaggagacacagccaccuauuuuugugcuagacagaaguucgccucucgguacagcggcgaucagggcuccuauuuugaccugugggggcgcggaacacuuaucguugugagcucugcuuccaccaaaggcccgagcgucuuccccacgauuugcgug

SEQ ID NO: 42024 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgaaucuagauacaccggcggccaggggugguauuuugaucuguggggacggggcacacacaucguggucagcuccgccagcaccaaggggccuucuguguucccgacgauuugcguu

SEQ ID NO: 42025 - RNA, 423 nt, Artificial Sequence
  derived and/or modified sequence opt5 from anti-HIV-1_HeavyChain
caggugcacauggagcaagccggcgggggaaugaagaaacccggcgcuagcaugaccgucuccugcaagacagccgacgaagauaucuucgacgcggcuuacaugcauuggguuagacaggccccugggcagacguuugaguggcugggauggaugaaaccggugaccggcgccgugaacuaugcucggcaguuccaagggcgcgucucuuuucuccaggaucagggaauuagaaucgccuacauggaccugcgggaucuuaaguucgacgauacagcuguguauuuuugugcccgcaaaaccaagggcgacguuagcggcgaugacagaggguucuuuuucgaucuguggggacggggcacacgcgugauugucuccucuagccuccaccaggggcccaucggacugccucccagauccgcg

SEQ ID NO: 42026 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccacagaauuucucuuacccgggaccgcgaucuguuuacagcucauauggacaucagaggacucacccagggcgauacagccaccuacuucugugcccggcaaaaguuugaaagccgcuauacaggcgggcagggaugguacuucgaccuguggggcagagggacccacauuguuguguccagcgcuucuacgaaaggaccguccgucuuucccaccaucuaugug

SEQ ID NO: 42027 - RNA, 426 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugaacuacgcucggaauuuccaggggcgcguuucuuuuuauagaacacgggaacugggaaucgccuacauggaucuucgcaaccugagauucgacgauaccgcuguguauuuuugugcccggaagacaaaaggcgacgucagcggcgaugaccgcggguucuuuuucgaucucuggggaagaggcacccgggugauuguuuccucugggcugcaucaacgcgcgcacagaagcucccccacaaucugcgug

SEQ ID NO: 42028 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucgugguuagcucugccuccaccaaggggccgagcguguuccccacgaucugcguc

SEQ ID NO: 42029 - RNA, 423 nt, Artificial Sequence
  derived and/or modified sequence opt5 from anti-HIV-1_HeavyChain
cagguguacauggagcaagccggcgucgggguuaagaaacccggagcuagcgugacccuguccugcaagacagccgacgaagauguguucgacgcggcuuauaugcacugggucagacaggccccuggcccggaucucgaguggcugggguggaugaaacccgugacgggagccguuaacuacgcucggaaguuucagggccgcgugucuuucuauagaacccgggaacuugggaucgccuacauggaccugcgcaaucucagauuugaugacacagcugucuauuucugugcccggaaaaccgcgggagaugugagcggcgacaagcgcggcuuuuucuuugaucugugggggagaggaucccggguuauugugucuagcgccuccacaaagggcccuucugucuuccccaccaucugcgug

SEQ ID NO: 42030 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcguuuucccccacgaccuccgg

SEQ ID NO: 42031 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucacgggcgcugugaacuuugggucucuggauuucagacaccggauuagccucacccgcgacagagaucuguuuacagcccauauggacauccggggacuuacccagggcgauacagccaccuacuucugugcucgccaaaaauuugaauccagauauacaggcgggcagggaugguacuucgaccuguggggccgggggacccacauuguugugucuagcgccuccacgaagggaccuagcgucuuuccgcaugaucuccgc

SEQ ID NO: 42032 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggagagaaucggaugggugaagacggucaccggcgcggugaacuuugggucucuugauuuccggcaccgcauuagccugacaagagaccgggaucucuuuaccgcucauauggacauccgcggacugacacagggcgauaccgccacauacuucugugccagacaaaaauuugaaucccgguauaccggcgggcagggaugguacuucgaccuuuggggccgcgggacgcacauuguugugucuagcgcuuccaccaagggaccgagcgucuuucccacaaucugcgug

SEQ ID NO: 42033 - RNA, 423 nt, Artificial Sequence
  derived and/or modified sequence opt5 from anti-HIV-1_HeavyChain
gagguguacauggaaagaggccgcgggggagucaagaaacccggcgccagcgcuacccuguccugcaagacagccgacgaggauguuuucgacgcggcuuauaugcacugggugcggcaggccccugggcaaacguuugaauggcucggauggaugaaaccggugaccggcgccgucucuuacgcuagaaaguuccaggggcgggugagcuuuuauaugacacgcgagcugggaauggccuacauggaucuuagaaaccugcgguucgacgauaccgcuguuuauuuuugugcccgcaaaacagcgggcgacguguccggcgauaauagaggguacuucuuugaccucuggggacggggcucucgcgucaucgugagcuccgccucuaccaaggggcccagcguuuucccucaugaucugaga

SEQ ID NO: 42034 - RNA, 426 nt, Artificial Sequence
  derived and/or modified sequence opt5 from anti-HIV-1_HeavyChain
caggcccaccuggagcaaagcggcuccggggugaagaaacccggagcuucugccagagucagcugcugguccucugaagacaucuucgagcggauugaacucauccauuggguucgccaggcgccuggccaggggcuggaguggauuggaugggugaagaccguggcuggcgccgucaacuuugggagccuugauuucagacaccggaucucccugacacgcgacagagaucucuuuacggcccauauggacauucggggacugacccagggcgauacagcuaccuacuucugugcccgccaaaaauuugaaucuagauauacaggcgggcagggaugguacuucgaccuuuggggccgggggacccacaucgugguuagcuccgcuagcacaaagggaccgucuguguuuccccaugaucugcgc

SEQ ID NO: 42035 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugcggcaggacgauaccgccacauauuuuugugcccgccaaaaauucgagagcagauacucuggggaccagggauccuauuuugaucuuuggggccggggcacccugaucaucgugagcucugcuuccacaaaggggccgagcguuuuccccaccauuuacgug

SEQ ID NO: 42036 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauggcaucucucugagcagagaucgggaccucuccacagcuuauauggauauucgcgggcugacccaggacgauacagccaccuacuuuugugccagacaaaaauucgcuagccgguauucuggagaccagggcuccuacuuugaucuuuggggccgcgggacacugaucgugguuagcucugccuccaccaagggaccgagcguguucccccaugaccucaga

SEQ ID NO: 42037 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucgugguuagcucugccuccaccaaggggccgagcguguucccccacgaccuccgg

SEQ ID NO: 42038 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccggcgacauccuccggaagucugaacugauucauugggugcgccaggccccugggcagggacuugaguggaucggcugggugaaaacagucacgggggcggugaacuucggaagccuggauuuuagacaccggauuucccucacccgcgacagagaucuguucacagcucauauggacauccggggccuuacccagggcgauacagccaccuacuuuugugcccgccaaaaguucgaaucuagauauacagggggacagggcugguacuuugaccugugggggcggggaacccacauuguugugagcuccgcuagcacgaaaggcccgucugucuucccccaugaucuccgc

SEQ ID NO: 42039 - RNA, 426 nt, Artificial Sequence
  derived and/or modified sequence opt5 from anti-HIV-1_HeavyChain
caggugcaccuggagcaaagcggcuccggggucaagaaacccggagccucuguuagagugagcugcugguccucugaagacaucuucgagcggaccgaacucauucauugggugcgccaggcuccuggccaggggcuggaguggaucggaugggucaagacagugacgggcgccguuaacuuugggagccuugauuucagacaccggauuucccugacccgcgacagagaucucuuuacagcgcauauggacauccggggacugacccagggcgauacagcuaccuacuucugugcccgccaaaaauuugaaucuagauauacaggcgggcagggaugguacuucgaccuuuggggccgggggacccacauuguggucagcuccgccugcacgaagggaccgagcguguuuccccaugaucugcgc

SEQ ID NO: 42040 - RNA, 426 nt, Artificial Sequence
  derived and/or modified sequence opt5 from anti-HIV-1_HeavyChain
caggcccaccuggagcaaagcugguccggcgugaagaaacccggggcuucugucagaguuagcugcugguccucugaagacaucuucgagcggaccgaacucauucauugggugcgccaggccccuggacagggccuggaguggaucgggugggugaagacagucacgggagcggugaacuuuggcagccuugauuucagacaccggauuucccugacccgcgacagagaucucuuuacagcucauauggacauccgggggcugacccagggagauacagccaccuacuucugugcccgccaaaaauuugaaucuagauauacaggcggccaggggugguacuucgaccuuuggggacggggcacccacauuguugugagcuccgcuagcacgaaggggccgucugucuuuccccaugaucugcgc

SEQ ID NO: 42041 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggcccggaguggaucgggugggugaagacggugagcggaaccgucaacuuuggcuccucugauuuccggaaucgcauuagccugacaagagaccgggaucuuuccaccgcgcauauggacauccgcgggcugacacaggaugacaccgcuacauauuuuugugccagacagaaauucgaaagccucuacucugaugaccaaggauccuauuuugaucuguggggccggggcacccuuauuaucgugagcucugccuccacgaaggggcccagcguuuucccucacgaccugcgc

SEQ ID NO: 42042 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucugucuuucccaccauccugcgc

SEQ ID NO: 42043 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauugccgugagcucugcuuccacgaaggggccgagcguuuucccccacgaccuccgc

SEQ ID NO: 42044 - RNA, 426 nt, Artificial Sequence
  derived and/or modified sequence opt5 from anti-HIV-1_HeavyChain
cagagccaccugaagcaauccggcucugccaugaaaaagcccggggcuagcgugagagucuccugcuggaccucugaggacaucuucgaacggacagagcucauuuacuggguucgccaggccccuggaagaggccuggaauggaucgggugggugaaaacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaguucgagagccuguacucugaugaccaaggauccuauuuugaucuuuggggccggggcacccugauuaucgugagcucugccuccacgaaagggccgagcguuuucccccacgaccuccgc

SEQ ID NO: 42045 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucgaaugggugaaggcggucucuggagcugugaacuacggcagccuggauuuuagacaccggguuucccucacgcgcgacagagaucuguucaccgcccauauggacauucgggggcuuacacaggaugacaccgccacauauuuuugugcucgccaaaaauucgagucuagauacaccggaggccagggcugguauuuugaucugugggggcggggaacacacaucguggucagcuccgccagcaccaagggcccuucuguguucccgcaugaccuccgc

SEQ ID NO: 42046 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgagagccgcuacucuggggaccagggauccuauuuugaucuuuggggcagaggcacacugaucaucgugagcucugcuuccaccaaggggccgagcguuuucccccacgaccuccgg

SEQ ID NO: 42047 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagccuugauuuccgcaauagaauuucccugucucgggaccgcgaucucagcaccgcuuacauggacaucagaggacugacacaggaugacaccgccacauauuuuugugcccggcaaaaguucgcuucccgcuacagcggcgaucagggcucuuauuuugaccuuugggggagaggaacccugauuguuguguccagcgccucuacaaaaggcccguccgucuucccccacgaucuccgg

SEQ ID NO: 42048 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacagcggguuucccuuucucgcgauagagaccugagcaccgcucacauggauauucggggacucacacaagacgauaccgccacauacuuuugugcccgccagaaauucgcuuccagauauagcggcgaccagggcucuuacuuugaucugugggggcggggaacccuuaucauuguguccagcgccucuacaaagggccccuccgucuucccucaugaccugcgc

SEQ ID NO: 42049 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgugagcucugccuccacgaaggggccgagcguuuucccccacgaccuccgc

SEQ ID NO: 42050 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggcagagggcuggaguggaucggaugggugaagacggucucuggcaccgugaacuuugggagcuccgauuuccggaaucgcauuucucuuacaagagaccgggaucugagcaccgcgcacauggacauccgcggacucacacaggaugacaccgcuacauacuuuugugccagacagaaauucgaaucccuguauagcgaugaccaaggcucuuacuuugaucuuuggggccgggggacccugauuaucguuuccagcgccucuacgaagggaccguccguguucccccaugaccuccgc

SEQ ID NO: 42051 - RNA, 426 nt, Artificial Sequence
  derived and/or modified sequence opt5 from anti-HIV-1_HeavyChain
caggugcaccuggagcaaagcggcuccggggucaagaaacccggagccucuguuagagugagcugcugguccucugaagacaucuucgagcggaccgaacucauucauugggugcgccaggcuccuggccaggggcuggaguggaucggaugggucaagacagugacgggcgccguuaacuuugggagccuugauuucagacaccggauuucccugacccgcgacagagaucucuuuacagcgcauauggacauccggggacugacccagggcgauacagcuaccuacuucugugcccgccaaaaauuugaaucuagauauacaggcgggcagggaugguacuucgaccuuuggggccgggggacccacauuguggucagcuccgccagcacgaagggaccgucuguguuuccccaugaucugcgc

SEQ ID NO: 42052 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugcggcaggacgauaccgccacauauuuuugugcccgccaaaaauucgagagcagauacucuggggaccagggauccuauuuugaucuuuggggccggggcacccugaucaucgugagcucugcuuccacaaaggggccgagcguuuucccccacgaccuccgc

SEQ ID NO: 42053 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggguggcuuacauggaucuucggaaccugcgcuucgacgauaccgccgucuauuuuugugcgagaaaaacagccggagacguguccggcgauaaucggggcuacuucuuugaccucugggggcgcggaucuagaguuaucgugagcuccgcuucuaccaagggccccagcgucuucccucaugaucugcgg

SEQ ID NO: 42054 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcaaccucuccacagcucauauggacauuagaggccugcggcaggaugacaccgccacauauuuuugugcccgccaaaaauucgagagcagauacucuggggaucagggauccuauuuugaccuuuggggccggggcacccugaucaucgugagcucugcuuccacaaaggggccgagcguuuucccccacgaucuccgc

SEQ ID NO: 42055 - RNA, 423 nt, Artificial Sequence
  derived and/or modified sequence opt5 from anti-HIV-1_HeavyChain
caggugcaacugguccagagcggcgccgagguuaagaaacccggggcuuccgugacccucucuugcaagacagccgacgaagauguguucgacgcggcuuacaugcacugggucagacaggccccuggacagacguuugaguggcugggcuggaugaaaccggugaccggggccguuagcuaugcucggaaguuccaaggacgcguguccuuuuacaugacaagagaacuuggcauggccuauauggaucugcggaaccuccgcuucgacgauaccgcugucuacuuuugugccagaaaaacagcgggggacgugucuggagauaaucggggcuauuucuuugaccuguggggccgcgggagcagaguuaucguguccucugccagcaccaagggacccuccgucuucccuacaauuuacgug

SEQ ID NO: 42056 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucgugcauugggugcgccaggccccuggccaggggcuggaguggauuggaugggucaagacggugaccggcgcgguuaacuuugggucuccgaauuucagacagcgggugagccuuacacgcgauagagaccuguuuaccgcucacauggauauccggggacucacacaagacgauaccgccacauacuucugugcccgccagaaauuugcuuccagauauucuggcgaccagggcagcuacuucgaucugugggggcggggaacccuuauugucguguccagcgccucuacgaagggccccuccguuuuuccucaugaccugcgc

SEQ ID NO: 42057 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucaucgugagcucugccuccaccaaggggccgcucggacugccccaugaccugcgg

SEQ ID NO: 42058 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagcagauacuccggcgaucagggcagcuauuucgaccugugggggcggggaacccucaucguggucucuuccgcuagcacaaagggcccuucuguguuuccgcacgaucugcgc

SEQ ID NO: 42059 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauuuacugggugcgccaggccccuggccaggggcuggaguggaucggaugggugaagauugucucuggcacggugaacuuugcgagccuugauuucagaaaucggaucucccugucucgcgacagagaucucagcaccgcucauauggacauucgggggcugacacaggaugacaccgccacauauuuuugugcccgccaaaaauucgcuuccagauacagcggagaucagggcucuuauuuugaccuuuggggccgggggacccugaucaucguuuccagcgccucuacaaagggaccguccguguucccccacgaucuccgc

SEQ ID NO: 42060 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagaaaccggauuagccuuacacgcgauagagaccuguccaccgcucacauggauauccggggacucacacaggacgauaccgccacauacuuuugugcccgccaaaaauucgaaucucuguauagcgacgaucagggcuccuacuuugaccuuuggggcagagggacccugauuaucguuagcucugcuuccacgaagggacccagcguguucccucaugaucuccgg

SEQ ID NO: 42061 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccuguauuccgacgaucagggcagcuacuucgaccuuugggggcgcggaacacugaucauugugucuuccgcuagcaccaaaggcccgucugucuuuccccaugaucucaga

SEQ ID NO: 42062 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuagcgauuucagaaaucggauuucccuuacacgcgacagagaucugucuaccgcucacauggacauccggggacucacacaggaugacaccgccacauacuuuugugcccgccaaaaauucgaaagccuguauuccgaugaccagggcagcuacuuugaucuuuggggcagagggacccugauuaucguuucuuccgcuagcacgaagggaccgucuguguucccccaugaccuccgg

SEQ ID NO: 42063 - RNA, 426 nt, Artificial Sequence
  derived and/or modified sequence opt5 from anti-HIV-1_HeavyChain
cagagccaccuggagcaauccggcucugccaugaagaaacccggggcuagcgccagaguguccugcuggaccucugaagacaucuucgauacaacggagcucauuuacuggguccggcaggcgccuggacagggccuggaauggaucggguggguuaagauugugagcggaaccgugaacuuugcuucccuugacuuccgcaauagaaucucucugagccgggaucgcgaccucuccacagcccauauggauauuagaggccugacccaggacgauacagccaccuauuuuugugcucggcaaaaauucgccagccgcuacucuggggaccagggauccuauuuugaucuuuggggcagaggcacacacaucgucgugagcucugcuuccaccaaggggccgagcguuuucccccaugaccugcgg

SEQ ID NO: 42064 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgaaucuagauacaccggcggccaggggugguauuuugaucuguggggacggggcacacacaucguggucagcuccgccagcaccaaggggccuucuguguucccgcaugaccuccgc

SEQ ID NO: 42065 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugaaagcagauacaccggcggccaggggugguauuucgaucuguggggacggggcacacacaucguggucuccagcgccucuaccaaggggccuuccguguuuccgcaugaccuccgc

SEQ ID NO: 42066 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgccagccgguacucuggagaucaaggcuccuauuuugaccuguggggccgcgggacccuuauuaucgugagcucugcuuccacgaagggaccgagcguuuucccccacgaucugaga

SEQ ID NO: 42067 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcgcauggacaucagagggcucacacaggaugacaccgcuacauauuuuugugcccggcagaaauucgaaagccuguacucugaugaccaaggauccuauuuugaucuuuggggccgcggcacccugauuaucgugagcucugccuccacgaaggggccgagcguuuuccccaccgaccucaga

SEQ ID NO: 42068 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaagaugacacagccaccuacuucugugcccggcagaaguuugcuagccgcuauuccggcgaucagggcagcuacuucgaccugugggggagaggaacacuuaucguggucucuuccgccagcaccaaaggcccgucuguguuuccccaugaucugcgg

SEQ ID NO: 42069 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuuuggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauuaucgugagcucugccuccacgaacgggccgaucggacucccccacgaccugcgc

SEQ ID NO: 42070 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccgcuauacaggcgggcagggaugguacuucgaccuguggggcagagggacccauaucguggucuccagcgcuucuacgaaaggaccguccguguuuccccacgaucuucgg

SEQ ID NO: 42071 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacaggacgauaccgccacauacuucugugcccgccaaaaauuugcuuccagauauucuggcgaccagggcagcuacuucgaucugugggggcggggaacccuuaucguggucuccagcgccucuacgaagggccccuccguguuuccucacgaccugcgc

SEQ ID NO: 42072 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacaggacucauuuacuggguucgccaggccccuggcagagggcuggaauggaucggaugggugaagacggugagcggcaccgucaacuuuggguccucugauuuccggaaucgcauuagccuuacaagagaccgggaucuguccaccgcgcauauggacauccgcggacucacacaggaugacaccgcuacauauuuuugugccagacagaaauucgagagccuguacucugaugaccaaggcuccuauuuugaucuuuggggccgggggacccugauuaucgugagcucugccuccacgaagggaccgagcguuuucccccacgaccuccgc

SEQ ID NO: 42073 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucagauuuucagacaccggaucagccuuacacgcgauagagaccuguuuaccgcucauauggauauucggggacucacacaaggcgacaccgccacauacuucugugcccgccagaaauuugaauccagauauaccggcgggcagggaugguacuucgaucuguggggccgggggacgcacaucguugugucuagcgcuuccaccaagggaccgagcgucuuuccccaugaccuucgc

SEQ ID NO: 42074 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauucauuggguucggcaggccccuggacagggccuggaauggaucgggugggugaagaccgugacaggagcggucaacuuuggcagccuugacuuccgccacagaauuucccugacccgggaucgcgaccucuuuacagcucauauggauaucagagggcugacccagggagacacagccaccuacuucugugcccggcaaaaauuugagucucgcuauacgggcggccaggggugguacuucgaucuuuggggaagaggcacccacauugugguuagcuccgcuagcacaaaggggccgucuguguuuccccaugaccugcgg

SEQ ID NO: 42075 - RNA, 426 nt, Artificial Sequence
  derived and/or modified sequence opt5 from anti-HIV-1_HeavyChain
cagagccaccuggagcaauccggcucugaagugaagaaacccggggccagcgucagaguuuccugcuggaccucugaggacaucuucgaacggacagagcucauuuacugggugcgccaggcuccuggaagaggccuggaauggaucgggugggugaagacggucagcggaaccgugaacuuuggcuccucugauuuccggaaucgcauuagccuuacaagagaccgggaucuguccaccgcccauauggacauccgcgggcucacacaggaugacaccgcgacauauuuuugugcuagacagaaauucgagagccuguacucugaugaccaaggauccuauuuugaucuuuggggccggggcacccugauuaucguuagcucugccuccacgaaggggccgagcguguucccccacgaccuccgc

SEQ ID NO: 42076 - RNA, 423 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauaucuucgacgcggcuuauaugcacugggugagacaggccccugggcagacguuugaguggcucggauggaugaaaccggugaccggcgccgucaacuacgcucggcaguuccaagggcgcgugucuuuuuauagaacacgggaacugggaauugccuacauggaucuucgcgaccugaaguucgaugacaccgcuguuuauuuuugugccagaaaaacaaagggcgaugugagcggcgacgaucggggguucuuuuucgaccucuggggacgcggcaccagagucaucguguccucugcgagcacaaaggggcccuccguuuuuccucaugaucugcgg

SEQ ID NO: 42077 - RNA, 426 nt, Artificial Sequence
  derived and/or modified sequence opt5 from anti-HIV-1_HeavyChain
cagagccaccuggagcaauccggcucugaagugaagaaacccggggccagcgucagaguuuccugcuggaccucugaggacaucuucgauacaacggaacucauuuacugggugcggcaggcuccuggacagggccuggaguggaucgggugggugaagauugucagcggaaccgugaacuuugccucccuugacuuccgcaauagaaucucucugagccgggaucgcgaccucuccacagcgcauauggauauuagaggccugacccaggacgauacagcuaccuauuuuugugcccggcaaaaauucgccagccgcuacucuggggaccagggauccuauuuugaucuuuggggcagaggcacacugaucaucguuagcucugcuuccaccaaggggccgagcguguucccccacgaccuccgg

SEQ ID NO: 42078 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuucucgcgauagagaccugagcaccgcuuacauggauauucggggacucacacaggacgauaccgccacauauuuuugugcccgccaaaaauucgcuuccagauacagcggcgaccagggcucuuauuuugaucugugggggcggggaacccuuaucguggucuccagcgccucuacaaagggccccuccguguucccucaugaccugcgc

SEQ ID NO: 42079 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcgccaagggaccgucugucuuuccccaugaucugcgc

SEQ ID NO: 42080 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgagcggacagaacucauuuacuggguucgccaggccccuggaagaggccuggaguggaucgggugggugaagacggugagcggaaccgucaacuucggcuccucugauuuccggaaucgcauuagccuuacaagagaccgggaucuguccaccgcgcauauggacauccgcgggcucacacaggaugacaccgcuacauauuuuugugccagacagaaauucgaaagccuguacucugaugaccaaggauccuauuuugaucuuuggggccggggcacccugauugugguuagcucugccuccacgaaggggccgagcguguuucccccucgcucugcu

SEQ ID NO: 42081 - RNA, 426 nt, Artificial Sequence
  derived and/or modified sequence opt5 from anti-HIV-1_HeavyChain
caggugcacauggagcaagccggcgggggagucaagaaacccggcgcuagcguuacccuguccugcaagacagccgacgaagauguguucgacgcggcuuacaugcauugggugagacaggccccugggcagacguuugaguggcucggauggaugaaaccggucaccggcgccgugaacuaugcucggaaguuccaggggcgcguuucuuuuuacagaacacgggaacugggaaucgccuauauggaucuucgcaaucugagauucgacgauaccgcuguguacuuuugugcccggaaaacaaagggcgacgucagcggcgaugaccgcggguucuuuuucgaucucuggggaagaggcacccgggugauuguuuccucugcgagcacaaaggggccccugcgcuccuuuccuagacggucugcc

SEQ ID NO: 42082 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucugucuuucccaccaucuaugug

SEQ ID NO: 42083 - RNA, 426 nt, Artificial Sequence
  derived and/or modified sequence opt5 from anti-HIV-1_HeavyChain
gagagccaccuggaacaguccggcucugccaugaagaaacccggggcuagcgugagagucuccugcuggaccucugaggacaucuucgauacaacggaacucauuuacuggguucggcaagccccuggacagggccuggaguggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcagaaauucgcuagccgcuacucuggggaccaaggauccuauuuugaucuuuggggcagaggcacacugaucaucgugagcucugccuccaccaaggggccgagcguuuucccccacgaccuccgg

SEQ ID NO: 42084 - RNA, 429 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaagacgauaccgccacauacuucugugcccgccagaaauuugcuucuagauauagcggcgaccagggcuccuacuucgaucugugggggcggggaacccuuauuguggucagcucugccuccacaaagggccccagcgggcugccuccccgcucuugcgug

SEQ ID NO: 42085 - RNA, 423 nt, Artificial Sequence
  derived and/or modified sequence opt5 from anti-HIV-1_HeavyChain
caggugcaccugguccaaagcggcgccgagguuaagaaacccggggcuuccgugaaggugucuugcaaagccagcggauacaccuucacaacguccggcauccauuggcucagacaggucccugggcagcggccggaauggaugggauggauucgccccaagaccggcgcgagaaaccaggcucggcaauuucagccucgcaucucucugacaagagaccgggcccuuagcaccgccuaucuggaucucaauucccugacaucugcugacagcgggaccuacuucugugcccgccagacauuuaaacccgauuucuauuuugcugaccagggaugguccuucaaccuuuggggcagaggcgcccacuuuauugugagcucugcguccaccaaggggccuagcguuuucccccaugaucugcgg

SEQ ID NO: 42086 - RNA, 429 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgcagggaccgaucggccugcccccucgccucugcguc

SEQ ID NO: 42087 - RNA, 426 nt, Artificial Sequence
  derived and/or modified sequence opt5 from anti-HIV-1_HeavyChain
cagagccaccucgagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgauuggacugcccccucggagcacg

SEQ ID NO: 42088 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagccuugauuuccgccacagaauuucccugacccgggaccgcgaucucuuuacagcucauauggacaucagaggacugacccagggcgauacagccaccuacuucugugcccggcaaaaguuugaaucucgcuauacaggcgggcagggaugguacuucgaccuuuggggcagagggacccacauuguugugagcuccgcuagcacgaaaggaccgucugucuuucccaccaucugcgug

SEQ ID NO: 42089 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucgaaucuagauacaccggcgggcagggaugguauuuugaccuguggggccgggggacacacaucguggucagcuccgcccuccaucagggaccuauuggccugccgccccgcagcacc

SEQ ID NO: 42090 - RNA, 429 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagagugucucugagccgggaucgcgaccucuccacagcuuauauggauaucagaggccugacccaggacgauacagccaccuacuuuugugcccggcaaaaauucgcuagccgcuauucuggggaccagggauccuacuuugaucuuuggggcagaggcacacugauuguugugagcucugcccuccaucaggggccgaucggacccuccccuaccauccugcgg

SEQ ID NO: 42091 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcguuuuccccacgauuuacgug

SEQ ID NO: 42092 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgagagccgcuauacagggggacagggcugguacuuugaccuuuggggcagagggacccauaucgugguuucuuccgcuagcacgaagggaccgucuguguuccccaccaucugcguc

SEQ ID NO: 42093 - RNA, 426 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcucacauggauauuagaggccugacccaagacgauacagccaccuauuuuugugcccggcagaaauucgagagccgcuacacagggggacagggcugguauuuugaccuuuggggcagagggacccauaucgucguguccagcgcuucuacgaagggaccguccguuuuccccaccaucugcgug

SEQ ID NO: 42094 - RNA, 426 nt, Artificial Sequence
  derived and/or modified sequence opt5 from anti-HIV-1_HeavyChain
agacggcaccuggagcagagcggcuccggggugaagaaacccggagccucuguccgcguuagcugcugguccucugaagacaucuucgagagaaccgaacucauucauugggugcggcaagcuccuggccaggggcuggaguggaucggaugggugaagacagucacgggcgccgugaacuuugggagccuugauuuccgccacagaauuucccugacccgggaccgcgaucucuuuacagcgcauauggacaucagaggacugacccagggcgauacagcuaccuacuucugugcccggcagaaauuugaaucucgcuauacaggcgggcaaggaugguacuucgaccuuuggggcagagggacccacauuguugugagcuccgccagcacgaagggaccgucugucuuuccccaugaucugcgg

SEQ ID NO: 42095 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgagagccgcuauucuggggaccagggauccuacuuugaucuuuggggcagaggcacacugaucaucgugagcucugcuuccaccaaggggccgagcguuuuccccacgauuugcgug

SEQ ID NO: 42096 - RNA, 429 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaauccagauauaccggcgggcagggaugguacuucgaccuuuggggccgggggacgcacauuguugugucuagcgcuuccaccaagggaccgcaucccgucuuuccucacgaucugccc

SEQ ID NO: 42097 - RNA, 426 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauuuacugggugcgccaggcccccggccaggggcuugaguggaucggaugggugaagauugucucuggcacggugaacuuugcgagccuggauuucagaaaucggaucucccucucucgcgacagagaucugagcaccgcuuauauggacauucgggggcuuacacaggaugacaccgccacauacuuuugugcccgccaaaaauucgcuuccagauauagcggagaucagggcucuuacuuugaccuguggggccgggggacccucaucguuguguccagcgccucuacaaagggaccuuccgucuucccgaccaucuaugug

SEQ ID NO: 42098 - RNA, 429 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggcccgccaggcgccuggccaggggcuggaguggaucggaugggugaagacggugaccggcgcugucaacuuugggucucuugauuucagacaccggauuagccugacacgcgacagagaucucuuuaccgcccauauggacauccggggacugacacagggcgauaccgccacauacuucugugcucgccaaaaauuugaauccagauauaccggcgggcagggaugguacuucgaccuuuggggccgggggacgcacauugugguuucuagcgccuccaccaagggaccgcugggccugcccccucgccucagcaga

SEQ ID NO: 42099 - RNA, 426 nt, Artificial Sequence
  derived and/or modified sequence opt5 from anti-HIV-1_HeavyChain
cagagccaccucgagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcucauauggauauuagaggccugacccaggacgauacagccaccuauuuuugugcccggcaaaaauucgcuagccgcuacucuggggaccagggauccuauuuugaucuuuggggcagaggcacacugaucaucgugagcucugccuccaccaaggggccgagcggacugcccccucggucugcu

SEQ ID NO: 42100 - RNA, 426 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgauacaacggagcucauuuacuggguccggcaggccccuggacagggccuggaauggaucgggugggugaagauuguuuccggaaccgugaacuuugcgucucuugacuuccgcaauagaaucagccugucccgggaucgcgaccucucuacagcucacauggauauuagaggccugcggcaagacgauaccgccacauauuuuugugcccgccagaaauucgagagcagauacuccggggaccagggaagcuauuuugaucuuuggggccggggcacccugaucaucgucucuuccgcuagcacaaaggggccgucuguguucccccaugaccuccgc

SEQ ID NO: 42101 - RNA, 426 nt, Artificial Sequence
  derived and/or modified sequence opt5 from anti-HIV-1_HeavyChain
gaggcccaccuggaacagagcggcuccggggugaagaaacccggagcuucugucagaguuagcugcuggaccuccgaggacaucuucgaacggacagagcucauucauugggugcgccaagccccuggccaggggcuggaauggaucggaugggugaagauugucucuggcacggugaacuuugcgagccuugauuucagaaaucggaucucccugucucgcgacagagaucucagcaccgcuuacauggacauucgggggcugacacaggaugacaccgccacauauuuuugugcccgccagaaauucgcuuccagauacagcggagaucaaggcucuuauuuugaccuuuggggccgggggacccugaucguuguguccagcgccucuacaaagggaccguccgucuucccccacgaucuccgc

SEQ ID NO: 42102 - RNA, 423 nt, Artificial Sequence
  derived and/or modified sequence opt5 from anti-HIV-1_HeavyChain
caggugcaacugguccagagcggcgccgagguuaagaaacccggggcuuccgugaaggugucuugcagagccagcggauacaccuucggcaaccacgcgaucuccuggguccggcaggcuccugggcagggacucgaauggaugggcuggauucgcccgaaaacaggggccagaaaucaagcccggcaguuucagccccgcaucucucugacgagagaccgggcucuuagcaccgccuaucuggaucucaacucccugacaucugcugacagcggaaccuacuucugugcccgccagacauuuaagccugauuucuauuuugcggaccaaggcugguccuucaaucuuuggggcagaggggcccauuuuauugugagcucugcuuccaccaaaggacccagcguuuucccucacgaucugcgg

SEQ ID NO: 42103 - RNA, 429 nt, Artificial Sequence
  derived and/or modified sequence opt5 from anti-HIV-1_HeavyChain
cagggccacaaccuggagcaaagcggguccgaagugaagaaacccggagccucugucagaguuagcugcuggaccuccgaggacaucuucgaacggacagagcucauucauugggugcgccaggcuccuggccaggggcuggaauggaucggaugggugaagacggucaccggcgccgugaauuuugggucucuugauuucagacaccggauuagccugacacgcgacagagaucucuuuaccgcgcauauggacauccggggacugacacagggcgauaccgcuacauacuucugugcccgccaaaaauuugaguccagauauaccggcgggcagggaugguacuucgaccuuuggggccgggggacgcacauuguugugucuagcgccuccaccaagggaccgagcgucuuuccccaugaucugcgc

SEQ ID NO: 42104 - RNA, 426 nt, Artificial Sequence
  derived and/or modified sequence opt5 from anti-HIV-1_HeavyChain
cccaccacauggaacaagagcggcuccgacgugaaaaagccuggggccucugucagaguuagcugcuggacguccgaggauaucuucgaacggaccgagcugauucacugggugcgccaggcuccgggacaaggccucgaauggaucgggugggugaaaacagucaccggagccgugaauuuuggcucucccaacuucagacaucggguuagccugacacgcgacagagaucuuuccaccgcgcacauggacauucgggggcugacacaggaugacaccgcuacguacuuuugugcccgccagaaguucgagucucucuauagcgaugaccagggauccuacuuugaucuguggggcagaggcacccuuaucauugugagcucugccuccacaaaagggccuagcgucuucccccaugaccugcgg

SEQ ID NO: 42105 - RNA, 432 nt, Artificial Sequence
  derived and/or modified sequence opt5 from anti-HIV-1_HeavyChain
cacgugacccccuggaacgaguacgucggcagagccaugaagaaaccugggcggagcguucgcguguccugcuggacaucugaagacaucuucgauacgaccgagcugauuuauugggugagacaggcuccgggacaaggccucgaauggaucgggugggucaagauugugagcggaacaguuaauuuugccucccuggacuuccggaaccgcaucucucuuagcagagaucgggaccuguccaccgcguacauggauauucgcggccucacacaggacgauaccgcuacauauuuuugugccagacagaaauucgccucucgguacagcggggaccagggauccuauuuugaucuguggggccgcggcacccuuaucguggucagcucugcuuccacgaaggggcccagcguguucccucaugaccugaga

SEQ ID NO: 42106 - RNA, 372 nt, Artificial Sequence
  derived and/or modified sequence opt5 from anti-HIV-1_HeavyChain
caggugcaacugguccagagcggcgccgagguuagacggcccggggcuuccgugaaggugucuugcaaagccagcggauucuccuuucucggccacuacauccauuggguccgccaggcgccugggcagggacuggaauggauuggcugggugaaggcuguuucuggggccgugaacuauggaagccuugacuucagacaccgggucucccugacccgcgauagagaccucucuacagcccauauggauauccggggccugacgcaagacgauaccgcuacauacuuuugugcccgccagaaauucgcuagaggcgaccaggggugguuuuucgaucuuuggggacggggcacccugauugugguuagcucc

SEQ ID NO: 42107 - RNA, 372 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacauccuauggcaucucuugggucagacaggcgccugggcagggacucgaauggauuggcugggugaagaucguuagcggggcugugaacuuuggauccccgaauuuccggcaacgcgucucucugacgagagaccgggaucuuuuuaccgcccacauggacauucgcggccugacacagggcgauaccgccacauacuucugugcuagacagaaauuugagcgcgggggacagggcuggaucuucgaccucugggggcggggaacccugauugccgugagcucc

SEQ ID NO: 42108 - RNA, 372 nt, Artificial Sequence
  derived and/or modified sequence opt5 from anti-HIV-1_HeavyChain
caggugcaacugguccagagcgaggccgaaguuaagaaacccggcgcuuccgugaagaucucuugcgccaccagcggguacgcguucacacucuauuaccugcacugggugagacaggcuccuggacagggccuugaguggauugggugggucaaaacggugaccggagccguuaacuuuggcuccgccuauuuccggcaucgcgugucucugacaagagaccgggaucucuuuaccgcucacauggacauccgcgggcugacacaaggagauaccgccacauacuucugugcuagacagaaguuuuauaaaggcggccaggggugguacuucgaccuuuggggacggggcacccugauugucgugagcucc

SEQ ID NO: 42109 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagacagagcucauucauugggugcggcaggccccuggccaggggcuggaauggaucggaugggugaaaacggucaccggcgcggugaacuuugggucuccgaauuuccgccacagaguuagccuuacacgggaucgcgaccuguuuaccgcucauauggauauuagaggacucacacagggcgacaccgccacauacuucugugcccggcaaaaguuugagcgcggcgggcagggaugguauuucgaucuguggggcagagggacccuuaucguggucuccucu

SEQ ID NO: 42110 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuccucucacgagagaccgggaucuguucaccgcccauauggacauucgcggacuuacacaggaugacaccgccacauauuuuugugcuagacagaaauucgcccggggcgaucaaggcugguuuuucgaccugugggggcgcggaacccucaucguggucuccucu

SEQ ID NO: 42111 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccccugaagacaucuucgagcggacagaacucauucauugggugcgccaggccccgggccaggggcuggaguggaucggaugggugaagauugucuccggcgcggugaacuuugggucucccaauuucagacagcggguuagccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcuguguccucu

SEQ ID NO: 42112 - RNA, 375 nt, Artificial Sequence
  derived and/or modified sequence opt5 from anti-HIV-1_HeavyChain
caggcccaccuggagcaaagcgcuuccggcgugaagagacccggggccucuguccggguuagcugcuggaccuccgaagacaucuucgagggaucugaacucauucauugggugcgccaggcgccuggccaggggcuggaguggaucggaugggugaaaacagucacgggcgcugugaacuuugggagcgccuacuucagacaccggguuucccuuacccgcgauagagaccuguuuacagcccauauggauauucggggacucacccagggcgacacagcuaccuauuucugugcccgccaaaaguuuuacaaaggcgggcagggaugguauuucgaucuguggggcagagggacacuuaucguggucucuagc

SEQ ID NO: 42113 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuuuaugcuggcgggcagggaugguacuucgaucuguggggcagagggacacuuaucguggucucuagc

SEQ ID NO: 42114 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcgggccgaacucauucauugggugcgccaggcgccuggccaggggcuggaguggaucggaugggugaagaccgucacaggcgcugugaacuuugggagcccgaauuucagacagcggguuucccuuacgcgcgauagagaccuguuuaccgcccacauggauauucggggacucacacaaggcgacaccgccacauacuucugugcucgccagaaauuugaaagaggcgggcagggauggaucuucgaucuguggggccgggggacccuuauugccgugucuagc

SEQ ID NO: 42115 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucucuugauuucagacaccggauuagccugacacgcgacagagaucucuuuaccgcucauauggacauccggggacugacacagggcgauaccgccacauacuucugugcccgccaaaaauuugaaagaggcgggcagggaugguauuucgaccuuuggggccgggggacccugauuguuguguccucu

SEQ ID NO: 42116 - RNA, 375 nt, Artificial Sequence
  derived and/or modified sequence opt5 from anti-HIV-1_HeavyChain
caggugcaccuggagcaaagcggcuccggggucaagaaacucggagccucuguuagagugagcugcuggaccuccgaagacaucuucgagcggacagaacugauucauugggugcgccaggcucccggccaggggcuugaguggaucggaugggucaaggccgugucuggcgcgguuaacuacgggagccuggauuuuagacaccgggugucccucacgcgcgacagagaucugucuaccgcucauauggacauucggggacuuacacaggaugacaccgccacauauuucugugcccgccaaaaauuugcuagaggcgaucagggcugguucuuugaccugugggggcggggaacccucaucgucgugagcucc

SEQ ID NO: 42117 - RNA, 375 nt, Artificial Sequence
  derived and/or modified sequence opt5 from anti-HIV-1_HeavyChain
caggccuaccuggagcaaagcggcuccaucaugaagaaacccggggcuucugugagagucagcugcuggaccuccgaagacauuuucgaucggacagagcucaucuauuggguucgccaggccccuggacagggccuggaauggauugggugggugaagaucgugucuggagcggucaacuuuggcagccuugacuucagaaaucgggugucccugacgcgcgauagagaccucuuuaccgcucacauggauauucgggggcugacacagggagacaccgccacauacuucugugcccgccaaaaauuugagagaggcggccaggggugguauuucgaucuuuggggacggggcacccugaucguugugucuagc

SEQ ID NO: 42118 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauuaacugggugcgccaggccccuggccaggggcuggaguggaucggaugggugaaggcggucucuggcgcugugaauuacgggagccuugauuuuagacaucggguuucccugacgcgcgacagagaucucucuaccgcccacauggacauucggggacugacacaggaugacaccgccacauauuucugugcucgccaaaaauuugccagaggcgaucagggcugguucuuugaccuuugggggcggggaacccugaucguggucagcucc

SEQ ID NO: 42119 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaagaggcgggcagggaugguauuucgaccuuuggggccgggggacacugauuguugugucuagc

SEQ ID NO: 42120 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagauugucucuggcgccgugaacuuugggagcccgaauuucagacagcggguuucccuuacccgcgauagagaccuguuuacagcgcacauggauauccggggacucacccaaggcgacacagcuaccuacuucugugcccgccagaaauuugaaagaggcgggcagggauggauuuucgaucuguggggccgggggacacuuaucgccgugucuagc

SEQ ID NO: 42121 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccggcgacaucuucgaacggacagagcugauucauugggugcgccaggcccccgggcagggacuugaauggaucggcugggugaaggcggucucuggggcugugaacuacggaagccuggauuuuagacaccggguuucccucacgcgcgacagagaucuguucaccgcccauauggacauucggggccuuacacaggaugacaccgccacauauuuuugugcucgccaaaaauucgccagaggcgaucaggggugguuuuucgaccuguggggacggggcacccucaucguggucucuagc

SEQ ID NO: 42122 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacacagauauccggggacucacccaaggcgacacagccaccuacuucugugcccgccagaaauuugaaagaggcgggcagggaugguauuucgaucuguggggccgggggacacuuauuguggucucuagc

SEQ ID NO: 42123 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugccucgccuccgaagacaucuucgagcggaccgaacugauucauugggugcgccaggcgccuggccaggggcuugaguggaucggaugggugaagacagucacgggcgcugugaacuuugggucuccgaauuucagacaccggguuagccugacccgcgauagagaccucuuuacagcccauauggauauucggggacugacccagggcgacacagccaccuacuucugugcucgccaaaaauuugaaagaggcgggcagggaugguauuucgaucuuuggggccgggggacacugaucguggucuccucu

SEQ ID NO: 42124 - RNA, 375 nt, Artificial Sequence
  derived and/or modified sequence opt5 from anti-HIV-1_HeavyChain
caggcccaccuggagcaaagcggcgcuggggugaagagacccggagccuccguccggguuucuugcuggaccagcgaagacaucuucgagacaacggaacucauucauugggugcgccaggcgccuggccaggggcuggaguggaucggaugggugaaaaccgucuccggcgcugugaacuuugggucucuuaauuucagacaccggguuagccugacacgcgauagagaccucuuuaccgcccauauggauauucggggacugacacagggcgacaccgccacauacuucugugcucgccaaaaguuugccagaggcgaucaggggugguucuuugaccuuuggggacggggcacccugaucguggucuccucu

SEQ ID NO: 42125 - RNA, 375 nt, Artificial Sequence
  derived and/or modified sequence opt5 from anti-HIV-1_HeavyChain
agacacaccuggaacaagagcggcuccggggugaaaaagcccggagccucuguccggguuagcugcuggacauccgaggacaucuucgaaaaaucugagcugauucauugggugcgccaggcuccuggccaagggcucgaauggaucggaugggugaagacggucaccggcgccgugaauuuugggagcuccgauuucagacagcggguuucucugacacgcgacagagaucuuuuuaccgcgcacauggacauucggggacugacacagggcgauaccgcuacauacuucugugcccgccagaaauuuuaugccggcgggcaaggaugguacuucgaccucuggggcagagggacccugaucguggucagcucc

SEQ ID NO: 42126 - RNA, 375 nt, Artificial Sequence
  derived and/or modified sequence opt5 from anti-HIV-1_HeavyChain
ggcacccccgggagcgaguccggaucuggcgugaagaaaccuggggccagcgucagaguuuccugcuggacaucugaagacaucuucgagcggacggaacugauucacugggugcgccaggcuccgggacaaggccucgaguggaucgggugggugaagauugucagcggagccgugaacuuuggcucccccaauuucagacagcggguuucucugacccgcgauagagaccuuuuuacagcgcauauggauauccggggccugacccagggggacacagcuaccuacuucugugcccgccagaaauuugaaagaggaggccaaggguggauuuucgaucucuggggacggggcacacugaucgccgugagcucc

SEQ ID NO: 42127 - RNA, 378 nt, Artificial Sequence
  derived and/or modified sequence opt5 from anti-HIV-1_HeavyChain
caggugcaacugguccagagcggcaccgagguucagaagcccggggccuccgugaaagugucuugcaaggcuuucggauacagcuuuacagacuauuacgucuauugggugagacaggccccuggccaagggcucgaauacguugcguggaucaacccguccaauggauauacgaaauacgcucagaaguuccaggauugggugacccugacacgggacucuagcauuaacaccgccuaucuucagcuggcccgcgucacauccgaugacaccgcuaucuacuacugugccagacaaaaauuugcuucucgguauagcggcgaucagggguccuacuucgaccucuggggacgcggcacacugauugugguuagcucu

SEQ ID NO: 42128 - RNA, 378 nt, Artificial Sequence
  derived and/or modified sequence opt5 from anti-HIV-1_HeavyChain
caggugcaacugguccagagcggcgccgcuguuaagaaacccggguccucugugaaggugagcugcaaagccuccggauacaucuucaccggcuauuacauucacuggaucagacaggcgccugggcagggacucgaguggaugggcuggauuaacccgucuacaggggacacgaaguuugcucggcaauuccagggacgcgucagcuuuuauagaacccgggaacugggcaucgccuacauggaucuucgcgaccugaaauucgaugacacagccguguauuuuugugcuagaaagaccaagggcgauguuuccggggacgaucggggauucuuuuucgaccucuggggccgcgggacaagagugauugucucuagc

SEQ ID NO: 42129 - RNA, 381 nt, Artificial Sequence
  derived and/or modified sequence opt5 from anti-HIV-1_HeavyChain
cagguguacauggagcaagccggcgcugggaugaagaaacccggagccagcaugaccgucuccugcaagacagcggacgaagauaucuucgacgcugccuauaugcacuggguuagacaggccccuggccagacguuugaguggcugggguggaugaaaccggugaccggagcugugaacuacgcccggcaguuccaaggccgcgucucuuuuuauagaacacgggaacucgggauugcuuacauggaucugcgcgaccuuaaguucgaugacaccgccguguauuuuugugcgagaaaaacaaagggagauguuagcggcgacgaucggggcuucuuuuucgaccugugggggcgcggaaccagagugaucgucuccucu

SEQ ID NO: 42130 - RNA, 381 nt, Artificial Sequence
  derived and/or modified sequence opt5 from anti-HIV-1_HeavyChain
cagguguucauggagcaagccggcgggggaaugaagaaacccggcgcuagcaugaccgucuccugcaagacagccgacgaagauguuuuugacgcggcuuacaugcacugggugagacaggccccugggcagacguucgaguggcugggauggaugaaaccggugaccggcgccgucaacuaugcucggaaguuucaggggcgcgugucuuucuacagaacacgggaacucggaaucgccuauauggaucugcgcgaccuuaaauuugaugacaccgcuguuuacuucugugccagaaagacaaagggcgaugugagcggcgacgaucggggguuuuucuuugaccuguggggacgcggcaccagagucauuguguccucu

SEQ ID NO: 42131 - RNA, 381 nt, Artificial Sequence
  derived and/or modified sequence opt5 from anti-HIV-1_HeavyChain
cagguguucauggagcaagccggcgggggaaugaagaaacccggcgcuagcaugaccgucuccugcaagacagccgacgaagauguuuuugacgcggcuuacaugcacugggugagacaggccccugggcagacguucgaguggcugggauggaugaaaccggugaccggcgccgucaacuaugcucggcaguuucaagggcgcgugucuuucuacagaacacgggaacucggaaucgccuauauggaucugcgcgaccuuaaguuugaugacaccgcuguuuacuucugugccagaaaaacaaagggcgaugugagcggcgacgaucggggguuuuucuuugaccuguggggacgcggcaccagagucauuguguccucu

SEQ ID NO: 42132 - RNA, 381 nt, Artificial Sequence
  derived and/or modified sequence opt5 from anti-HIV-1_HeavyChain
caggugcacauggagcaagccggcgggggagucaagaaacccggcgcuagcguuacccuguccugcaagacagccgacgaagauguguucgacgcggcuuacaugcauugggugagacaggccccugggcagacguuugaguggcucggauggaugaaaccggucaccggcgccgugucuuaugcucggaaguuccaggggcgcguuagcuuuuacaugacaagagaacugggaauggccuauauggaucuucggaaccugcgcuucgacgauaccgcuguguacuuuugugccagaaaaacagcgggcgacgucuccggcgauaaucggggguauuucuuugaccucuggggacgcggcucuagagugaucguuagcucc

SEQ ID NO: 42133 - RNA, 381 nt, Artificial Sequence
  derived and/or modified sequence opt5 from anti-HIV-1_HeavyChain
cagguguacauggagcaagccggcgggggaaugaagaaacccggcgcuagcaugaccgucuccugcaagacagccgacgaagauaucuucgacgcggcuuauaugcacuggguuagacaggccccugggcagacguuugaguggcugggauggaugaaaccggugaccggcgccgugaacuacgcucggcaguuccaagggcgcgucucuuuuuauagaacacgggaacucggaauggccuacauggaucugcgcaaucuuagauucgacgauaccgcuguguauuuuugugcccggaagacagcgggcgacguuagcggcgauaaccgcggguacuucuuugaccuguggggaagaggcucccgggugauugucucuagc

SEQ ID NO: 42134 - RNA, 381 nt, Artificial Sequence
  derived and/or modified sequence opt5 from anti-HIV-1_HeavyChain
cagguguacauggagcaagccggcgggggagucaagaaacccggcgcuagcguuacccuguccugcaagacagccgacgaagauguguucgacgcggcuuauaugcacugggugagacaggccccugggcagacguuugaguggcucggauggaugaaaccggucaccggcgccgugucuuacgcucggaaguuccaggggcgcguuagcuuuuauaugacaagagaacugggaauggccuacauggaucuucggaaccugcgcuucgacgauaccgcuguguauuuuugugccagaaaaacagcgggcgacgucuccggcgauaaucggggguacuucuuugaccucuggggacgcggcucuugggugaucguuagcucc

SEQ ID NO: 42135 - RNA, 381 nt, Artificial Sequence
  derived and/or modified sequence opt5 from anti-HIV-1_HeavyChain
caggugcaacugguccagagcggcgccgagguuaagaaacccggggcuuccgugacccucucuugcaagacagccgacgaagauguguucgacgcggcuuacaugcacugggucagacaggccccuggacagacguuugaguggcugggcuggaugaaaccggugaccggggccguuaacuaugcucggaaguuccaaggacgcgugagcuuuuacagaacacgggaacuuggcaucgccuauauggaucugcgcaaucucagauucgacgauaccgcugucuacuuuugugcccggaaaacagcgggggacguguccggagauaagcgcggcuucuuuuucgaccuguggggcagagggucucggguuauugugagcucc

SEQ ID NO: 42136 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcggccucuccacagcuuauauggacauuagagggcugacccaggaugacacagccaccuacuuuugugcccggcaaaaauucgcuagccgcuauucuggagaucagggcuccuacuuugaccuuuggggcagagggacacugaucgugguuagcucu

SEQ ID NO: 42137 - RNA, 384 nt, Artificial Sequence
  derived and/or modified sequence opt5 from anti-HIV-1_HeavyChain
caggcccaccuggagcaaagcgcuuccggcgugagacggcccggggccucuguccgcguuagcugcuggaccuccgaagacaucuucgagagaucugaacucauuuacugggugcggcaggcgccuggacgcggccuggaguggaucggguggauuaaacuugugagcggagcugucaacuuuggcuccguggauuucagagaccggguuucucugacacgcgauagagaccucuuuacggcccauauggauauccgggggcugacccagggagacacagccaccuauuucugugcucgccagaaguuugaaagcagauacacaggcggccaagggugguauuucgaucuuuggggacggggcacccacauuguggucuccagc

SEQ ID NO: 42138 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuuaauuuuagaagccggauuucccugacacgcgauagagaccucuucaccgcucacauggauauccggggacugacacagggcgacaccgccacauauuuuugugcccgccaaaaauucgaaucuagauacaccggcgggcagggaugguauuuugaucuuuggggccgggggacgcauauuguugugagcucc

SEQ ID NO: 42139 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaucuagauauacaggcgggcagggaugguacuucgaucuguggggccgggggacccacaucguggucagcucc

SEQ ID NO: 42140 - RNA, 384 nt, Artificial Sequence
  derived and/or modified sequence opt5 from anti-HIV-1_HeavyChain
caggugcaccuggagcaaagcggcuccggggucaagaaacccggagccucuguuagagugagcugcugguccucugaagacaucuucgagcggaccgaacucauucauugggugcgccaggcuccuggccaggggcuggaguggaucggaugggucaagacagugacgggcgccguuaacuuugggagccuugauuucagacaccggauuucccugacccgcgacagagaucucuuuacagcgcauauggacauccggggacugacccagggcgauacagcuaccuacuucugugcccgccaaaaauuugaaucuagauauacaggcgggcagggaugguacuucgaccuuuggggccgggggacccacauuguggucagcucc

SEQ ID NO: 42141 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugggccgggaucgcgaccucagcacagcuuauauggauauuagagggcugacccaggacgauacagccaccuacuuuugugcccggcaaaaauucgcuucccgcuauagcggagaccagggcucuuacuuugaucuuuggggcagagggacacugaucgugguuuccagc

SEQ ID NO: 42142 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaaggcgacacagcuaccuacuucugugcccgccagaaauuugaauccagauauacgggcgggcagggaugguacuucgaucuuuggggccgggggacccauaucguggucucuagc

SEQ ID NO: 42143 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaaggaaucuucgacacaacggagcucauuuacuggguucggcaggccccuggccaggggcuggaauggaucggaugggugaagauugugagcggcaccgucaacuuugcgucccuugauuuccgcaauagaaucucucugagccgggaccgcgaucucuccacagcuuauauggacauuagagggcugacccaggaugacacagccaccuacuuuugugcccggcaaaaauucgcuagccgcuauucuggagaucagggcuccuacuuugaccuuuggggcagagggacacugaucgugguuagcucu

SEQ ID NO: 42144 - RNA, 384 nt, Artificial Sequence
  derived and/or modified sequence opt5 from anti-HIV-1_HeavyChain
cagagcagacuggagcaauccggcucugccaugaagaaacccggggcuagcgugcgggucuccugcuggaccucugaagacaucuucgauacaacggagcucauuuacuggguucgccaggccccuggacagggccuggaauggaucgggugggugaagauugugagcggaaccgucaacuuugcgucccuugacuucagaaaucggaucucucugagccgcgauagagaccucuccacagcucacauggauauucggggccugacccaggacgauacagccaccuauuuuugugcccgccaaaaauucgcuagcagauacucuggggaccagggauccuauuuugaucuuuggggccggggcacacugaucaucgugagcucu

SEQ ID NO: 42145 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuugaaagccgcuauacaggcgggcagggaugguacuucgaccuguggggcagagggacccauaucguggucuccagc

SEQ ID NO: 42146 - RNA, 384 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcguccucugacuuccgcaauagaaucagccuuucccgggaucgcgaccugagcacagcuuauauggauauuagaggccucacccaggacgauacagccaccuacuuuugugcccggcaaaaauucgcuucucgcuauuccggggaccagggaagcuacuuugaucuguggggcagaggcacacuuaucaucgugucuucc

SEQ ID NO: 42147 - RNA, 384 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcacggugaacuuugcgagccuugauuucagaaaucggaucucccugucucgcgacagagaucucagcaccgcuuacauggacauucgggggcugacacaggaugacaccgccacauauuuuugugcccgccaaaaauucgcuuccagauacagcggagaucagggcucuuauuuugaccuuuggggccgggggacccugaucguuguguccagc

SEQ ID NO: 42148 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcugguccucugaagacaucuucgagcgcacagaacugauucauugggugagacaagcuccuggccaggggcucgaguggaucggaugggugaagacggucaccggcgccgugaacuuugggagccuggauuuccggcaccgcauuucccuuacaagagaccgggaucuguuuaccgcgcauauggacauccgcggacucacacagggcgauaccgcuacauacuucugugccagacagaaauuugaaucucgguauaccggcgggcaaggaugguacuucgaccuguggggccgcgggacgcacauuguugugagcucc

SEQ ID NO: 42149 - RNA, 384 nt, Artificial Sequence
  derived and/or modified sequence opt5 from anti-HIV-1_HeavyChain
agacacaccugggagcagagcggcuccggggugaagaaacccggagccucuguccggguuagcugcuggacauccgaagacaucuucgagcgcacggaacugauucauugggugagacaagcuccuggccaggggcucgaguggaucggaugggugaagaccgucacaggcgccgugaacuuugggucucuggauuuccggcaccgcauuagccuuaccagagaccgggaucuguuuacagcgcauauggacauccgcggacucacccagggcgauacagcuaccuacuucugugccagacagaaauuugaaucccgguauacgggcgggcaaggaugguacuucgaccuguggggccgcgggacccacauuguugugucuagc

SEQ ID NO: 42150 - RNA, 414 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggucugaacucauucauugggugcgccaggccccuggccaggggcuggaguggaucggaugggugaagacagucacgggcgcggugaacuuugggagcccgaauuucagacaccggguuucccuuacccgcgauagagaccuguuuacagcucauauggauauucggggacucacccagggcgacacagccaccuacuucugugcccgccaaaaauauuacgcuggcgggcagggaugguauuuugaucuguggggcagagggacacuuaucguggucucuagcgccuccaccaagggacccagcguguuccacgaccugcgg

SEQ ID NO: 42151 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggauggauuuucgaucuguggggccgggggacccuuaucgcugugucuagcgccuccacaaagggacccagcgucuuuccuaccaucugcgug

SEQ ID NO: 42152 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaagcggucagcggcgcugugaacuacgggucccuugauuuucgccacagaguuucucugacacgggaccgcgaucucuucacggcccauauggacauuagaggacugacccaggaugacacagccaucuauuuuugugcucggcaaaaguucgcccgcggcgaucagggcugguuuuucgaccuuugggggagaggaacccugauuguggucagcuccgcuagcacaaaaggcccgucuguguuuccccacgaucuccgg

SEQ ID NO: 42153 - RNA, 417 nt, Artificial Sequence
  derived and/or modified sequence opt5 from anti-HIV-1_HeavyChain
caggcccaccuggagcaaagcggcuccggggugaagaaagucggagcuucuguuagagugagcugcuggaccuccgaagacaucuucgagcggacagaacucauucauugggugcgccaggcccccggccaggggcuggaguggaucggaugggucaaggcggugucuggcgcuguuaacuacgggagccuugauuuuagacaccgggugucccugacgcgcgacagagaucucuucaccgcccauauggacauucggggacugacacaggaugacaccgccaucuauuuuugugcucgccaaaaauucgccagaggcgaucagggcugguuuuucgaccuuugggggcggggaacacugauugucgugucuagcgcuuccaccaagggcccuagcguuuuuccgcacgaucuccgc

SEQ ID NO: 42154 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucuacgccggcgggcagggaugguauuuugaccuguggggcagagggacccucaucguggucucuagcgcuuccacaaagggaccuagcguguucccgcacgaucugcgg

SEQ ID NO: 42155 - RNA, 423 nt, Artificial Sequence
  derived and/or modified sequence opt5 from anti-HIV-1_HeavyChain
cagguguacauggagcaagccggcgcuggggucaagaaacccggagccagcguuacccuguccugcaagacagcggacgaagauguguucgacgcugccuauaugcacugggugagacaggccccuggccagacguuugaguggcucggguggaugaaaccggucaccggagcugugucuuacgcccggaaguuccagggccgcguuagcuuuuauaugacaagagaacuggggauggcuuacauggaucuucggaaccugcgcuucgacgauaccgccguguauuuuugugcgagaaaaacagccggagacgucuccggcgauaaucggggcuacuucuuugaccucugggggcgcggaucuagagugaucguuagcuccgcuucuaccaagggccccagcguguucccucaugaucugcgg

SEQ ID NO: 42156 - RNA, 426 nt, Artificial Sequence
  derived and/or modified sequence opt5 from anti-HIV-1_HeavyChain
cagagccaccuggagcaauccggcucugccaugaagaaacccggggcuagcgugagagucuccugcuggaccucugaagacaucuucgauacaacggagcucauuuacuggguucggcaggccccuggacagggccuggaauggaucgggugggugaagauugugagcggaaccgucaacuuugcgucccuugacuuccgcaauagaaucucucugagccgggaucgcgaccucuccacagcuuauauggauauuagaggccugacccaggacgauacagccaccuacuuuugugcccggcaaaaauucgcuagccgcuauucuggggaccagggauccuacuuugaucuuuggggcagaggcacacugaucgugguuagcucugccuccaccaaggggccgagcguguuccccacgaucuauguc

SEQ ID NO: 42157 - RNA, 372 nt, Artificial Sequence
  derived and/or modified sequence opt5 from anti-HIV-1_HeavyChain
caggugcaacugguccagagcggcgccgagguuaagaagcccggggcuuccgugaaggugucuugcaaagccagcggaggcacccucuccucuuacgcgaucagcugggucagacaggcuccugggcagggacuggaauggauuggcugggugaagacaguuacgggggccgugaacuucggauccgccuguuuucggcaccgcgucucucuuaccagagaccgggaucuguucacagcucauauggacauccgcggccucacccaaggcgauacagccaccuauuuuugcgcuagacagaaauucuacaaagggggacagggcugguauuuugaccugugggggcggggaacacuuauugugguuagcucc

SEQ ID NO: 42158 - RNA, 372 nt, Artificial Sequence
  derived and/or modified sequence opt5 from anti-HIV-1_HeavyChain
cacgugagacugguccagagcggcgccgagguugaaaagcccggggcuuccgugaaagugucuugcgagaccagcaacuacccuuucaauauguauggaaugacauggguccggcaagccccgggccaggggcucgaauggaucggaugggugaagauuguuuccggcgcggugaacuuugggucucccaauuuccgccagagagucagccugacgcgggaccgcgaucuuuuuaccgcucauauggacaucagaggacugacacagggcgauaccgccacauacuucugugcccggcaaaaauuugagcgcggcgggcagggauggauuuucgaccucuggggcagagggacccugaucgcuguguccucu

SEQ ID NO: 42159 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacguguucgagcggacagaacugauccauugggugcgccaggcccccggccaggggcuugaguggauuggaugggucaaggcggugucuggcgcuguuaacuacgggagccuggauuuuagacaccgggugucccucacgcgcgacagagaucuguucaccgcccauauggacauccggggacuuacacaggaugacaccgccacauauuuuugugcucgccaaaaauucuacgccggcggccaggggugguauuuugaucuguggggaagaggcacccucauugucgugucuagc

SEQ ID NO: 42160 - RNA, 375 nt, Artificial Sequence
  derived and/or modified sequence opt5 from anti-HIV-1_HeavyChain
agacacaccugggagcagagcggcuccggggugaagaaacccggagccucuguccggguuagcugcugguccucugaagacaucuucgagcgcacagaacugauucauugggugagacaagcuccuggccaggggcucgaguggaucggaugggugaagacggucaccggcgccgugaacuuugggagccuggauuuccggcaccgcauuucccuuacaagagaccgggaucuguuuaccgcgcauauggacauccgcggacucacacagggcgauaccgcuacauacuucugugccagacagaaauuugaacggggcgggcaaggaugguauuucgaccuguggggccgcgggacccuuauuguugugucuagc

SEQ ID NO: 42161 - RNA, 375 nt, Artificial Sequence
  derived and/or modified sequence opt5 from anti-HIV-1_HeavyChain
agacacaccugggagcagagcggcuccggggugaagcggcccggagccucuguccgcguuagcugcuggacauccgaagacaucuucgagacgaccgaacugauucauugggugagacaagcuccuggccaggggcucgaguggaucggaugggugaaaacagucucuggcgccgugaacuuugggagccugaauuuccggcaccgcguuucccuuaccagagaucgggaccugucuacagcgcauauggauauucgcggacucacccaggacgauacagcuaccuacuuuugugccagacagaaguucgcccggggcgaccaaggcugguuuuucgaucugugggggcgcggaacgcuuaucguggucagcucc

SEQ ID NO: 42162 - RNA, 381 nt, Artificial Sequence
  derived and/or modified sequence opt5 from anti-HIV-1_HeavyChain
cagguguucauggagcaagccggcgcugggaugaagaaacccggagccagcaugaccgucuccugcaagacagcggacgaagauguuuuugacgcugccuacaugcacugggugagacaggccccuggccagacguucgaguggcugggguggaugaaaccggugaccggagcugucaacuaugcccggcaguuucaaggccgcgugucuuucuacagaacacgggaacucgggaucgcuuauauggaucugcgcgaccuuaaguuugaugacaccgccguuuacuucugugcgagaaaaacaaagggagaugugagcggcgacgaucggggcuuuuucuuugaccugugggggcgcggaaccagagucauuguguccucu

SEQ ID NO: 42163 - RNA, 384 nt, Artificial Sequence
  derived and/or modified sequence opt5 from anti-HIV-1_HeavyChain
caggugcaccuggagcaaagcggcuccggggucaagaaacccggagccucuguuagagugagcugcuggaccuccgaagacaucuucgagcggacagaacucauucauugggugcgccaggcuccuggccaggggcuggaguggaucggaugggucaagacggugaccggcgccguuaacuuugggucucuugauuucagacaccggauuagccugacacgcgacagagaucucuuuaccgcgcauauggacauccggggacugacacagggcgauaccgcuacauacuucugugcccgccaaaaauuugaauccagauauaccggcgggcagggaugguacuucgaccuuuggggccgggggacgcacauuguggucucuagc

SEQ ID NO: 42164 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauuucugugcucgccaaaaauuugccagaggcgaucagggcugguucuuugaccugugggggcggggaacccucaucguggucagcuccgcuagcacaaagggcccuucuguguucccgaccauuugcguu

SEQ ID NO: 42165 - RNA, 417 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucguggucagcuccgccagcaccaaaggaccgucuguguuucccacgauuugcguu

SEQ ID NO: 42166 - RNA, 417 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacguguucgagcggacagaacugauccauugggugcgccaggcccccggccaggggcuugaguggauuggaugggucaaggcggugucuggcgcuguuaacuacgggagccuggauuuuagacaccgggugucccucacgcgcgacagagaucuguucaccgcccauauggacauccggggacuuacacaggaugacaccgccacauauuuuugugcucgccaaaaauucuacgccggcggccaggggugguauuuugaucuguggggaagaggcacccucauugucgugucuagcgcuuccacaaaggggccuagcguuuucccgcacgaccugcgg

SEQ ID NO: 42167 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuucugugcccgccagaaauuugaaagaggcgggcagggaugguauuucgaucuguggggccgggggacccuuauuguggucucuagc

SEQ ID NO: 42168 - RNA, 384 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaagacggucaccggcgcggugaacuuugggucucuggauuucagacaccggauuagccucacacgcgacagagaucuguuuaccgcucauauggacauccggggacuuacacagggcgauaccgccacauacuucugugcccgccaaaaauuugaauccagauauaccggcgggcagggaugguacuucgaccuguggggccgggggacgcacauuguugugucuagc

SEQ ID NO: 42169 - RNA, 426 nt, Artificial Sequence
  derived and/or modified sequence opt5 from anti-HIV-1_HeavyChain
caggcccaccuggagcaaagcggcuccggggugaagaaacccggagcuucugucagaguuagcugcugguccucugaagacaucuucgagcggaccgaacucauucauugggugcgccaggccccuggccaggggcuggaguggaucggaugggugaagacagucacgggcgcggugaacuuugggagccuugauuucagacaccggauuucccugacccgcgacagagaucucuuuacagcucauauggacauccggggacugacccagggcgauacagccaccuacuucugugcccgccaaaaauuugaaucuagauauacaggcgggcagggaugguacuucgaccuuuggggccgggggacccacauuguugugagcuccgcuagcacgaagggaccgucugucuuucccaccaucugcgug

SEQ ID NO: 42170 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugaaagaggcgggcagggaugguauuucgaucuguggggccgggggacgcuuaucguggucuccucu

SEQ ID NO: 42171 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuauacaacguacggcgucuccuggcucagacaggugccugggcagcggccggaauggaugggauggauccgccccaagaccggcgcgagaaaccaagcucggcaguuccagccucgcauuucucugacaagagaccgggcccuuagcaccgccuaucuggaucucaauucccugacaucugcugacagcgggaccuacuuuugugcccgccagacauucaaacccgauuuuuauuucgcugaccaaggaugguccuuuaaccuuuggggcagaggcgcccacuucaucguuagcucu

SEQ ID NO: 42172 - RNA, 384 nt, Artificial Sequence
  derived and/or modified sequence opt5 from anti-HIV-1_HeavyChain
agagcccaccuggagcagagcggcuccggggugaagaaacucggagcuucuguccggguuagcugcuggaccuccgaagacaucuucgagcgcacagaacugauucauugggugagacaagcccccggccaggggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuuuugugcuagacagaaauucgaaucucgguacaccggcggccaagggugguauuuugaucuguggggacgcggcacacacaucaccgugagcucc

SEQ ID NO: 42173 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagauugucucuggcgcggugaacuuugggagcccgaauuucagacagcggguuucccuuacgcgcgauagagaccuguuuaccgcucacauggauauccggggacucacacaaggcgacaccgccacauacuauugugcccgccagaaauucgaaagaggcgggcagggauggauuuuugaucuguggggccgggggacccuuaucgcugugucuagc

SEQ ID NO: 42174 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuuuugugcucgccaaaaauucgccagaggcgaucagggcugguuuuucgaccugugggggcacggaacccucaucguggucucuagc

SEQ ID NO: 42175 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuugaaagaggcgggcagggaugguauuucgaucuguggggccacgggacccuuaucguggucuccucu

SEQ ID NO: 42176 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggacggagaucuguuuacagcucacauggacauucgcggccucacccaaggcgauacagccaccuacuucugugccagacagaaguuuuaugcugggggacagggcugguacuucgaccugugggggcggggaacacuuaucauugugagcucc

SEQ ID NO: 42177 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggcaccagauuagcgaucgcguuucccuuaccagagaccgggaucuguucacagcucauauggacauccgcggacucacccaaggcgauacagccaccuacuuuugugccagacagaaguucuaugcuggcgggcagggaugguacuuugaccuguggggccacgggacacuuauuguggucucuagc

SEQ ID NO: 42178 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacacagccaccuacuucugugcccgccaaaaauuugaaagaggcgggcagggaugguauuucgaucuguggggccacgggacacuuaucguggucucuagc

SEQ ID NO: 42179 - RNA, 375 nt, Artificial Sequence
  derived and/or modified sequence opt5 from anti-HIV-1_HeavyChain
caggcccaccuggagcaaagcggcgcuggggugaagaaacccggagccuccgucagaguuucuugcuggaccagcgaagacaucuucgagcggacagaacucauucauugggugcgccaggcgccuggccaggggcuggaguggaucggaugggugaagacggucuccggcgcugugaacuuugggucuccgaauuucagacaccggguuagccuuacccgcgauagagaccuguuuacagcccauauggauauucggggacucacccagggcgacacagccaccuacuauugugcucgccaaaaauucgaaagaggcgggcagggaugguacuuugaucuguggggccgggggacacuuaucguggucuccucu

SEQ ID NO: 42180 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggcagagggcuugaguggaucggaugggugaaggcggucucuggcgcugugaacuacgggagccuggauuuucggcaccgcguuucccucacgagagaccgggaucuguucaccgcccauauggacauucgcggacuuacacaggaugacaccgccacauauuacugugcuagacagaaauuugaacggggcggccaaggguggaucuucgaucuguggggacgcggcacccucauugccgugucuagc

SEQ ID NO: 42181 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuauugugcccggcagaaguucuacgcuggcgggcagggaugguauuuugaccuguggggccgcgggacacuuaucguggucagcucc

SEQ ID NO: 42182 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuucugugcccgccaaaaauuuuauaagggcgggcagggaugguacuucgaucuguggggcagagggacccuuaucguggucuccucu

SEQ ID NO: 42183 - RNA, 372 nt, Artificial Sequence
  derived and/or modified sequence opt5 from anti-HIV-1_HeavyChain
uacguggagcugggcaccaacacagggcccgaagucagaaagccuggagccagcguuaaaaucuccugcaagacgucuggcuauauuuucaccgacaauuacuuucacuggcuccggcaggcuccggccguggggcuggaguggaugggauggaucaacagccauaauggcuauacaaaauccgcgaagaaauuccaagggcgcauuaccaugacaagagauaccgcuguggacacagccuacauggaacuuaucgaucugaccucugacgauacggccaccuauuacugugcucggcagaaguuuuaugccggaggccagggcugguacuucgaccucugggggugcggaacacugauugucgugagcucc

SEQ ID NO: 42184 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccgcgggacacuuaucugcgugagcucc

SEQ ID NO: 42185 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuagcgauuucagacagcggguuucccuuacacgcgacagagaucuguuuaccgcucacauggacauucggggacucacacaaggcgauaccgccacauacuauugugcccgccagaaauucuacgcuggcgggcagggaugguauuuugaccuguggggcagagggacccuuaucguggucucuagc

SEQ ID NO: 42186 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagccggucacgggcgcggugaacuuugggucucccaauuucagacaccggguuagccuuacccgcgauagagaccuguuuacagcucauauggauauucggggacucacccagggcgacacagccaccuacuucugugcccgccaaaaauuugaaagaggcgggcagggaugguauuucgaucuguggggccgggggacacuuaucguggucuccucu

SEQ ID NO: 42187 - RNA, 375 nt, Artificial Sequence
  derived and/or modified sequence opt5 from anti-HIV-1_HeavyChain
caggugcaacugguccagagcggcgccgagguuaagaaacccggggcuuccgugagagugucuugcuggaccagcgaagacaucuucgagaaguccgaacucauucacuggguccggcaggccccuggacagggccuggaguggaucgggugggugaaaacaguuacgggagcggugaacuuuggcucuagcgauuuccgccaaagagucucccuuacccgggaccgcgaucuguuuacagcucauauggacauuagagggcucacccagggagauacagccaccuacuauugugcccggcagaaguucgaacgcggcggccaggggugguacuuugaccuguggggaagaggcacacuuaucgugguuucuagc

SEQ ID NO: 42188 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucugucuaccgcccauauggacauucggggacuuacacaggaugacaccgccacauauagcugugcucgccaaaaauucgccagaggcgaucagggcugguuuuucgaccugugggggcggggaacccucaucguggucuccagc

SEQ ID NO: 42189 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuauugugcccgccaaaaauucgaaagaggcgggcagggaugguacuuugaucuguggggccgggggacgcuuaucguggucuccucu

SEQ ID NO: 42190 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcacagugaacuuugggucucuuaauuucagacagcggguuagccugacccgcgauagagaccucuuuacagcgcacauggauauucggggacugacccaaggcgacacagcuaccuacuucugugcccgccagaaauuugccagaggcgaucaggggugguucuuugaccuuuggggacauggcacgcugaucguggucuccucu

SEQ ID NO: 42191 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccccuuuaccgcucauauggauauucggggacugacacagggcgacaccgccacauacuucugugcccgccaaaaauuugaaagaggcgggcagggaugguauuucgaucucuggggccacgggacccugaucguggucuccucu

SEQ ID NO: 42192 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauuuguggacucacacagggcgacaccgccacauacuucugcgcccggcaaaaauuugaacgcggcgggcagggaugguauuucgaucuguggggccacgggacccuuaucguggucuccucu

SEQ ID NO: 42193 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacagcggguuucccucacgcgcgacagagaucuguucaccgcccacauggacauucggggacuuacacaaggcgauaccgccacauauuacugugcucgccagaaauuuuaugccggcgggcagggaugguacuucgaccuguggggcagagggacccucaucguggucucuagc

SEQ ID NO: 42194 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucaagucugagcucauucauugggugcggcaggccccuggccaggggcuggaauggaucggaugggugaaaacagucacgggcgcggugaacuuugggagcuccgauuuccgccagagaguuucucuuacccgggaccgcgaucuguuuacagcucacauggacauuagaggacucacccaaggcgauacagccaccuacuucugugcccggcagaaguuuuaugcuggcgggcagggaugguacuucgaccuguggggccaugggacacuuaucguggucagcucc

SEQ ID NO: 42195 - RNA, 375 nt, Artificial Sequence
  derived and/or modified sequence opt5 from anti-HIV-1_HeavyChain
caggcccaccuggagcaaagcggcuccggggugaagaaacccggaaccucugucagaguuagcugcuggacauccgaagacaucuucgagcggacggaacucauucauugggugcgccaggcuccuggccaggggcuggaguggaucggaugggugaagaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaauuugccagaggcgaucaggggugguucuuugaccuguggggacacggcacgcuuaucguggucuccucu

SEQ ID NO: 42196 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacaggaugacaccgccacauauuacugugcucgccaaaaauuugccagaggcgaucagggcugguucuuugaccugugggggcggggaacccucaucguggucucuagc

SEQ ID NO: 42197 - RNA, 381 nt, Artificial Sequence
  derived and/or modified sequence opt5 from anti-HIV-1_HeavyChain
caggugcaacugguccagagcggcgccgagguuaagaaacccggggcuuccgugaaggugucuugcaaagccagcggauacaccuucacagacuauuaccuccacugggucagacaggcgccuggccaggggcuggauugggugggauggaucaaccccaauuccggcgggacgaacuaugcucaaaaguuucagggacggguugccaugacccgcgacacaucucuuagcuccguguaccuggaucucaauucucugaccagcgccgacuccggcacauauuucugugcuagacagaccuuuaaaccggauuucuacuuugccgaccagggcuggagcuucaaccuuugggggcaaggaucucauuuuauugucuccagc

SEQ ID NO: 42198 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcgcgccccuggccaggggcuggaguggaucggaugggugaaaacagucacgggcgcggugaacuuugggagcuccgauuucagacagcggguuucucuuacccgcgacagagaucuguuuacagcucacauggacauucggggacucacccagggcgauacagccaccuacuauugugcccgccaaaaguucuacgcuggcgggcagggaugguauuuugaccuguggggcagagggacacuuaucguggucagcucc

SEQ ID NO: 42199 - RNA, 372 nt, Artificial Sequence
  derived and/or modified sequence opt5 from anti-HIV-1_HeavyChain
caggcccaccuggagcaaagcggcuccggggugaagaaacccggagcuucugucaccguuagcugcuggacauccgaagacaucuucgagaagucugaacucauucauugggugagacaggccccuggccaggggcuggaguggaucggaugggugaaaacggucaccggcgcggugaaccuuguuuaccagauuagcgaucgggugucccugacacgcgacagagggcucuuuaccgcucacauggauauccggggacugacacaaggcgacaccgccacauauuacugugcccgccagaaguucuaugcuggcgggcagggaugguacuuugaucuuuggggcagagggacccugauugucgugucuagc

SEQ ID NO: 42200 - RNA, 375 nt, Artificial Sequence
  derived and/or modified sequence opt5 from anti-HIV-1_HeavyChain
caggcccaccuggagcaaagcggcuccggggugaagaagcccggagcuucugucagaguuagcugcuggaccuccgaagacaucuucgagggcucugaacucauucauugggugcggcaggccccugggcagggacuggaguggaucggcugggugaagacagucacgggggcggugaacuuuggaagcgcuuacuuccgccacagaguuucccuuacccgggaucgcgaccuguuuacagcccauauggauauuagaggccucacccagggcgacacagccaccuauuucugugcucggcaaaaauuuuacaaagggggacagggcugguauuucgaucugugggggcacggaacacuuaucguggucucuagc

SEQ ID NO: 42201 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuacgggucucuuaauuuuagaagccggauuucccugacacgcgauagagaccucuucaccgcucacauggauauccggggacugacagaaggcgacaccgccacauauuuuugugcccgccagaaauucuacgcuggcgggcaaggaugguauuuugaucuuuggggccaugggacccugauuguugugucuagc

SEQ ID NO: 42202 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucucuggcgcggugaacuuugggagcccgaauuucagacaccggguuucccuuacccgcgauagagaccuguuuacagcucauauggauauucggggacucacccagggcgacauggccacauacuucugugcccgccaaaaauuugaaagaggcgggcagggaugguauuucgaucuguggggccacgggacccuuaucguggucucuagc

SEQ ID NO: 42203 - RNA, 375 nt, Artificial Sequence
  derived and/or modified sequence opt5 from anti-HIV-1_HeavyChain
caggcccaccuggagcaaagcggcuccggggugaaggaacccggaaccucugucagaguuagcugcuggacauccgaggacaucuucgaacggacggagcucauucauugggugcgccaggcuccuggccaggggcuggaauggaucggaugggugaaaaccgucacaggcgccgugaacuuugggucuccgaauuucagacaccggguuagccuuacccgcgauagagaccuguuuacagcgcauauggauauucggggacucacccagggcgacacagcuaccuacuucugugcccgccaaaaguuugagagaggcgggcagggauggaucuucgaucuguggggccgggggacgcuuauugccguguccucu

SEQ ID NO: 42204 - RNA, 375 nt, Artificial Sequence
  derived and/or modified sequence opt5 from anti-HIV-1_HeavyChain
caggugcaacuggagcagagcggcuccggggucaagaaacucggagccucuguuagagugagcugcuggaccuccgaagacaucuucggccggacagagcugauucacugggugcgccaggcucccgggcagggacuugaauggaucggcugggucaaggccgugucuggggcgguuaacuacggaagccuggauuuuagacaucgggugucccucacgcgcgacagagaucuguucaccgcucacauggacauucggggccuuacacaagaugacaccgccacauauuacugugcccgccagaaauuugcuagaggcgaucaggggugguucuuugaccuguggggacggggcacccucaucgucgugucuagc

SEQ ID NO: 42205 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgacgauaucuucaagacagaacucauucauugggugcggcaggccccuggccaggggcuggaguggaucggaugggugaaaacggucaccggcgcggugaacuuugggucuccgaauuuccgccagagaguuagccuuacacgggaccgcgaucuguuuaccgcucacauggacauuagaggacucacacaagaugacaccgccacauacuucugugcccggcagaaguuugcucgcggcgaucagggcugguucuuugaccugugggggagaggaacccuuaucguggucuccucu

SEQ ID NO: 42206 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagcggacagaacucauucauugggugcgccaggccccuggccaggggcuggaguggaucggaugggugaagacggucaccggcgcggugaacuuugggucuccgaauuucagacaccggguuagccuuacacgcgauagagaccuguuuaccgcucauauggauauucggggacucacacagggcgacaccgccacauacuauugugugcgccaaaaauucgaaagaggcgggcagggaugguacuuugaucuguggggccgggggacccuuaucgucguguccucu

SEQ ID NO: 42207 - RNA, 375 nt, Artificial Sequence
  derived and/or modified sequence opt5 from anti-HIV-1_HeavyChain
caggugcaacugguccagagcggcgccgagguuaagaaacccggggcuuccgugaaggugucuugcuggaccagcgaagacaucuucgagaaauccgaacucauucacugggucagacaggccccuggacagggccuggaguggaucgggugggugaagacaguuacgggagcggugaacuuuggcucuagcgauuuccggcaacgcgucucccuuaccagagaccgggaucuguuuacagcucauauggacauucgcgggcucacccagggagauacagccaccuacuauugugccagacagaaauucuacgcuggcggccaggggugguauuuugaccuguggggacggggcacacuuaucgugguuucuagc

SEQ ID NO: 42208 - RNA, 375 nt, Artificial Sequence
  derived and/or modified sequence opt5 from anti-HIV-1_HeavyChain
caggcccaccuggagcaaagcggcuccggggugaagaaacucggagcuucugucagaguuagcugcuggaccuccgaagacaucuucgagcggacagaacugauucauugggugcgccaggcccccggccaggggcuugaguggaucggaugggugaaggcggucucuggcgcugugaacuacgggagccuggauuuuagacaccggguuucccucacgcgcgacagagaucuguucaccgcccauauggacauucggggacuuacacagggcgauaccgccacauauuuuugugcucgccaaaaauucuacaagggcgggcagggaugguauuuugaccuguggggcagagggacccucaucguggucucuagc

SEQ ID NO: 42209 - RNA, 372 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucgagaagucugaacucauucauugggugcggcaggccccuggccaggggcuggaguggaucggaugggugaaaacagucacgggcgcggugaacuuugcucaccagauuagcgaucgcguuucccuuaccagagaccgggaucuguucacagcccauauggacauccgcgggcucacccaaggagauacagccaccuacuauugugcuagacagaaguuuuacgccggcggccaggggugguauuucgaccuguggggacggggcacacuuauuguggucucuagc

SEQ ID NO: 42210 - RNA, 375 nt, Artificial Sequence
  derived and/or modified sequence opt5 from anti-HIV-1_HeavyChain
caggcccaccuggagcaaagcggcuccggggugaagaaacccggagcuucugucagaguuagcugcuggaccuccgaagacaucuucggccggacagagcucauucauugggugcgccaggccccugggcagggacuggaauggaucggcugggugaagacggucucuggggcggugaacuuuggaagcccgaauuucagacaccggguuucccuuacccgcgauagagaccuguuuacagcucauauggauauucggggccucacccagggcgacacagccaccuacuucugugcccgccaaaaauuugagagagggggacagggcugguauuucgaucugugggggcggggaacacuuaucugcgugucuagc

SEQ ID NO: 42211 - RNA, 636 nt, Artificial Sequence
  derived and/or modified sequence opt5 from anti-HIV_5CIN_LightChain
gagaucgugcugacccagagccccggcacacaaucccucucuccuggggaaagagccacgcugagcugccgggcuucccagucugucggaaacaauaaacuugccugguaccagcagcgcccgggccaagcgcccagacugcucauuuauggggcuagcucccggccuucuggaguugccgaccgcuucagcggcuccgggagcggaaccgauuuuacacugaccaucucuagacuugagcccgaagacuucgccguguacuauugucagcaguacggccagucccugagcacauuuggccaagggaccaaaguggaggucaagcggacaguggcugccccuucuguuuucauuuuucccccuuccgaugaacagcucaaaagcggaaccgcuucuguggucugccugcugaacaauuucuauccgcgcgaggccaaggugcaguggaaaguugacaacgcgcuccaguccggcaauagccaagaguccgugacggaacaggauucuaaggacagcaccuacucccugagcucuacacuuacccuguccaaggccgauuaugagaaacacaaggucuacgcuugugaagugacacaucaggggcucagcucucccgugaccaagagcuuuaacaga

SEQ ID NO: 42212 - RNA, 672 nt, Artificial Sequence
  derived and/or modified sequence opt5 from anti-HIV_5CIN_HeavyChain
gugcagcugguccaaagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcagcgggggaaaacccaucggcgcuuucgcccacugggggcagggaacccuggugacagucucuuccgcgagcaccaaaggcccuucuguguuuccccucgccccuuccagcaagucuacauccgggggaaccgcugcccugggcugccugguuaaagacuauuucccggaacccgugacggucagcuggaacuccggcgcucucacaucuggggugcauaccuuuccugccgugcugcaaagcuccggacuuuacagccugucuuccgucguuacagugcccagcucuagccucggcacccagaccuauauuuguaaugugaaccacaagccuuccaauacaaaggucgauaaaaagguggagccc

SEQ ID NO: 42213 - RNA, 678 nt, Artificial Sequence
  derived and/or modified sequence opt5 from anti-HIV_5CIL_HeavyChain
gugcagcugguccaaagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcgacggggaucugggaaaacccaucggcgcuuucgcccacugggggcagggaacccucgugacagucagcucugcguccaccaaaggcccuagcguguuuccccuggccccuucuuccaagagcacaucugggggaaccgcugcccugggcugccucguuaaagacuauuucccggaacccgugacggucuccuggaacagcggcgcucugacauccggggugcauaccuuuccugccgugcuucaaucuagcggacuguacucccucagcucugucguuacagugcccuccagcucucugggcacccagaccuauauuuguaaugugaaccacaagccuagcaauacaaaggucgauaaaaagguggagccc

SEQ ID NO: 42214 - RNA, 678 nt, Artificial Sequence
  derived and/or modified sequence opt5 from anti-HIV_5CIP_A-Chain
gugcagcugguccaaagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcuggggguggcugggaaaacccaucggcgcuuucgcccacugggggcagggaacccucgugacagucagcucugcguccaccaaaggcccuagcguguuuccccuggccccuucuuccaagagcacaucugggggaaccgcugcccugggcugccucguuaaagacuauuucccggaacccgugacggucuccuggaacagcggcgcucugacauccggggugcauaccuuuccugccgugcuucaaucuagcggacuguacucccucagcucugucguuacagugcccuccagcucucugggcacccagaccuauauuuguaaugugaaccacaagccuagcaauacaaaggucgauaaaaagguggagccc

SEQ ID NO: 42215 - RNA, 681 nt, Artificial Sequence
  derived and/or modified sequence opt5 from anti-HIV_5CIP_HeavyChain
gugcagcugguccaaagcggcgccgagguuaagagacccggguccucugugaccgugagcugcaaggcuuccggaggcucuuucagcacauacgcccucuccuggguccggcaggcgccugggcgcggacuggaauggaugggcggggugaucccgcuucugacgauuaccaacuaugcucccagauuucagggacggaucacaauuaccgccgaccgcucuacaagcaccgccuaccucgagcuuaauucccugagaccugaagauacagcuguuuauuacugugcccgggagggcaccacgggcuggggguggcugggaaaacccaucggcgcuuucgcccacugggggcagggaacccucgugacagucagcucugcguccaccaaaggcccuagcguguuuccccuggccccuucuuccaagagcacaucugggggaaccgcugcccugggcugccucguuaaagacuauuucccggaacccgugacggucuccuggaacagcggcgcucugacauccggggugcauaccuuuccugccgugcuucaaucuagcggacuguacucccucagcucugucguuacagugcccuccagcucucugggcacccagaccuauauuuguaaugugaaccacaagccuagcaauacaaaggucgauaaaaagguggagcccaaa

SEQ ID NO: 42216 - RNA, 630 nt, Artificial Sequence
  derived and/or modified sequence opt5 from anti-HIV_4JKP_LightChain
gagaucgugcugacccagagccccgccacacucucccugucuccuggcgaaacggcuauuaucagcugcagaaccucccaauacgggucucuugccugguaucagcagcggccgggacaggcgccccgccuggucauuuacagcggcuccacaagagcugccgggaucccugaccgguucucuggaagccgcuggggcgccgauuauaaccucuccauuagcaaucuggagucuggggacuuuggaguuuacuauugucaacaguacgaguucuuuggccagggcaccaagguccagguggauaucaaaagaacaguggcugcccccuccguguucaucuuuccucccagcgacgaacaacuuaagucugggaccgcuuccguugugugccugcucaacaauuucuauccucgggaagccaaaguccaguggaagguggauaacgcgcugcagagcggaaauucucaggaguccguuacagagcaagacagcaaagauuccaccuacucucugagcuccacgcucacccugagcaaggccgacuacgaaaagcacaaaguguaugcuugugaggucacacaucagggccuuucuuccccggugaccaagagcuuuaaccgcggggaaugc

SEQ ID NO: 42217 - RNA, 678 nt, Artificial Sequence
  derived and/or modified sequence opt5 from anti-HIV_3TNN_E-Chain
gaggugcagcuggucgaaagcggcgggggacucguucaacccggcgggucccugagacuuucuugcgccgcuagcggauucaccuuuuccacauacgccaugucuugggugcggcaggcgccuggcaaggggcuggagugggugagcuccaucaacaauucuggacgcaacacguucagcgcugacuccgucaaaggcagauuuaccauuagccgggauaauucuaagaacacacucuuccuggugaugaauagccuucgcgccgaagacaccgccguuuauuacugugcuaaagaucugagacucggcgggggauccgacuauuggggccaggggacacuggugaccgucucuuccgccagcacaaagggaccgucuguguuuccccuggcuccuuccagcaaauccaccucuggcgggacggccgcgcucggaugccugguuaaggauuacuuccccgagccugugaccgucagcuggaacuccggcgcccuuacaagcggcgugcacaccuuucccgcugugcugcagucuuccgggcucuauagccugucuagcgucguuacagugccuuccucuagccuuggaacccaaacguacaucuguaaugugaaccauaagccguccaauacaaaagucgacaagcggguggaacccaaaagcugcgauaagacccac

SEQ ID NO: 42218 - RNA, 705 nt, Artificial Sequence
  derived and/or modified sequence opt5 from anti-HIV_3BQU_B-Chain
agaaucacccugaaggagagcgggcccccucucgugaaaccgacacagacgcugacccuuacaugcuccuucucuggcuuuagccuguccgacuucggagucggcguuggguggauucggcaacccccuggaaaggcccucgaauggcuggcuaucauuuacucugaugacgauaaacgcuauagccccucccuuaacaccagacugacaaucaccaaggacacaucuaaaaaucagguggugcucgucaugacccgggugagcccuguugauacggccaccuacuuuugugcgcaccgcagaggccccacaacccuguucggggugccuauugcucggggaccggucaacgccauggacguguggggccagggcaucacaguuaccaucuccagcacgucuacaaaggggcccuccguguuuccucuggcccccagcucuaaguccaccgcuggaggcgccgcugcccucgggugccuggucaaagauuauuucccugagcccgugacagugagcuggaauagcggagcgcuuaccuccggcguccauaccuuuccggccguucugcagagcuccgggcucuacucucugagcuccguggugacagucccuucuucuucccuuggaacgcaaaccuauacauguaacgugaaucacaagcccagcaacaccaaaguugacaagcgcguggaaccuaaaucuugc

SEQ ID NO: 42219 - RNA, 642 nt, Artificial Sequence
  derived and/or modified sequence opt5 from anti-HIV_3BQU_A-Chain
gcccugcagcucacccaaagccccuccucucugagcgcuuccgugggcgacagaaucacaauuacgugccgggccucucagggggucaccagcgcgcuugcuugguaccgccagaagccuggauccccgccccagcugcucaucuaugaugccucuagccuggaguccggcguuccuagcagauucucuggguccggaagcggcacagaauuuacccuuacaauuucuacccugcggcccgaggacuucgccacauacuauugucaacagcuccacuuuuacccucauaccuucgggggaggcacgcgcguggaugugagacggaccgucgcugcccccuccguguuuaucuucccuccgagcgacgaacagcugaaaucuggcacagcuuccguugugugccugcucaacaauuuuuauccccgcgaggccaagguccaguggaaaguggauaacgcgcugcaaagcggaaauucccaggaaucuguuaccgagcaggacagcaaggauuccacauacagccuuucuuccacccugacgcucagcaaagccgacuaugagaagcacaagguguacgaaugugaggucacacaucaggggcugucuagcccugugaccaaauccuucaacagaggcgaaugc

SEQ ID NO: 42220 - RNA, 387 nt, Artificial Sequence
  derived and/or modified sequence opt5 from anti-HIV_IgG_VR-Chain
auggagacccccgcccagcuccuguuccugcuucugcucuggcugccugacacaacgggcgaaaucgugcuuacccaaagcccggggacacugucccucucugcuggagagagagccacccugagcugccgggcgucccagucugucagcucccgcuaccuggcuugguaucagcagaagcccggccaagccccuagacuccugauuuacggggccucuagccgggcuacaggaauccccgaucgcuuuuccggcagcgggucuggaaccgacuucacacuuaccauuuccagaguugaaccugaggauuuugccggcuauuacugucagcaguaugacaacagcgugugcacguucggccaggggaccaaacuggaaaucaagcgg

SEQ ID NO: 42221 - RNA, 348 nt, Artificial Sequence
  derived and/or modified sequence opt5 from anti-HIV_IgG_HeavyChain
augaagcaccugugguucuuucuccugcuuguggccgcucccagauggguccugagccagguucaacuccaggaguccggcccugggcuggugaaaccgucugaaacccuuagccugacaugcacgguguccggaggcucuaucagcucccauuacuggucuuggauucggcagagccccgggaagggacuccaguggaucggcuauauuuacuauuccgggagcaccaacuacucuccuucccugaaaagccgcgucacaaucucuguggagaccuccaagaaucaauucagccugaaacucacaucuaugaccgccgcggacacagcuguuuauuacugugccaga

SEQ ID NO: 42222 - RNA, 714 nt, Artificial Sequence
  derived and/or modified sequence opt5 from anti-HIV_4P9M_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagaaccugacauccgaugacaccgccgucuauuucuguacaaccacaagcaccuacgauaaauggucuggacuucaucacgacggcgugauggccuuuuccagcuggggccaagggacgcugaucucuguuuccgcugccagcaccaagggaccuuccguguucccccucgcuccuucuagcaaguccacaagcggcgggaccgccgcgcugggaugccuggucaaagauuauuuucccgaaccugugacagugucuuggaacuccggcgcccucaccagcgggguccauacguucccggcuguucugcagucuagcggacuuuacucccugucuagcguggugacaguccccuccagcucucucggcacccagacauauaucuguaaugugaaucacaagccuuccaacaccaaaguugacaagcggguggagcccaaaagcugcgauaagacc

SEQ ID NO: 42223 - RNA, 645 nt, Artificial Sequence
  derived and/or modified sequence opt5 from anti-HIV_4P9M_LightChain
gacauccagaugacccaaagccccuccacacugucugccagcauuggcgauacggugagaaucuccugccgggcuucucagagcauuaccgggaacugggucgccugguaccagcagcgcccuggaaaggcgccgagacuccugaucuaucggggcgcugcccuucucgggggaguucccucccgcuucucuggcagcgccgcugggacagacuuuacccugacaauuggaaaucugcaagccgaggauuucggcaccuuuuacugucagcaguaugacacauacccuggcaccuucgggcagggaacgaaaguggaagugaagagaaccgucgcugcccccuccguguuuaucuucccucccagcgaugagcaacuuaaaucuggcacagcguccguugugugccugcucaacaauuuuuauccucgggaagccaagguccaguggaaaguggacaacgcucugcagagcgggaauagccaggaguccguuaccgaacaagauagcaaggacucuacauacucccugagcuccacccucacgcugucuaaggccgauuaugagaaacacaagguguacgcuugugaggucacacaucagggacuuagcuccccggugaccaaaucuuucaaccgcggcgaaugc

SEQ ID NO: 42224 - RNA, 558 nt, Artificial Sequence
  derived and/or modified sequence opt5 from anti-HIV_4P9H_C-Chain
aagaaagugguccugggcaagaaaggggacaccguugaacucacaugcacggccagccagaagaaauccauccaauuccacuggaagaacucuaaucagauuaagauccugggaaaccagggcagcuuucuuaccaaagggcccuccaagcugaaugauagagcugacucucggcgcagccucugggaucagggaaacuucccucugauuaucaaaaaucuuacaauugaagacuccgauaccuacaucugugagguggaagaccaaaaggaggaagugcagcugcucgucuuuggccugacagccaacucugauacccaucugcuccaggggcagagccugacacuuacccuggaguccccgcccggaagcucuccuuccgugcaaugcagaagcccccggggcaaaaauauccagggcgggaagacgcucucuguuucccagcuggagcuucaggacagcggaaccuggacauguaccgugcugcaaaaccagaagaaagucgaguucaagauugauaucgugguucucgcguuucagaaagcuauugacggccgc

SEQ ID NO: 42225 - RNA, 462 nt, Artificial Sequence
  derived and/or modified sequence opt5 from anti-HIV_4YBL_A-Chain
gugcccgucuggaaggacgccgauaccacacuguucugcgcuagcgacgccaaagcgcacgagacggaaugucauaacguuugggcuacccacgccugcgugccuacagauccgaauccccaggagauccaucucgaaaacgugaccgagaauuuuaacauguggaagaauaacauggucgaacaaaugcaggaggacgugauuucccugugggaucagugucuucagccuggcggggcccccaaaaucucuuucgacccuauucccauccacuacugcaccccugcuggauauguuauucugaaguguaaugauaaaaacuuuaauggcacagggccgugcaagaacgugagcuccguccaauguacacauggaaucaagcccgugguuucuagcggcgggggaaauaucaaagacaacuggagauccgagcucuacaaguauaaagugguccagauugaa

SEQ ID NO: 42226 - RNA, 1056 nt, Artificial Sequence
  derived and/or modified sequence opt5 from anti-HIV_4R4N_V-Chain
aucuggaaggacgccaacaccacacuguucugcgcuagcgaugccaaagcguacgacacggaggugcacaaugucugggcuacccaugccuguguucccacagauccuuccccgcaggaacucaagauggagaacgugaccgaagaguuuaauauguggaaaaacaauaugguggaacaaaugcacacagacauuaucucucugugggaucagagccuuaagcccugcguccagcugaccggcggguccgcccucacacaggcuuguccuaaagugaccuucgagcccauuccuauccauuauugcgcccccgcuggauacgccauucugaaguguaacgacaaggaguuuaauggcacggggcuuugcaaaaacguuucuaccgugcaauguacacacggaaucagaccugucgugagcacccagcugcuccugaauggcucccuggcggaagggaagguuaugauccggucugagaacauuacaaauaacgugaaaaauaucauuguccagcucaacgaaagcgugaccaucaauugcacgcgcccgaacaacggaggcuccggcagcgggggagauauuagacaggcccauuguaaugugucuggcucccaauggaacaagacacugcaccaggucguugagcagcuucggaaauauuggaauaacaauaccaucauuuucaacucuagcuccgggggagaccuggagaucacaacccacagcuuuaauugcggcggggaguucuuuuacuguaacaccucuggacucuucaauuccacaugggugaacggcacggcuagcaucgaaaauggcaccauuacacugcccugccgcaucaagcagauuaucaacauguggcaaagaguggggcaggccauuuaugcuccucccauccagggagucauccggugcguguccaauauuaccggccuuauccugacacgcgaugggggaggcaacucuaaugaaaacgagaccuuuagaccugggggaggcgacaugcgggauaacuggcgcagcgaacucuacaaguauaaaguugugaagauugag

SEQ ID NO: 42227 - RNA, 1065 nt, Artificial Sequence
  derived and/or modified sequence opt5 from anti-HIV_4JKP_G-Chain
guguggaaggacgccgauaccacacuguucugcgcuagcgacgccaaagcgcacgagacggaaugucauaacgucugggcuacccacgccugcguucccacagauccuaauccgcaggagauccaucucgaaaacgugaccgagaauuuuaacauguggaagaauaacaugguggaacaaaugcaggaggacgucauuucccugugggaucagugucuucagcccugcgugaaacugacaggcgggucuguuaucaagcaagccuguccuaaaauuagcuucgaccccaucccuauucacuacugcacccccgcuggauaugugauccucaaguguaaugauaagaacuuuaauggcacagggccuugcaaaaacgucuccucugugcaguguacccauggaaucaagccgguugugagcacgcagcugcuucugaauggcucccucgccgaggaagagauuaucauuagaucugaaaaccugaccaauaacgcuaaaacaaucauuguccaccugaauaagagcguggagaucaacugcacccggcccuccaacgggggaagcggcucuggcggggacauucgcaaagccuacugugagaucaauggaacaaaguggaacaaggugcucaaacaggucaccgaaaagcugaaagagcacuucaauaacaagacgaucauuuuucaaccucccuccggcggggaucuugaaaucacaaugcaucacuucaauugcagaggagaguuuuucuauugcaacaccacacagcuguuuaauaacaccuguauuggcaaugaaaccaugaaagggugcaacggaacaaucacgcucccuuguaagauuaaacagaucaucaauauguggcagggcaccggccaagcgauguacgcucccccgauugacgggaagaucaacugcguuagcaauauuacaggaauccugcuuacccgggauggcggggccaacaauacaucuaacgagaccuuccgcccuggaggcgggaacauuaaggacaauuggagauccgagcuguauaaauacaagguggugcagaucgaaggaagc

SEQ ID NO: 42228 - RNA, 723 nt, Artificial Sequence
  derived and/or modified sequence opt5 from anti-HIV_3BQU_D-Chain
augggcuggagcuggaucuuccuguuucuccuguccgggaccgccggagugcacucuggcguccagcuucaacagagcgggcccgagcugguuaagccuggagcuuccgugaaaaugucuugcaaggccagcggcuacuccuucacagacuauuuuaugcauugggugaaacagucucacggaaagagccucgauuggauuggguacaucaacuguuauacgggcgcgaccaauuacucccagaaauucaagggcaaggcuacauuuaccgucgacacaagcucuaacaccgccuauaugcaauucaauucccugacaagcgaagauucugccguguacuauugcgcuagaaccuccauuggguacggaagcucuccgcccuuuccuuacuggggccaggggacgcuuguuaccguguccgccgcuaaaacaacacccccuagcgucuauccccuggccccuggauccgcggcccagaccaacucuauggugacccucggcugucugguuaagggguacuucccggagcccgugacggucacauggaauagcggaucccugagcucuggcgugcauaccuuuccugcugugcuccaguccgaccuguauacacuuagcucuagcgucaccguucccuccucuccucggcccagcgaaaccgugacaugcaacguggcccacccggcuuccagcacgaaagucgauaagaaaaucgugccucgc

SEQ ID NO: 42229 - RNA, 699 nt, Artificial Sequence
  derived and/or modified sequence opt5 from anti-HIV_3BQU_C-Chain
augaccauguucagccuggcccuccugcuuucccugcuccugcuuugcgugucugacagcggcgcugagacaacggucacccagucccccgccucucugagcauguccaucggggaaaagguuacaauuagauguaucaccucuacagauauugacgaugacaugaacugguaccaacagaaaccuggagagccgccccggcuccugaucagcgauggcaauacccugcgcccuggggugcccuccagauuuucuagcuccggauauggcacagacuucguguuuaccauugaaaacaugcucagcgaggaugucgcggacuacuauugccugcagucugauaaucuuccuuacacguucgggggaggcaccaaccuggaaaucaagcgggcugacgccgcccccacaguguccaucuuuccuccgagcucugagcagcucaccuccggcggggcuagcguuguguguuuccugaauaacuuuuaucccaaagauauuaaugucaaguggaaaaucgacggauccgagcgccaaaacggcgugcuuaauucuuggacagaucaggacagcaaggacuccaccuacagcaugucuuccacgcugacacucaccaaggaugaauaugagagacacaacagcuacacaugcgaagccacccauaaaaccucuacaagcccuauuguuaaguccuucaaucgg

SEQ ID NO: 42230 - RNA, 333 nt, Artificial Sequence
  derived and/or modified sequence opt5 from anti-HIV_Ig_LightChain
gacgugguccugacccagagccccgccucccucgcuguuucucugggccaaagagccacaaucagcugcaaggcgucccagucuguggauuacgacggggauagcuauaugaacugguaccagcagaaaccuggacaaccgcccaagcugcuuauucacgcugccuccaaucucgugucuggcaugccugcccgguucagcggguccggaagcggcacggacuuuacccugaacauccaucccgucgaggaagaggaugcugccacauauuacugucagcagucuauugaagacccucccaccuucgggggaggcacaaaacuugagaucaag

SEQ ID NO: 42231 - RNA, 342 nt, Artificial Sequence
  derived and/or modified sequence opt5 from anti-HIV_Ig_HeavyChain
gacgugcagcugcaacagagcggccccgggcucgucaagccuucccagucucugagccacacaugcaccguuacgggauacuccaucaccucugauuaugccuggaacuggauuagacaguucccgggcaauaaacuugaguggaugggguacaucagcuuuuccggaucuacaagcuauaaccccucccucaagagccggauuucuaucacccgcgacacauccaaaaaucuguucuuucugcaacuuaacagcgugaccacagaagauaccgcuacguacuauugugccagaggccugccugacuacugggggcagggaaccacacucaccgugucuucc

SEQ ID NO: 42232 - RNA, 1083 nt, Artificial Sequence
  derived and/or modified sequence opt5 from anti-HIV_4P9H_G-Chain
guguggaaggacgccgauaccacacuguucugcgcuagcgacgccaaagcgcacgagacggaaugucauaacgucugggcuacccacgccugcguucccacagauccuaauccgcaggagauccaucucgaacaagugaccgagaacuuuaauauguggaagaacaauaugguggaacagaugcaggaggacgucauuucccugugggaucagugucuucaacccugcgugaaacugacaggcgggucuguuaucaagcaggccuguccuaaaauuagcuucgaccccaucccuauucacuacugcacccccgcuggauaugugauccucaaguguaacgauaagaauuuuaacggcacagggccuugcaaaaaugucuccucugugcaguguacccauggaaucaagccgguugugagcacgcagcugcuucugaacggcucccucgccgaggaagagauuaucauuagaucugaaaaucugaccaacaaugcuaaaacaaucauuguccaucugcaaaagagcguggagaucaacugcacccggcccuccaaugggggaagcggcucuggcggggacauucgcaaagccuacugugagauccagggaacaaaguggaacaaggugcucaaacaggucaccgaaaagcugaaagagcacuucaacaauaagacgaucauuuuucagccucccuccggcggggaucuugaaaucacaaugcaccacuucaacugcagaggagaguuuuucuauugcaauaccacacaacuguuucagaacaccuguauuggcaaugaaaccaugaaagggugcaacggaacaaucacgcucccuuguaagauuaaacagaucaucaauauguggcaaggcaccggccaggcgauguacgcucccccgauugacgggaagaucaacugcguuagccagauuacaggaauccugcuuacccgggauggcggggccaauaacacaucuaaugagaccuuccgcccuggaggcgggaacauuaaggacaauuggagauccgagcuguauaaauacaagguggugcagaucgaaggaagccaucaccaccaucaccau

SEQ ID NO: 42233 - RNA, 147 nt, Artificial Sequence
  derived and/or modified sequence opt5 from anti-HIV_Chain
caggugcaacugguccagagcggcgggcagaugaagaaacccggagaguccaugagaaucucuugccgggccagcggcuacgaguucauugacuguacccucaacuggauccgccuggcuccugggaagagaccggaauggauggga

SEQ ID NO: 42234 - RNA, 180 nt, Artificial Sequence
  derived and/or modified sequence opt5 from anti-HIV_Chain
cccugcuguuucgccuacaucgcuagaccucugccgcgggcccacauuaaggaguauuuuuacaccagcggcaaaugcuccaaccccgcgguggucuucguuacacgcaagaauagacaggugugugcuaacccugagaaaaagugggugcgggaauauaucaauucucucgaaaugagc

SEQ ID NO: 42235 - RNA, 249 nt, Artificial Sequence
  derived and/or modified sequence opt5 from anti-HIV_Chain
cuggaguggaugggcagaaucauucccgccaucgacgaugugaccuacgcucagacauuccgggggcgcgucacguuuagcgccgacaaguucaccacaaccgcguauauggaucucacaggacugagauccgaagacaccgcuacauacuuuugcgcccgggauccucaaguuaaccgcagaggcaauuguuucgaccacugggggcagggaacccuugugacggugucuagcgccuccaccaaaggc

SEQ ID NO: 42236 - RNA, 270 nt, Artificial Sequence
  derived and/or modified sequence opt5 from anti-HIV_Chain
gacguggucaugacccagagcccccugucccucccuguuacacugggccaaccggccucuaucagcugcagauccucucagagccuuguguacucccacggggauacguaucugaaguguuuccagcagcggcccggacaaucuccucgcagacccauuuacaaagugagcaaccgggacuccggcgucccugaucgcuuuagcgggucuggauccggcaccgacuucacacucaagaucagcagaguggaggcugaagauguuggggug

SEQ ID NO: 42237 - RNA, 294 nt, Artificial Sequence
  derived and/or modified sequence opt5 from anti-HIV_Chain
agcuccuucgccaucucuugggugagacaggcucccggccaagggcuggaguggaugggaggcauuaucccuauuuuugaagccaccagcuacgcgcagaaguuccaggaccggcucacaaucacgaccgaugaguccacaaccacagcuuauauggaccugucuagccuucgcuccgaagauaccgccgucuacuauugcgccagagcucagggggacauucugacagagggauacuuugauuauuggggccaagggacccucguuacggugucuagcgccuccaccaaagga

SEQ ID NO: 42238 - RNA, 297 nt, Artificial Sequence
  derived and/or modified sequence opt5 from anti-HIV_Chain
aacaccuucacaagccacuacgugcauugggucagacaggcccccggccaagggcuggaguggaugggaaugaucaauccuggcgggacgacccgguaugcuccgaaguuucaggaccgcguuacacucaccagagauacauccacccggacaguguacauggaacugcgcucucuuagaagcgaggacaccgccguguauuacugcgcgcggccccaguauaaccugggacgcgaaccucucaaugucuggggccaggggacgauggugaccguuuccucugcuagcacaaaagga

SEQ ID NO: 42239 - RNA, 297 nt, Artificial Sequence
  derived and/or modified sequence opt5 from anti-HIV_Chain
auccggagcuucuacuggcacuggauuagacagucccccggcaaggggcuggaguggcucggaucuguguuugacaacggccugaccacacauaauccuagccuuaaaucccgccugacgaucucugaagauccgagcagaaaccaaauuucccucaagcugcggucuaugaccgccgcugacacagccgucuauuacugcgcgcgcggggauuaugacauccuuaccagcuccuaccaguucgauuauuggggacagggcacacugguugcugugagcucugccuccaccaaaggg

SEQ ID NO: 42240 - RNA, 300 nt, Artificial Sequence
  derived and/or modified sequence opt5 from anti-HIV_Chain
cagagcgcccugacccaacccgcuuucguguccggcucuccugggcagagcaucacacucuccugcacgcugggaaccgaggacgucucuugguaccagcagagaccgaacagcgcgccccggcuuauuaucuuugauguuaagaaacgcccuuccgacgugucugauagauucagcggccacaauuccgacacagccgcuuuucugaccauuagcgaacuccggcccgaggaugaagccgacuauuucuguacaucuuggccuuaccgcuuugauagagggaccaagguggacgucgcc

SEQ ID NO: 42241 - RNA, 300 nt, Artificial Sequence
  derived and/or modified sequence opt5 from anti-HIV_Chain
cagagcgcccugacccaacccgcuuucguguccggcucuccugggcagagcaucacacucuccugcacgcugggaaccgaggacgucucuugguaccagcagagaccgaacagcgcgccccggcuuauuaucuuugauguuaagaaacgcccuuccgacgugucugauagauucagcggccacaauuccgacacagccgcuuuucugaccauuagcgaacuccggcccgaggaugaagccgaguauuucuguacaucuuggccuuaccgcuuugggagaggaaccaagguggacgucgcc

SEQ ID NO: 42242 - RNA, 300 nt, Artificial Sequence
  derived and/or modified sequence opt5 from anti-HIV_Chain
cagagcgcccugacccaccccgcuuucguguccggcucuccugggcaaagcaucacacucuccugcacgcugggaaccgaggacgucucuugguaccagcagagaccgaacagcgcgccccggcuuauuaucuuugauguucgcaagagaccuuccgaagugucugaccgguucagcggccauaaauccgauacagccgcuuuucugaccauuagcgaccuccgccccgaggaugaagccgaguauuucuguacaucuuggccuuacagauuugaccgggggacccgccuggauguggcc

SEQ ID NO: 42243 - RNA, 300 nt, Artificial Sequence
  derived and/or modified sequence opt5 from anti-HIV_Chain
cagagcgugcugacccaacccgccuucgucuccggcucuccugggcagagcaucacaauuuccugcacgguuggaaccacagacgugucuugguaccagcagagaccgaacagcgcuccccggcucaucauuuuugaugugaagaaacgcccuuccggcgucucugacagauucagcggguccagcucugauaaugccgcguuucugaccaucgcuggacuucggcccgaggacgaagccgaguauuacuguacauccuggccuuaucgcuucggcagagggaccaagguggauguugga

SEQ ID NO: 42244 - RNA, 300 nt, Artificial Sequence
  derived and/or modified sequence opt5 from anti-HIV_Chain
cagagcgugcugacccaacccgccuucgucuccgcuucuccuggccagagcaucacacucuccugcaaccuggggacggacuacguuucuugguaucagcagagaccgagcuccgcgccccggcuuauuaucuuugaugugaagaaucgcccuucuggagugagcgacagauucuccggcuacaacagcgauaccgccgcuuuucugacaauuucugggcuccaacccgaggacgaagccgaguauuacuguaccuccuggccuuauaauuucggacccggcacaaaagucgaugugacc

SEQ ID NO: 42245 - RNA, 300 nt, Artificial Sequence
  derived and/or modified sequence opt5 from anti-HIV_Chain
cagagcgugcugacccaacccgccuccgucucuggcagcccugggcaguccaucaacauuucuugcgcuggaagaagcgaccggguuuccugguaccagcagcgcccgaauggcgugcccaagcuccugcuuuucgauguguauagacggccuucuggggucagcgaccgcuuuuccggaagccacucugaugacacagccuuccugacgaucuccggccuccaaaccgaugacgaggcggauuacuauuguacaagccaucccuacgcuuuugggccuggaaccaaagugaacguucug

SEQ ID NO: 42246 - RNA, 300 nt, Artificial Sequence
  derived and/or modified sequence opt5 from anti-HIV_Chain
cagagcgugcugacccaacccgccuucgucuccggcucuccugggcagagcaucacacucuccugcacgcugggaaccgaggacguuucuugguaccagcagagaccgaacagcgcuccccggcuuauuaucuuugaugugaagaaacgcccuuccgacgugucugauagauucagcggccacaauuccgacacagccgcguuucugaccauuagcgaacuccggcccgaggaugaagcugaguauuucuguacaucuuggccuuaccgcuuugggagaggaaccaaggucgacguggcc

SEQ ID NO: 42247 - RNA, 306 nt, Artificial Sequence
  derived and/or modified sequence opt5 from anti-HIV_Chain
cagagcgcccugacccaacccgcuuccgugucuggcagcccugggcaguccaucacaauuucuugcacggccgacagcgauuacgucuccugguaucagcagagaccgaacucugcgcccaagcucauccuguucgacguuaauagccggccuuccggagugagcgaucgcuacucuggcuccagaagcgggaacaccgcuucucuuacaauuuccggacugcaacgggaggacgaagccgauuauuuuuguacccccuggccuuacgacuuccgccccggcacaagaguguuuguccucgggcag

SEQ ID NO: 42248 - RNA, 306 nt, Artificial Sequence
  derived and/or modified sequence opt5 from anti-HIV_Chain
cagagcgcccugacccaacccgcuuucguguccggcucuccugggcagagcaucacacucuccugcucucugggaacggccgacgucagcugguaccagcagagaccgaacuccgcgccccggcuuauuaucuuugauguuaagaaacgcccuucugacgugagcgauagauucuccggccacaauagcgacaccgcugccuuugugacaauuucugagcugcggcccgaagaugaggccgaauauuucuguaccuccuggccuuaccgcuuugggcccggaacaaaggucgacguggcuagacaa

SEQ ID NO: 42249 - RNA, 306 nt, Artificial Sequence
  derived and/or modified sequence opt5 from anti-HIV_Chain
cagagcgugcugacccaacccgccuccgucucuggcagcccugggcagacaaucuccauuucuugcagcggaacguucggcuccgacucuguuagcugguaccagcaguuuccgaacuccgcucccacccucaucauuuucgaugugcacagacggccuagcgggaucucuacacgcuuuuccggaagcaccucuggcgacacagccucccugaccauuagcacacuucauagagaggaugaagcguucuauuacuguaccucucaccccuaugacuuugggggaggcacguacgugaucguccug

SEQ ID NO: 42250 - RNA, 306 nt, Artificial Sequence
  derived and/or modified sequence opt5 from anti-HIV_Chain
cagagcgugcugacccaacccgccuccgucucuggcagcccugggcagacaaucuccauuucuugcagcggaacguucggcuccgacucuguuagcugguaccagcaguauccgaacuccgcucccacccucaucauuuuugaugugcacagacggccuagcgggaucucuacacgcuucuccggaagcaccucuggcgacacagccucccugaccauuagcacacuucauagagaggaugaagcguacuauuacuguaccucucaccccuaugacuuugggggaggcacguacgugaucguccug

SEQ ID NO: 42251 - RNA, 306 nt, Artificial Sequence
  derived and/or modified sequence opt5 from anti-HIV_Chain
cagagcgcccugacccaacccgcuuccgugucuggcagcccugggcaguccaucaacauuucuugcgccggaagaagcgaccgggucuccugguaccagcagcgcccgaauggcguucccaagcuccugauguucgauguguauagacggccuucuggggugagcgaccgcuuuuccggaagccacucuggcgauacagcguuccuuacgaucuccgggcugcaaaccgaggacgaagcugauuacuauuguacaagccaucccuacgccuuuggagccggcaccaaagucaacgugcucagacag

SEQ ID NO: 42252 - RNA, 306 nt, Artificial Sequence
  derived and/or modified sequence opt5 from anti-HIV_Chain
gacauccagaugacccaaagccccuccucucugagcgccuccgugggcgauagagucucuauucacugccaggcugggcagggaaucggcagcucccucaacugguaccagcaaaagccugggcgggccccgcgccugcuuguucauggagcgucuaaucugcagagaggcgugcccagccgguucuccgggagcggauuucacacaacguucacccucacaauuucuucccugcagccugacgauguggcuaccuauuggugugccgcccuugaguuuuucggccccggcacaaaagucgaaauc

SEQ ID NO: 42253 - RNA, 309 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcagcccgaggauaucgcgaccuacuuuugucagguguaugaguucguggucccugggacaagacuugaccugaaacggaccguggcu

SEQ ID NO: 42254 - RNA, 309 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaagagggguuccggcgcgguucucuggacgcagauggggccaagaauauaaccucacaauuaauaaccugcagcccgaggauguggcuaccuacuuuugucagguguaugaguucaucgucccugggacacggcuugaccugaaacgcaccguggcc

SEQ ID NO: 42255 - RNA, 309 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaagagggguuccgucucgguucagcggacgcagauggggccaagaauauaaccucacaauuaauaaccugcagcccgaggauaucgcgaccuacuuuugucagguguaugaguucgcugugccugggacacggcuugaccugaaacgcaccgucgcc

SEQ ID NO: 42256 - RNA, 309 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcaggcggaggauaucgcuaccuacuuuugucagguguaugaguucgccgugcccgggacaagacuugaccugaaacggaccgucgcc

SEQ ID NO: 42257 - RNA, 309 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcagcccgaggauaucgcgaccuacuuuugucagguguaugaguucauugugccugggacaagacuugaccugaaacggaccgucgcu

SEQ ID NO: 42258 - RNA, 309 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaacagggguuccgucuagauucaccggacggcgcuggggccaagaauauaaccucacaauuaauaaccugcagcccgaggauaucgcgaccuacuuuugucagguguaugaguucauugugccugggacaagacuugaccugaaacggaccgucgcu

SEQ ID NO: 42259 - RNA, 312 nt, Artificial Sequence
  derived and/or modified sequence opt5 from anti-HIV_Chain
gacauccagaugacccaaagccccuccucucugagcgccuccgugggcgauaaggucacaauuacgugccagaccucugcuggguaccucaacugguaucagcagagacggggacgcgccccuaaacugcuuauguacgacggcagcagacugguuacaggggugccgucccgguucucuggacgcagauggggcacccaauauaaucucacaaucgggagccugcagcccgaggauguggcgaccuacuauugucaggucuacgaauuuuucggaccuggcacacggcuugaccugaagcgcaccguggcu

SEQ ID NO: 42260 - RNA, 312 nt, Artificial Sequence
  derived and/or modified sequence opt5 from anti-HIV_Chain
gacauccagaugacccaaagccccuccucucugagcgccuccgugggcgauaaggucacaauuacgugccagaccucugcuggguaccucaacugguaucagcagagacggggacgcgccccuaaacugcuuauguacgacggcagcagacugguuacaggggugccgucccgguucucuggacgcagauggggcacccaauauaaucucacaaucgggagccugcagcccgaggauauugcgaccuacuauugucagguguacgaauuuuucggaccuggcacacggcuugaccugaaguccaccgucgcu

SEQ ID NO: 42261 - RNA, 312 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaagagggguuccggcgcgguucucuggacgcagauggggccaagaauauaaccucacaauuaauaaccugcagcccgaggauguggcuaccuacuuuugucagguguaugaguucaucgucccugggacacggcuugaccugaaacgcaccguggccgcc

SEQ ID NO: 42262 - RNA, 312 nt, Artificial Sequence
  derived and/or modified sequence opt5 from anti-HIV_Chain
ugcaccgugagcggcggguccaucauuucuuacuauuggaacuggaucagacagagccccggaaagggccuggaguggcucggguacauuuucgacggaggccgggccaauuauaacccuucccugcgcucuagacuuacaaugagcgucgauacguccaaaaaucaaaucucucugaagguuaaaagcgugaccgcugccgacuccgcgauuuacuauugugcucggcucgauggggaagccuuucgcuacuauuucgacagcuggggacagggcacacuggugaccgucucuuccgccagcacaaagggc

SEQ ID NO: 42263 - RNA, 312 nt, Artificial Sequence
  derived and/or modified sequence opt5 from anti-HIV_Chain
gugagcggcgggagauucuccaacuacggacugucuuggguccggcaggcccccggccaagggcucgaguggaugggacgcaucguuccugcuauuaauagagccaaguaugcgcagaaauuucagggccgggugauccugaccgcugacaagauuacagauacggccuacauggaacuucgcagccugagauccgaggacaccgccaucuucuauugcgcucgggauccgcagauugaaauccgcgggaacgccuuugacaucuggggacaaggcacaguggucaccgugucuagcgcuuccacaaaaggc

SEQ ID NO: 42264 - RNA, 315 nt, Artificial Sequence
  derived and/or modified sequence opt5 from anti-HIV_Chain
agcgacaucuccguggcccccggcgagaccgcuagaauuucuugcggggaaaagagccugggaucccgggccguccagugguaccaacaccgcgcgggccaggcuccuucucucaucauuuauaacaaucaggauagaccgagcgggauccccgagcgguucuccggaucuccugacagccccuuuggcacaacggccacccugacaauuaccuccguugaagccggggaugaggcugacuacuauugucauaucugggauagccgcgugccuacaaaauggguguucggaggcggcaccacacuuaccguccug

SEQ ID NO: 42265 - RNA, 315 nt, Artificial Sequence
  derived and/or modified sequence opt5 from anti-HIV_Chain
agcuccaugucugugagccccggcgagaccgccaagaucuccugcgggaaagaaucuauuggaagcagagcuguccagugguaccaacagaaguccggccagccuccgucucugaucauuuauaacaaucaggaccggcccagcgggguuccugagcgcuucuccgccacacccgauuuuggagcgggcacgaccgcuacacucaccaucacaaacguggaagccgacgaugaggccgacuacuauugucacauuuacgaugcuagagggggaaccaauuggguguucgaccggggcgccacacugaccguccuu

SEQ ID NO: 42266 - RNA, 315 nt, Artificial Sequence
  derived and/or modified sequence opt5 from anti-HIV_Chain
agcuucguguccgucgcccccggccagaccgcuagaaucacaugcggggaggaaucucugggaagccgguccguuauuugguaccaacagcgcccuggccaggccccgucucucaucauuuauaacaauaacgacagacccagcgggaucccugagcgguuuuccggaucucccggcagcacguucgggaccacagcgacccugacaauuaccuccguggaagcuggagaugaggccgacuacuauugucacaucugggauagccgcagaccuacaaauuggguguuuggcgaaggcaccacgcuuaccguccug

SEQ ID NO: 42267 - RNA, 315 nt, Artificial Sequence
  derived and/or modified sequence opt5 from anti-HIV_Chain
agcuucguguccgucgcccccggccagaccgcuagaaucacaugcggggaggaaucucugggaagccgguccguuauuugguaccaacagcgcccuggccaggccccgucucucaucauguauaacaaucacgacagacccagcgggauuccugagcgguuuuccggaucucccggcagcacguucgggaccacagcgacccugacaaucaccuccguggaagcuggagaugaggccgacuacuauugucauauuugggauagccgcagaccuacaaacuggguguuuggcgaaggcaccacgcuuaccguccug

SEQ ID NO: 42268 - RNA, 315 nt, Artificial Sequence
  derived and/or modified sequence opt5 from anti-HIV_Chain
gacauccagaugacccaaagccccuccucucugagcgccuccgugggcgauaaggucacaauuacgugccagaccucugcuggguaccucaacugguaucagcagagacggggacgcgccccuaaacugcuuauguacgacggcagcagacugguuacaggggugccgucccgguucucuggacgcagauggggcacccaauauaaucucacaaucgggagccugcagcccgaggauauugcgaccuacuauugucagguguacgaauuuuucggaccuggcacacggcuugaccugaaguccaccgucgcugcc

SEQ ID NO: 42269 - RNA, 315 nt, Artificial Sequence
  derived and/or modified sequence opt5 from anti-HIV_Chain
gacauccagaugacccaaagccccuccucucugagcgccuccgugggcgauagagucucuauuaacugccaggcugggcagggacucggcagcucccugaauugguaccagcaaaagccugggcgggccccgaaacuucugguucacggagcgucuaaccuccagcgcggcgugcccagcagauucuccgggagcggauuucauacaacguucacccugacaaucucuucccuucagccugacgauguggcuaccuauuuuugugccgccuuccagugguuuggccccggcacaaaggucgagauuaaacggacc

SEQ ID NO: 42270 - RNA, 318 nt, Artificial Sequence
  derived and/or modified sequence opt5 from anti-HIV_Chain
ugcaccgugagcggcggguccaucucuagcgccggauacuauuggacauggauuagacagcaccccggcaaggggcuggaguucaucggauacauuuauuacaucggcacgaccuauuacaacccuucccucaaaucucggcugacaauuagcaucgacaccuccaagaaucaauuuucucuuaaacugagcuccgucacagcugccgauaccgcgaucuauuacugugcucgcgacuacacagccagagggcggcauuucuuugauuauuggggacagggcgcccucguuaccgugagcucugcuuccacgaagggc

SEQ ID NO: 42271 - RNA, 321 nt, Artificial Sequence
  derived and/or modified sequence opt5 from anti-HIV_Chain
agcucccugccccucucucuggccccuggcgcuaccgccaagaucccgugcggggagaaaagcagaggaucccgggcggugcagugguaccaacagaagcccggccaggcuccuacacuuauuaucuauaacaaucaggaccgccccgccggggucucugaaagauacagcggaaacccugauguugccauuggcgugacggcuacccugacaaucucccggguggaggccggggacgaagcugaguauuacugucacuauugggauucucgcagccccauuuccugggucuucggaggcuggacccaacucacagugcug

SEQ ID NO: 42272 - RNA, 321 nt, Artificial Sequence
  derived and/or modified sequence opt5 from anti-HIV_Chain
agcucccugccccucucuguggccccuggcgcuaccgccaagaucgcgugcggggagaaauccuucgcuagcagagccguccagugguaccaacagaagccgggacaggcccccguucugauuaucuauaacaaucaggaccggccugcuggcgugucugaacgcuuuagcgggacacccgaugugggauucggcuccacggccacccuuacaauuucuagagucgaggcuggggacgaagccgauuacuauugucacaaaugggacagccgguccccucugagcuggguguuuggaggcggcacccaacucacaguucug

SEQ ID NO: 42273 - RNA, 321 nt, Artificial Sequence
  derived and/or modified sequence opt5 from anti-HIV_Chain
gacauccagaugacccaaagccccuccucucugagcgccuccauuggcgauagagugacaaucacgugccgggcuucucaggacauugccaacuaccucaauugguaucagaagaaaagcgggaccccuccgaagcugcuuaucuucgcggcuacaaaccugcaccgcggagucucccccagauuuaccggcucugggcauggaacacacuucagccucaccauuacaaauguucagcaugaggauuuuggcaacuacuucugucaacaguccuuugccaccguggggagcuucggacagggcacguggguggacauccgg

SEQ ID NO: 42274 - RNA, 321 nt, Artificial Sequence
  derived and/or modified sequence opt5 from anti-HIV_Chain
gacauccagaugacccaaagccccuccucucugagcgccuccauuggcgauagagugacaaucacgugccgggcuucucaggacauugccaacuaccucaauugguaucagaagaaaagcgggaccccuccgaagcugcuuaucuucgcggcuacaaaccugcaccgcggagucucccccagauuuaccggcucugggcauggaacacacuucagccucaccauuacaaauguucagcaugaggauuuuggccacuacuucugucaacaguccuuugccaccguggggagcuucggacagggcacguggguggacauccgg

SEQ ID NO: 42275 - RNA, 321 nt, Artificial Sequence
  derived and/or modified sequence opt5 from anti-HIV_Chain
gacauccagaugacccaaagccccuccucucugagcgccuccgugggcgauagagucacaauuacgugccgggcuucucaggacaucgccaacuaccucaauugguaucagaagaaaagcgggaccccuccgaagcugcuuauuuucgcggcuacaaaccugcaccgcggaguuucccccagauuuucuggcagcggguccggaacccauuucagccucacaaucaccaaugugcaguacgaggauuuugccaacuauuucugucaacacucuuuuggcacaauugggaccuucggacagggcacguggguggacauccgg

SEQ ID NO: 42276 - RNA, 321 nt, Artificial Sequence
  derived and/or modified sequence opt5 from anti-HIV_Chain
gacauccagaugacccaaagccccuccucucugagcgccuccauuggcgauagagugacaaucacgugccgggcuucucaggacauugccaacuaccucaauugguaucagaagaaaagcgggaccccuccgaagcugcuuaucuucggagcgacaaaccugcaccauggcgucucuccccgcuuuuccgggagcggacacggcacccauuucucccucacaauuaccaauguucagcacgaggauuuugcuaacuacuucugucaacagagcuuucagacaguggggucuuucggacagggcaccuggguggacaucaga

SEQ ID NO: 42277 - RNA, 321 nt, Artificial Sequence
  derived and/or modified sequence opt5 from anti-HIV_Chain
gaaaucgugcugacccagagccccgccacacucucccugucuccuggcgaaacggcuauuaucagcugcagaaccucccaaucugggagccuugccugguaccagcagcggccgggacaggcgccccgccuggucauuuauuccggcucuacaagagcugccgggaucccugaccgguucagcggaucccgcuggggcgccgauuacaaccucagcauuucuaaucuggaguccggggacuuuggaguuuauuacugucaacaguaugaguucuuuggccagggcaccaagguccagguggauaucaaaagaacaguggcu

SEQ ID NO: 42278 - RNA, 321 nt, Artificial Sequence
  derived and/or modified sequence opt5 from anti-HIV_Chain
gacauccagaugacccaaagccccuccucucugagcgccuccauuggcgauagagugaacaucacaugccaggcuucucgggacacggggagcgcccucaauugguaccagcagaaggucggacgcccuccgagacugcuuauuuccgcgguuucuaaccugggcgcuggggugcccagccgguucuccggacgcagaagcggcacccaaucuacacucaccaucaauacacugcagccugaagauauugccaccuauuuuugucagcacuacgaguucuuugggcccggaacaaaaguggacaucaagcggaccgucgcc

SEQ ID NO: 42279 - RNA, 321 nt, Artificial Sequence
  derived and/or modified sequence opt5 from anti-HIV_Chain
gacauccagaugacccaaagccccuccucucugagcgccuccgugggcgauagagucacaauuacgugccaggcugggcagggaaucggcucuagccuccagugguaccaacagaagccugggaaagccccgaagcugcuuguucacggagcguccaaccugcaucggggcgugcccucucgcuucagcggguccggauuucacaccacauucagccucaccauuucuggccugcagagagacgauuuugcuacauauuucugugccgugcuugaguuuuucggcccugggaccaaagucgaaaucaagcggacaguggcc

SEQ ID NO: 42280 - RNA, 324 nt, Artificial Sequence
  derived and/or modified sequence opt5 from anti-HIV_Chain
agcuacgugagaccccuguccgucgcccucggcgagaccgcuucuaucagcugcgggcggcaggcccugggaucccgcgcgguucaaugguaucagcacagaccuggccaggcuccgauucuucugaucuacaacaaucaggaccggcccucugggauuccugaacgcuucagcggaacacccgauaucaacuuuggcacgagagccacccucacaauuuccgggguggaggccggagacgaagcugauuauuacugucauaugugggacucucggagcggcuucuccuggagcuuuggcggggccacccgccugacagugcuu

SEQ ID NO: 42281 - RNA, 324 nt, Artificial Sequence
  derived and/or modified sequence opt5 from anti-HIV_LightChain
gacauccugaugacccagagccccucccuccugucugccagcgugggcgauagagucacaauuacgugcaaggcuucccaagacguuucuaccgccguggcgugguaccagcagaaaccugggaaggcuccgaaacuucugaucuauugggccagcacacggcacaccggagugcccucccgcuucacaggcucugggagcggaaccgauuuuacacucaccauuuccagacugcaggccgaggacuucgcucuuuacuauugucaacagcauuacacgaccccuuggacauuuggcgggggaaccaaggucgaaaucaaacgg

SEQ ID NO: 42282 - RNA, 324 nt, Artificial Sequence
  derived and/or modified sequence opt5 from anti-HIV_LightChain
gacaucgugaugacccagagccccucccugcucucugccagcgucggcgauagaguuacaauuacgugcaaggcuucccaagacgugucuaccgccguggcgugguaccagcagaaaccugggaaggcuccgaaacugcuuaucuauugggccagcacacggcacaccggaguccccucccgcuucucuggcagcggguccggaacagauuuuacccugacaauuagcucucuccagccugaggacuucgcccuguacuauugucaacagcauuacaccacgcccuggaccuuuggcgggggaacaaagguggaaaucaaaaga

SEQ ID NO: 42283 - RNA, 324 nt, Artificial Sequence
  derived and/or modified sequence opt5 from anti-HIV_Chain
gacauccagaugacccaaagccccuccucucugagcgccuccgugggcgauacagucacgauuaacugccagaccaauaagggguaccucaacugguaucagcagagacggggacgcgcuccuaaacugcuuauguacgacggcucuaagcugguuacaggggugccgagcagauucuccggacggcgcuggggcacccaauauaaucucacaaucgggucucugcagcccgaggauauugccaccuacuauugucagguguacgaauuuuucggaccuggcacaagacuugaccugaaacggaccgucgcggcucccagcgau

SEQ ID NO: 42284 - RNA, 333 nt, Artificial Sequence
  derived and/or modified sequence opt5 from anti-HIV_Chain
cugagcgccuacgugggcgacagagucaccaucacaugccgggcuucccagaacauuaauacguaucucaacugguaccaacagcgccccgggaaggccccuaagcugcuuaucuaugcggcuucuacccugcagagcggaguuccguccagauucucuggcagcggguccggaacagauuuuacccucacaauuucuaaucuggagaccgaagacuucgccguguacuauugucagcaaacauacagcuccgugaccuuuggccaggggacgaaacuugagacccggcgcacagucgccgcucccagcguguucaucuuuccucccucugau

SEQ ID NO: 42285 - RNA, 333 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaaggggucaacuucguugugugguaccagcagaagcgcggacaggcgccgagacugcucauuuauggcaauucugaccgggugcccggggucccugaucgcuuuagcgcuagaggauccggcaccgaguucucucuggugaucagcuccguugaacccgacgauuuugcccuuuacuauugucaagaguacagcucuacaccuuauaacuucgggcccggaacccggguggaccgcaaaagaacagucgccgcu

SEQ ID NO: 42286 - RNA, 336 nt, Artificial Sequence
  derived and/or modified sequence opt5 from anti-HIV_HeavyChain
gaggugaagcuggaagagagcggcgggggacucguccagcccggcggguccagaaaacugucuugcgccgcuagcggauucaccuuuuccucuuucggcaugcacuggguucggcaagccccugaaaaggggcuugaguggguggcguacaucagcuccggaucuagcacacugcauuaugcugacacggugaaaggccgcuuuaccauuuccagagauaacccgaagaauacacucuuccugcagaugaaacuucccagccuguguuacggccuccuggggucucggaaccugucccaccgccuccugagccagaaugacaccccuaucugccuu

SEQ ID NO: 42287 - RNA, 336 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaaggggucaacuucguugugugguaccagcagaagcgcggacaggcgccgagacugcucauuuauggccccucugaccgggcuccuggggugcccgaucgcuuuagcgccagaggauccggcaccgaguucucucuggucaucagcuccguggaaccugacgauuuugcccuuuacuauugucaagaguacagcucuacacccuauaauuucgggaccggaacacggguugaccgcaaaagaaccguggcugccccu

SEQ ID NO: 42288 - RNA, 336 nt, Artificial Sequence
  derived and/or modified sequence opt5 from anti-HIV_Chain
cagacccugagccucacaugcuccgugucuggcgggagcaucuccucugccggauacuauuggggcuggauuagacaacaccccgggaagggacuggaguggaucggccauauuuacuauagcgggaacacgaauuacaacccuucccuuaaaucucggcugagcauguccgucgaaaccagcaagaaucaguucucucucaaccuggcuuccguuacagccgcggacaccgcuguguauuuuugugcccgcgauuacagcgccgcuggaagacaccuuuucgacucuuggggccagggcauccuggugacagucuccagcgccucuaccaaaggg

SEQ ID NO: 42289 - RNA, 336 nt, Artificial Sequence
  derived and/or modified sequence opt5 from anti-HIV_LightChain
gacaucgugaugacccagcaaacaccccugacgcucagcauuaccaucggccagccugccuccauuucuugcaagagcucccagucucugcuugauagcgacgggaaaacauaccugaacuggcuccugcagagaccgggacaaucccccaagcggcuuaucuauuggaugucuaaacuggauagcggcgucccugaccgcuucaccggguccggaagcggcacagauuuuacccucaagauuucuagaguugaggcugaagaccuggggguguacuauuguuggcagggaacacacuuccccuggaccuuuggcggcgggacgaaacuggagcuc

SEQ ID NO: 42290 - RNA, 339 nt, Artificial Sequence
  derived and/or modified sequence opt5 from anti-HIV_LightChain
gacaucgugauuacccagagcacaaaguucauguccacgucugucggcgauagaguuagcauuaccugcaaagccucccaagacgugucuacagcuguggccugguaccagcagaagcccgggcagagcccuaaacugcucaucuauugggcguccacccggcacacaggagucccggaucgcuuuaccggcucugggagcggaacagacuacacccugacgaucuccagagugcaagcugaggaucuugcccuguauuacugucagcagcauuauaccacacccuggaccuucggcgggggaacaaagcucgaaauuaaacggaccguugccgcuccu

SEQ ID NO: 42291 - RNA, 339 nt, Artificial Sequence
  derived and/or modified sequence opt5 from anti-HIV_Chain
gacauccagaugacccaaagccccuccucucugagcgccagagugggcgauacagucacguuuaccugccaggcuaacggguaccucaauugguaucagcagcggcgcggaaaggccccuaaacugcuuauuuacgacggcuccaagcuggagagagggguuccgucucgguucagcggacgcagauggggccaagaauauaaccucacaaucaauaaccugcagcccgaggauauugcgaccuacuucugucagguguaugaauuugcugugccugggacacggcuugaccugaaacgcaccgucgccgcccccuccguguucaucuuuccuucugau

SEQ ID NO: 42292 - RNA, 339 nt, Artificial Sequence
  derived and/or modified sequence opt5 from anti-HIV_Chain
cagagcgugcugacccaacccgccuccgucucuggcagcccugggcaguccaucacaauuucuugcacgggaaccaacagcgacguuggcuacuccuaugugucuugguuccagcagcacccggggaaggugcccaagcuccugaucuacgaugucagcagacgguccagcggagugucuaaucgcuuuuccggcagcagaucugggaacacagcuucccuuaccauuagcggacugcgggccgaggacgaagcggauuauuacuguggcucuuucacaaccucccucacacugguuuuuggcgggggaaccaaacuugcugugcuggucagcccuucc

SEQ ID NO: 42293 - RNA, 339 nt, Artificial Sequence
  derived and/or modified sequence opt5 from anti-HIV_Chain
agccuguccgccucugugggcgacagagucaccaucacaugccgggcuagcgaguccauuucuuucuaccucaacugguaucagcaaaagcccgggaaagccccugaacugcuuaucuucgcgacgagcacccugcacuccggaguuccgucucgcuucagcggcuccgggagcggaacagauuuuacccucacaauuucuucccugcagcuugaggacuucgcuaccuacuauugucagcagucuagcuccacacccuuuaccuucggcgggggaacgaagguggaaaucaaaagaaccguggccgccccuagcgucuuuauuuuucccccuucugau

SEQ ID NO: 42294 - RNA, 342 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcagcccgaggauaucgcgaccuacuuuugucagguguaugaguucauugugccugggacaagacuugaccugaaacggaccgucgcugcccccucuguguuuaucuucccucccagcgau

SEQ ID NO: 42295 - RNA, 342 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaagagggguuccgucucgguucagcggacgcagauggggccaagaauauaaccucacaauuaauaaccugcagcccgaggauaucgcgaccuacuuuugucagguguaugaguucgcugugccugggacacggcuugaccugaaacgcaccgucgccgcccccuccguguuuauuuucccucccucugau

SEQ ID NO: 42296 - RNA, 342 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaagagggguuccgucucgguucagcggacgcagauggggccaagaauauaaccucacaauuaauaaccugcagcccgaggauaucgcgaccuacuuuugucagguguaugaguucguggucccugggacacggcuugaccugaaacgcaccguggcugcccccuccguuuuuauuuucccucccucugau

SEQ ID NO: 42297 - RNA, 342 nt, Artificial Sequence
  derived and/or modified sequence opt5 from anti-HIV_Chain
gacauccagaugacccaaagccccuccucucugagcgccagagugggcgauacagucacguuuaccugccaggcuaacggguaccucaauugguaucagcagcggcgcggaaaggccccuaaacugcuuauuuacgacggcuccaagcuggagagagggguuccgucucgguucagcggacgcagauggggccaagaauauaaccucacaaucaauaaccugcagcccgaggauauugcgaccuacuucugucagguguaugaauuugcugugccugggacacggcuugaccugaaacgcaccgucgccgcccccuccguguucaucuuuccucccucugau

SEQ ID NO: 42298 - RNA, 342 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuauguacgacggcucuacacuggaacgcgggguuccggcgagauucagcggacggcgcuggggccaagaauauaaccucaccaucaauaaccugcagcccgaggauguggcuacauacuuuugucagguguaugaguucauugucccugggaccagacuugaccugaagcggacaguggccgcccccuccguuuuuaucuucccucccucugau

SEQ ID NO: 42299 - RNA, 342 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcaggcggaggauaucgcuaccuacuucugucagguguaugaguucgccgugcccgggacaagacuugaccugaaacggaccgucgccgcuccuucuguguuuauuuuucccccuagcgau

SEQ ID NO: 42300 - RNA, 342 nt, Artificial Sequence
  derived and/or modified sequence opt5 from anti-HIV_Chain
gacauccagaugacccaaagccccuccucucugagcgccuccgugggcgauacagucacguuuaccugccaggcuaacggguaccucaauugguaucagcagagacggggaaaggccccuaaacugcuuauuuacgacggcucucgccuggagagagggguuccgagccgguucuccggacgcagauggggccaagaauauaaccucacaaucaauaaccugcagcccgaggauauugcgaccuacuucugucagguguaugaauuugcugugccugggacacggcuugaccugaagcgcaccgucgccgcccccucuguguucaucuuuccucccagcgau

SEQ ID NO: 42301 - RNA, 342 nt, Artificial Sequence
  derived and/or modified sequence opt5 from anti-HIV_Chain
gacauccagaugacccacagccccuccucucugagcgccuccgugggcgauacagucacgauuaccugccaagcuaacggguaccucaauugguaucagcagagacggggaaaggccccuaaacugcuuaucuacgacggcucuaagcuggaaacagggguuccgagccgcuucaccggaagacgguggggccaggaauauaaccucacaauuaauaaccugcaacccgaggauaucgcgaccuacuuuugucagguguaugaguucauugugccugggacacgccuugaccugaaaagaaccgucgcugcccccuccguguuuaucuucccucccucugau

SEQ ID NO: 42302 - RNA, 342 nt, Artificial Sequence
  derived and/or modified sequence opt5 from anti-HIV_Chain
gacauccagaugacccaaagccccuccucucugagcgccagagugggcgauacagucacgauuaccugccaggcuaacggguaccucaauugguaucagcagcggcgcggaaaggccccuaaacugcuuaucuacgacggcuccaagcuggaaacagggguuccgucuagauucaccggacggcgcuggggccaagaauauaaccucacaauuaauaaccugcagcccgaggauaucgcgaccuacuuuugucagguguaugaguucauugugccugggacaagacuugaccugaaacggaccgucgcugcccccagcguguuuaucuucccucccuccgau

SEQ ID NO: 42303 - RNA, 342 nt, Artificial Sequence
  derived and/or modified sequence opt5 from anti-HIV_Chain
gacauccagaugacccaaagccccuccucucugagcgccagagugggcgauacagucacguuuaccugccaggcuaacggguaccucaauugguaucagcagcggcgcggaaaggccccuaaacugcuuauuuacgacggcuccaagcuggagagagggguuccgucucgguucagcggacgcggcugggggcaagaauauaaccucacaaucaauaaccugcagcccgaggauauugcgaccuacuucugucagguguaugaauuugcugugccuggaacaagacuugaccugaaacggaccgucgccgcccccuccguguucaucuuuccucccucugau

SEQ ID NO: 42304 - RNA, 342 nt, Artificial Sequence
  derived and/or modified sequence opt5 from anti-HIV_Chain
gacauccagaugacccaaagccccuccucucugagcgccuccgugggcgauacagucacgauuaccugccaggcuaacggguaccucaauugguaucagcagagacggggaaaggccccuaaacugcuuaucuacgacggcucuaagcuggaacgcgggguuccgagcagauucuccggacggcgcuggggccaagaauauaaccucacaauuaauaaccugcagcccgaggauaucgcgaccuacuuuugucagguguaugaguucguggucccugggacaagacuugaccugaaacggaccguggcugcccccucuguuuuuauuuucccucccagcgau

SEQ ID NO: 42305 - RNA, 342 nt, Artificial Sequence
  derived and/or modified sequence opt5 from anti-HIV_Chain
agccaguccguggucacccaagagcccucucugacaguuagcccuggcgggacggugacccucacaugcggaccguccaccggcgccgugacaucuggguucuacccccacugguuucagcagaagccuggacaggcucccagagcccugaucuauagcaccuccaacaaauacucuuggaccccugcgcgguucagcggcucccuucucgggggaaaggcuguccugacacugagcgacgugcaacccgaugacgaagccgaguauuacugucuucugcuccuguauuacggcggcccuuggauuuuugggggaggcacgaaacugaccguucucgugucu

SEQ ID NO: 42306 - RNA, 345 nt, Artificial Sequence
  derived and/or modified sequence opt5 from anti-HIV_Chain
gacauccagaugacccaaagccccuccucucugagcgccuccgugggcgauaaggucacaauuacgugccagaccucugcuggguaccucaacugguaucagcagagacggggacgcgccccuaaacugcuuauguacgacggcagcagacugguuacaggggugccgucccgguucucuggacgcagauggggcacccaauauaaucucacaaucgggagccugcagcccgaggauguggcgaccuacuauugucaggucuacgaauuuuucggaccuggcacacggcuugaccugaagcgcaccguggcugcccccuccguuuuuauuuucccucccagcgau

SEQ ID NO: 42307 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccagacaaccaagggguaccucaacugguaucagcagagacggggacgcgcuccuaaacugcuuauguucgacggcucuaagcugguuacaggggugccgagcagauuuuccggacggcgcuggggcacccaauacaaucucacaaucgggucucugcagcccgaagaucuugccaccuauuacugucagguguaugaguucuuuggaccuggcacgagacuggaccucaaacggaccgucgcggcucccagcguguucauuuuuccucccuccgau

SEQ ID NO: 42308 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccagacaaacaagggguaccucaauugguaucagcagagacggggacgcgcuccuaaacugcuuaugugugacggcucuaagcugguuaccggggugccgagcagauucuccggacggcgcuggggcacacaauacaaccucaccaucgggucucugcagcccgaggauauugccacauauuacugccagguguaugaauuuuucggaccuggcaccagacuugaccugaaacggacggucgcggcucccagcguguuuaucuucccucccuccgau

SEQ ID NO: 42309 - RNA, 345 nt, Artificial Sequence
  derived and/or modified sequence opt5 from anti-HIV_Chain
gacauccagaugacccaaagccccuccucucugagcgccagagugggcgauaaggucacaauuacgugccagaccuccgcuggguaccucaacugguaucagcagcggcgcggcagagccccuaaacugcuuauguacgacggaucucggcugguuacaggggugccgagccgcuucuccggaagacgguggggcacccaauauaaucucacaaucgggucucugcagcccgaggauauugcgaccuacuauugucagguguacgaauuuuucggaccuggcacacgccuugaccugaagagaaccgucgcugcccccagcguguuuaucuucccucccuccgau

SEQ ID NO: 42310 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccagacaaacaagggguaccucaauugguaucagcagaaaagaggacgggcuccuaagcugcuuauguacgacggcucuaaacugguuaccggggugccgagccgccucuccggaagacgguggggcacacaauauaaccugaccaucgggucucuucagcccgaagauauugccacauacuauugucagguguacgaguucuuuggaccuggcacccgccuggaccucaagagaacggucgcggcucccagcguguucaucuuuccucccuccgau

SEQ ID NO: 42311 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccagacaaacaagggguaccucaauugguaucagcagagacggggacgcgcuccuaaacugcuuauguacgacggcucuaagcugguuaccggggugccgagcagacucuccggacggcgcuggggcacacaauauaaccugaccaucgggucucuucagcccgaagauauugccacauacuauugucagguguacgaguucuuuggaccuggcaccagacuggaccucaaacggacggucgcggcucccagcguguucaucuuuccucccuccgau

SEQ ID NO: 42312 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccacacaaacaagggguaccucaauugguaucagcagagacggggacgcgcuccuaaacugcuuauguucgacggcucuaagcugguuaccggggugccgagcagauuuuccggacggcgcuggggcacacaguacaaccucaccaucgggucucugcaacccgaggauauugccacauauuacugucagguguaugaagucuucggaccuggcaccagacuugaccugaaacggacgguggcggcucccagcguuuuuaucuucccucccuccgau

SEQ ID NO: 42313 - RNA, 345 nt, Artificial Sequence
  derived and/or modified sequence opt5 from anti-HIV_Chain
gacauccagaugacccaaagccccuccucucugagcgccuccgugggcgauacagucacgauuaacugccagaccaauaagggguaccucaacugguaucagcagagacggggacgcgcuccuaaacugcuuauguacgacggcucuaagcugguuacaggggugccgagcagauucuccggacggcgcuggggcacccaauauaaucucacaaucgggucucugcagcccgaggauauugccaccuacuauugucagguguacgaauuuuucggaccuggcacaagacuugaccugaaacggaccgucgcggcucccagcguguuuaucuucccucccuccgau

SEQ ID NO: 42314 - RNA, 345 nt, Artificial Sequence
  derived and/or modified sequence opt5 from anti-HIV_Chain
gacauccagaugacccaaagccccuccucucugagcgccagagugggcgauaaggucacaauuacguaccagaccuccgcuggguaucucaacugguaccagcagcggcgcggcagagccccuaaacugcuuauguaugacggaucucggcugguuacaggggcgccgagccgcuucuccggaagacgguggggcacccaauacaaucucacaaucgggucucugcagcccgaggauauugcuaccuauuacugccagguguaugaauuuuucggaccuggcacacgccuugaccugaagagaaccguggccgcccccagcgucuuuaucuucccucccuccgau

SEQ ID NO: 42315 - RNA, 345 nt, Artificial Sequence
  derived and/or modified sequence opt5 from anti-HIV_Chain
gacauccagaugacccaaagccccuccucucugagcgccuccgugggcgauacagucacgauuaccugccagacaaacaagggguaccucaauugguaucagcagagacggggacgcgcuccuaaacugcuuauguacgacggcucuaagcugguuaccggggugccgagcagauucuccggacggcgcuggggcacacaauauaaccucaccaucgggucucugcagcccgaggauauugccacauacuauugucagguguacgaauuuuucggaccuggcaccagacuugaccugaaacggacggucgcggcucccagcguguuuaucuucccucccuccgau

SEQ ID NO: 42316 - RNA, 345 nt, Artificial Sequence
  derived and/or modified sequence opt5 from anti-HIV_Chain
gugacccugagccucucccccggcgagagagccacacugucuugccgggcuagccagacgaucuccaacaauuaccuugccugguaucaacagaagccugggcaggcgccgcgccugcucauuuacggagcuucuagcggcgccaccgggcugcccgacagauucuccggaucuggcagcgggacagauuuuacccuuacaaucucccggcuggaaccugaggacuucgccgucuauuacugucaccaguaugcucucagccccuggaccuuuggacgcggcacaaaaguugaaauuaagagaaccguggccgcuccuucuguguucaucuuucccccuuccgau

SEQ ID NO: 42317 - RNA, 345 nt, Artificial Sequence
  derived and/or modified sequence opt5 from anti-HIV_Chain
acccugagcgccuccgugggcgacagagucacaaucacgugccgggcuucucagagcauuaacaauuaccucaacugguaucaacagaagcccgggaaagccccuaagcugcuuaucuacgcggcuuccucucugcagagcggaguuccgucccgcuucucuggcagcggguccggaaccgauuuuacacucaccauuagcucucugcagcccgaggacuucgugacauauuacugucaacagaccuauuccaauccuagaauguuuggccaggggacaaaaguggaaaucaagcggaccgucgccgcccccagcguguucauuuuuccucccucugaugagcag

SEQ ID NO: 42318 - RNA, 345 nt, Artificial Sequence
  derived and/or modified sequence opt5 from anti-HIV_Chain
cagagcgcccugacccaagcucccuccgccucuggcacaccugggcagagagugacgaucagcugcuccggaggcgggucuaacauuggaggcaaucucgucagcugguaccagcacuucccgggggcggcucccaagcugcuuaucuaucggaacgaccagcgcccuuccggaguucccgauagauuuucugccagcaaauccggcaccagcgccucucuggcuauuuccggccuccggagcgacgaugaggccacauacuucugugcugccuaugacucuacccugucccuucgccuguuugggggaggcacaacccucgcggugcugagccaaccuaaggcc

SEQ ID NO: 42319 - RNA, 345 nt, Artificial Sequence
  derived and/or modified sequence opt5 from anti-HIV_Chain
aagcccagccagacccugucccucacaugcacggugucuggcgggagcaucuccucugccggauacuauuggaccuggauuagacaccauccuggcaaagggcuggaguucaucggauacauuuaucacaucggcacaccguacuauaaccccagccuuaagucccggcugaccauuucuaucgacacaagcaaaaaucaauuuucccucaagcugagcucugucaccgcugccgauacagcgaucuacuauugugcucgcgacuacaccgccagagggcggcauuucuuugauuacuggggacagggcgcccuuguuacgguguccagcgcuucuaccaaaggc

SEQ ID NO: 42320 - RNA, 345 nt, Artificial Sequence
  derived and/or modified sequence opt5 from anti-HIV_Chain
cccagcgagacccugucccucacaugcagagugucuggcgccagcaucuccaacuucuacuggacguggauucggcagccugcugggaagggacuggaauggaucggccgccuuuauucuagcgacaaaaccaauuacaacccgucccugaaugggagagucacaaugucucucgauaccagcaagaaccaauuuucccugcggcuuacaagcaugaccgacgccgauacagcgauuuauuacugugcucgcgagaaaggacaguggguuacccugcccccuuauuacuucgacucuuggggccaggggauccucgugacgguguccagcgccucuaccaaggga

SEQ ID NO: 42321 - RNA, 348 nt, Artificial Sequence
  derived and/or modified sequence opt5 from anti-HIV_Chain
ggccccgccacccugagcguguccccuggggagagagcuacacucucuugccgggccagccagucccugcgcaacaaucuugcgugguaccaacagaagacgggacagucuccgagacugcucaucuaugcugucagcacccgggccacaggcauucccccucgcuucuccgggggaggcucugggaccgaauuuacacugaccaucgacagccuucaguccgaggauuucgccguuuacuuuugucaacaguaugacagcccccaguggacauucggacagggcaccaaaguggaaauuaagagaacgguggcugccccuucugucuuuaucuucccucccuccgau

SEQ ID NO: 42322 - RNA, 348 nt, Artificial Sequence
  derived and/or modified sequence opt5 from anti-HIV_Chain
gcccccgugacccugagcgcuuccgucggcgacacaguuacgauuaccugcagagccucucagccuaucgcgacauuccucaacugguaccaacacaagccggggcaggcucccaaacugcuuaucuaugccgccagcaccuuucagcggggagcuccuucccgcuacucuggcagcggguccggaacagauuucacccugacaauuaauucucuccagcccgaggaccuggccaccuauuacugucaacagacguuuaccgauccugugacauucggccaggggaccagacuugaaaucaagcggacaguggcugcccccagcgucuuuauuuucccuccguccgac

SEQ ID NO: 42323 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggggauggcucgccugguaccaccagcgcccuggcaaggcgccgagacugcuuaucuaucgggggucccgccugcucggaggcguccccucuagauucagcggguccgcugccggaacagacuuuacccugacaauugccaaccuucaggcugaggauuucggcaccuuuuacugucaacaguaugacacauacccuggcaccuucgggcagggaacgaaaguugaagugaagcggaccguggccgcucccagcgucuuu

SEQ ID NO: 42324 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggaacugggucgccugguaccagcagcgcccuggaaaggcgccgagacuccugaucuaucggggcgcugcccuucucgggggaguucccucccgcuucucuggcagcgccgcugggacagacuuuacccugacaauuggaaaucugcaaaccgaggauuucggcacauuuuacugucagcaguaugacaccuacccuggcacguucgggcagggaaccaaaguggaagugaagagaacagucgccgcucccuccguguuu

SEQ ID NO: 42325 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggaacugggucgccugguaccagcagcgcccuggaaaggcgccgagacuccugaucuaucggggcgcugcccuucucgggggaguucccucccgcuucagaggcucugccgcugggacagacuuuacccugacaauuggaaaucugcaagccgaggauuucggcaccuuuuacugucagcaguaugacacauacccuggcaccuucgggcagggaacgaaaguggaagugaagcggaccgucgcugcccccagcguguuu

SEQ ID NO: 42326 - RNA, 351 nt, Artificial Sequence
  derived and/or modified sequence opt5 from anti-HIV_LightChain
gacauccagaugacccaaagccccuccacacugucugccagcgugggcgauacggucagaauuuccugccgggcuucucagagcaucaccgggggauggcucgccugguaccaccagcgcccuggcaaggcgccgagacugcuuauuuaucgggggucccgccugcucggaggcguucccucuagauucagcggguccgcugccggaacagacuuuacccugacaaucgccaaccuucaggcugaggauuucggcaccuuuuacugucaacaguaugacacauacccuggcaccuucgggcagggaacgaaaguggaagugaagcggaccgucgccgcucccagcguguuu

SEQ ID NO: 42327 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggaacugggucgccugguaccagcagcgcccuggaaaggcgccgagacuccugaucuaucggggcgcugcccuucucgggggaguucccucccgcuucucuggcagcgccgcugggacagacuuuacccugacaauuggaaaucugcaagccgaggauuucggcaccuuuuacugucagcaguaugacacauacccuggcaccuucgggcagggaacgaaaguggaagugaagagaaccgucgcugcccccuccguguuu

SEQ ID NO: 42328 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggggaugggucgccugguaccaccagcgcccuggcaaggcgccgagacuccugaucuaucgggggucccgccuucugggaggcguucccucuagauucagcggguccgcugccggaacagacuuuacccucacaauuggcaaccugcaggccgaggauuucggcaccuuuuacugucaacaguaugacacauacccugggaccuucggacagggcacgaaaguggaagugaagcggaccgucgcugcccccagcguguuu

SEQ ID NO: 42329 - RNA, 351 nt, Artificial Sequence
  derived and/or modified sequence opt5 from anti-HIV_LightChain
gacauccagaugacccaaagccccuccacacugucugccagcgugggcgauacggucagaauuuccugccgggcuucucagagcaucaccgggggauggcucgccugguaccaccagcgcccuggcaaggcgccgagacugcuuauuuaucgggggucccgccugcucggaggcguucccucuagauucagcggguccgcugccggaacaggcuuuacccugacaaucgccaaccuucaggcugaggacuucggcaccuuuuacugucaacaguaugauacauacccugggaccuucggacagggcacgaaaguggaagugaagcggaccgucgccgcucccagcguguuu

SEQ ID NO: 42330 - RNA, 351 nt, Artificial Sequence
  derived and/or modified sequence opt5 from anti-HIV_LightChain
gacauccagaugacccaaagccccuccacacugucugccagcgugggcgggacggucagaauuuccugccgggcuucucagagcaucaccggaggcuggcucgccugguaccaccagcgcccugggaaggcgccgagacugcuuauuuaucggggaucccgccugcucggcgggguucccucuagauucagcggauccgcugccggcacagauuuuacccugacaaucgccaaccuucaggcugaggacuucggcaccuuuuacugucaacaguaugauacauacccugggaccuucggacagggcacgaaaguggaagugaagcggaccgucgccgcucccagcguguuu

SEQ ID NO: 42331 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggaacugggucgccugguaccaccagcgcccuggaaaggcgccgagacuccugaucuaucggggcgcugcccuucucgggggaguucccucccgcuucucuggcagcgccgcugggacagacuuuacccugacaauuggaaaucugcaggccgaggauuucggcaccuuuuacugucaacaguaugacacauacccuggcaccuucgggcagggaacgaaaguggaagugaagagaaccgucgcugcccccuccguguuu

SEQ ID NO: 42332 - RNA, 351 nt, Artificial Sequence
  derived and/or modified sequence opt5 from anti-HIV_LightChain
gacauccagaugacccaaagccccuccacacugucugccagcauuggcgauacggugaugaucuccugcagagcuucucagagcauuaccgggggauggcucgccugguaccaccagcggccuggcaaggcgccgcgccugcuuaucuauagaggguccaaacugcucggaggcguccccucucgguucagcggguccgcugccggaacaggcuuuacccugacaauuggcaaccuucaggccgaggacuucgggaccuuuuacugucaacaguaugauacauacccuggaaccuucggccaggggacgaagguugaagugaaacgcaccguggcugcccccagcgucuuu

SEQ ID NO: 42333 - RNA, 351 nt, Artificial Sequence
  derived and/or modified sequence opt5 from anti-HIV_LightChain
gacauccagaugacccaaagccccuccacacugucugccagcgugggcgauacggucagaauuuccugccgggcuucucagagcaucaccgggggauggcucgccugguaccaccagcgcccuggcaaggcgccgagacugcuuauuuaucgggggucccgccugcucggaggcguucccucuagauucagcggguccgcugccggagccgacuuuacacugaccaucgcuaaccuucaggccgaggauuucggcacauuuuacugucaacaguaugacaccuacccuggcacauucgggcagggaaccaaaguggaagugaagcggacggucgcugcccccagcguguuu

SEQ ID NO: 42334 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggggauggcucgccugguaccaccagcgcccuggcaaggcgccgagacugcuuaucuaucgggggucccgccuggucggaggcguucccucuagauucagcggguccgcugccggaacagacuuuacccucacaauuggcaaccugcaggccgaggauuucggcaccuuuuacugucaacaguaugacacauacccugggaccuucggacagggcacgaaaguggaagugaagcggaccgucgcugcccccagcguguuu

SEQ ID NO: 42335 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggggauggcucgccugguaccaccagcgcccuggcaaggcgccgagacugcuuaucuaucgggggucccgccugcucggaggcguccccucuaaauucagcggguccgcugccggaacagacuuuacccugacaauugccaaccuucaggcugaggauuucggcaccuuuuacugucaacaguaugacacauacccuggcaccuucgggcagggaacgaagguugaagugaaaagaaccguggccgcucccagcgucuuu

SEQ ID NO: 42336 - RNA, 351 nt, Artificial Sequence
  derived and/or modified sequence opt5 from anti-HIV_LightChain
gacauccagaugacccaaagccccuccacacugucugccagcacgggcgauaccgugagaauuuccugccgggcuucucagagcaucacagggaacugggucgccugguaccagcagcgcccuggaaaggcgccgagacuccugauuuaucggggcgcugcccuucucgggggaguucccucccgcuucagaggcucugccgcugggaccgacuuuacacugaccaucggaaaucugcaagccgaggauuucggcacauuuuacugucagcaguaugacaccuacccuggcacguucgggcagggaaccaaaguggaagugaagcggacagucgcugcccccagcguguuu

SEQ ID NO: 42337 - RNA, 351 nt, Artificial Sequence
  derived and/or modified sequence opt5 from anti-HIV_LightChain
gacauccagaugacccaaagccccuccacacugucugccagcauuggcgauacggugagaaucuccugccgggcuucucagagcauuaccgggaacuggcucgccugguaccaccagcgcccuggaaaggcgccgagacugcuuaucuaucggggcucccgccugcucgggggaguccccucuagauucagcggcuccgcugccgggacagacuuuacccugacaauugccaaucuucaggcugaggauuucggaaccuuuuacugucaacaguaugacacauacccuggcaccuucggccaggggacgaaaguugaagugaagcggaccguggccgcucccagcgucuuu

SEQ ID NO: 42338 - RNA, 351 nt, Artificial Sequence
  derived and/or modified sequence opt5 from anti-HIV_Chain
aucauucuguuccucguggccaccgcuacaggcagcugggcccaguccgcgcugacgcaacccagaucugucagcgggucccuuggacagucuguuaccaucagcugcacaggcuccucuagcgacguggggcgguacaacuauguguccugguaccagcaccauccuggaaaggcuccgaaacugaugauuagcgaugucaauaagcgccccucuggcgugccugacagauuuuccgggagcaaaucuggaaacaccgccucccucacaaucagcggccugcaggccgaggaugaaaccgacuauuacuguugcucuuaugcuggcuccuacauuuggguuuucggggga

SEQ ID NO: 42339 - RNA, 351 nt, Artificial Sequence
  derived and/or modified sequence opt5 from anti-HIV_Chain
cccgugacccugagcgccuccgucggcgacagaguuacaaucacgugccgggcuucugaggauauuagcaaguaccucaacugguaucagcacaaaccugggaaggccccgaaacugcuuaucuacaccgcguccucucuggaaacaggagugcccagccgcuucuccggcucugggagcggaaccgacuuuucccucacaauuagcucucugcaaccugaugacuucgcuaccuauuacugucagcaguccuauacaagcucugugaccuuuggccaggggacgagagucgaggugaagcggaccguugccgcccccuccguguucaucuuuccucccagcgaugaacaa

SEQ ID NO: 42340 - RNA, 351 nt, Artificial Sequence
  derived and/or modified sequence opt5 from anti-HIV_Chain
guggaggaacccggcagcuccgucaagguuucuugcaaagccagcgggggauccucuaccgcuuacggcuauagcugggugagacaggccccugggcaaggauucgaguggaugggccggaucauuccguuuuacgggaucauuacauaugcgcccaaguuccagggacgcgugacgaucaccgcugacagauccacaucuaccgucuacauggaacugacacggcucaccuuugccgauacagcccuguucuuuugugcucgcgacuauggcgauccuagaaacggcuacuauuucgacagcugggaucaggggcuuuggcugaccguguccagcgccucuacgaaagga

SEQ ID NO: 42341 - RNA, 351 nt, Artificial Sequence
  derived and/or modified sequence opt5 from anti-HIV_Chain
caggugagacuggagcaaagcggcgccgcuguccggacccccggggccuccguuacacucucuugccaggcgagcggauacaaguucgugaacuauaucauucacugggugcgccagagaccuggccuggcuuuugaaugggucgggaugaucgacccguaccggggacgccccugguccgcccauucuuucgagggcagacuuagccugucccgggaugugucuauggaaauucucuauaugacgcugaccagccuucgcuccgacgauacagccaccuacuuuugugcuagagccgaggcugaaagccagucucacucccggccuaucauuagcacaucuggggcccgc

SEQ ID NO: 42342 - RNA, 351 nt, Artificial Sequence
  derived and/or modified sequence opt5 from anti-HIV_Chain
gugcaccuggagguccagcuccaacagagcggccccgaacugaagaaaccuggggagaccguuaagaucuccugcaaagccucuguguacacauucacggaauauccgauucauugggugaagcaggcucccggaaaaggcuuuaaguggaugggguggaucaacaccuacagcggagagccuacauaugccgacgauuucaagggcagauuugcguucucccuugaaaccucugcuagcacagccuaccugcagauuaauucccucaaaaacgaggacaccgccacauauuuuugugcuucucuggggcgggauuacuggggacaaggccagggcaccacgcuuaccguc

SEQ ID NO: 42343 - RNA, 354 nt, Artificial Sequence
  derived and/or modified sequence opt5 from anti-HIV_Chain
cugagcgugucccucggcgagagagccaccaucaacugcaagucuagccaguccauucuguacucuagcgacaaaaagaauuaucuugcuugguaccaacagaaaaucgggcagcccccuaagcugcuccuguauugggccuccacacgggaaucuggcauuccggaucgcuucagcggauccgggagcggaucugacuuuacgcuuaccaucuccagccugcagcccgaggaugucgcgguuuacuauugucaacaguacuauauuucuccuuucacauuuggccccgggaccaaaguggaccucaagagaacaguggcugccccuuccgucuucaucuuucccccuagcgau

SEQ ID NO: 42344 - RNA, 354 nt, Artificial Sequence
  derived and/or modified sequence opt5 from anti-HIV_Chain
cagagcgugcugacccaacccccuuccgccucuggcgcuccggggcagagagucacaaucagcugcuccggaggccccucuaacguugggggaaauuacguguauugguaccggcaguucccuggcacggcccccaagcuccugauucuucgcgacgaucagagaccuagcggggugcccgaccgguuuuccgcgucuaaaagcggaaacuccgcuagccuggccaucucuggccuccgcccugaugacgaggccuucuauuuuugugcuaccuacgauuccgacggcagcauuagacuguucgggggaggcacagcccuuaccguccugucucaaccgaaggcugcccccucc

SEQ ID NO: 42345 - RNA, 354 nt, Artificial Sequence
  derived and/or modified sequence opt5 from anti-HIV_Chain
aaggcccccgcuacccugagccucuccccuggcgagagagccacacugucuugccgggcgagccaguccguggggucugaccuugcuugguaccaacagaaaccgggacaggcuccccgccugcucaucuaugaugccagcaacagagccacggccauuccugcucgguucuccggcucugggagcggaaccgacuucacacuguccaucagcucucuugaacccgaggauuucgccgucuacuuuugucagcaacgcuaugacaagauuaccuucggccaggggacaagacuggaaauccagcggaccguugcggccccuuccguguuuauuuuucccccuagcgaugagcag

SEQ ID NO: 42346 - RNA, 354 nt, Artificial Sequence
  derived and/or modified sequence opt5 from anti-HIV_Chain
caggugcaacugguccagagcggcgccgaggcuaagagacccggggacuccguuaaagugucuugcaaggccagcggauacaccuucacagaauauuacauccacugggugcggcagacgccuggccagggguuugaguggaugggaauuaucaccccgggcgcggggaacacaaccuaugcucaaaaauuccagggacgcauuacagucaccagagauacauccgccgccaccguguacauggaacucucuaaucugacgagcgaggacaccgcuguuuauuuuuguucccggggcgugucuuucuggggccaggggacacuugucaccgugagcuccgccagcacaaaggga

SEQ ID NO: 42347 - RNA, 354 nt, Artificial Sequence
  derived and/or modified sequence opt5 from anti-HIV_HeavyChain
gaggugaagcugcagcaaagcggcgccgaacucgucagacccggggcuuccguuaaaaugucuugcaaggccagcggauaccgguucaccuccuauaacaugcacugggugaaacagacaccucgccagggccuggaguggaucggggcgauuuacccgggaaauggcgacacgucuuauaaccagaaguuuaaagggaaggcuacccuuacaguggauaagagcuccucuaccgccuacaugcaacugagcucccucacaagcgaagacucugccgucuauuucugugcuagaggacggcugucccuuggcuuugauuacuggggccaggggagcacccugacagugucuucc

SEQ ID NO: 42348 - RNA, 357 nt, Artificial Sequence
  derived and/or modified sequence opt5 from anti-HIV_Chain
caggugcaacugguccagagcggcaccgccguuaagagacccggggcuuccgugcgggugucuugccaggccagcggauacacauucaucgaccacuuuauuuauugguggcgccaggcgccuggccaagggcucgaguggcugggauggaucaacccgcuuacgucccagcccucuuacccuagcagauuccagggccggcugacccucacacgcgauaccuuugacgaaaugcuguauauggaucuuagagggcugcgguccgacgauacaggaauuuacuucugugcucgcagacauucugacuauugcgauuuugacaucuggggcagcggcacccagauuaucgucuccagc

SEQ ID NO: 42349 - RNA, 357 nt, Artificial Sequence
  derived and/or modified sequence opt5 from anti-HIV_Chain
caggugcaacugguccagagcggcaccgccguuaagagacccggggcuuccgugcgggugucuugccaggccagcggauacacauucacggacuauuuuaucuacugguggcgccaggcgccuggccaagggcucgaguggcugggauggauuaacccgcuuaccucccagcccucuuauccuagcagauuccagggccggcugacacucacccgcgauacauuugacgaaaugcuguacauggaucuuagagggcugcgguccgacgauaccggaaucuauuucugugcucgcagacacucugacuacugcgauuuugacauuuggggcagcggcacacagaucauugucuccagc

SEQ ID NO: 42350 - RNA, 357 nt, Artificial Sequence
  derived and/or modified sequence opt5 from anti-HIV_Chain
cagagcgugcugacccaacccagauccgucucuggcagcccugggcaguccguuacaaucucuugcacgggaaccagcuccgacgugggcggguacaacuaugugucuugguaccagcagcacccgggaaaggcccccaaaacaaugauuuucgaugucaccaagcggccuagcggcgugcccgaccgcuuuuccgggagcaaaucuggaaauacagcuucccucaccaucagcggccugcaagccgaggaugaagcggacuauuacuguucuuccuaugcuggcagaaacacauucuacguuuuugggaccggaacgaccgugacaguccaggugagcccuucucagcccccuccg

SEQ ID NO: 42351 - RNA, 357 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucugucagcuccaacuaccuggccugguaucagcagaagccgggacaggcgccccgccuccugauuuacggcgcuucuagcagagccaccgggaucccugaccgguucuccggaagcggcucugggacagauuuuacccuuuccauuagccgccuggagcccgaagacuucgccguuuauuacugucaacaguauggaacaucuuccugcaccuuuggccagggcacaaaacucgagaucaagagaaccguggcugccccuagcguguucauuuuu

SEQ ID NO: 42352 - RNA, 357 nt, Artificial Sequence
  derived and/or modified sequence opt5 from anti-HIV_Chain
cugagcgccuccgugggcgacagagucaccaucacaugccgggcuucucagagcauugaucgcuaccucaacugguaucaacagaagcccgggaaagccccuaagcugcuuaucuacgcggcuuccucucugcacacggacguuccgagcagauucuccggaucuggcgccgggaccuauuuuacacucaccauuacaagccugcagcccgaggauuucgccaccuacuauugucagcaaucccauagcccuucuuuuggacaggaauccuacagcaucacauucggccaggggacccggcuugagauuaaacgcacgguggcugcccccucuguguuuaucuucccucccuccgac

SEQ ID NO: 42353 - RNA, 357 nt, Artificial Sequence
  derived and/or modified sequence opt5 from anti-HIV_Chain
aacuucaugcugacccaggcccccagcgcuuccggcgccccugggcaaagagugacaaucucuugcagcggaggcccguccaaugucgggggaaacuacguuuauugguaccggcaguaucccggcacggcgccuaagcuccugauucuucgcgacgaucagagacccucuggggugccugaccgguuuagcgcuuccaaaucuggaaauagcgccucccuggccaucagcgaacuccgccccgaugacgaggcuuucuacuuuugugccaccuaugauucugacggcuccauuagacuguucggcgggggaacagcucuuaccgugcugagccagccuaaggccgcgccgucuguc

SEQ ID NO: 42354 - RNA, 360 nt, Artificial Sequence
  derived and/or modified sequence opt5 from anti-HIV_Chain
gacauccagaugacccaaagccccuccucucugagcgccuccauuggcgauagagugaacaucacaugccaggcuucucgggacacggggagcgcccucaauugguaccagcagaaggucggacgcccuccgagacugcuuauuuccgcgguuucuaaccugggcgcuggggugcccagccgguucuccggacgcagaagcggcacccaaucuacacucaccaucaauacacugcagccugaggauauugccaccuauuuuugucagcacuacgaguucuuugggcccggaacaaaaguggacaucaagcggaccgucgccgcuccuuccguguucaucuuucccccuagcgaugaacag

SEQ ID NO: 42355 - RNA, 360 nt, Artificial Sequence
  derived and/or modified sequence opt5 from anti-HIV_Chain
cagagcgugcugacccaacccgccuccgucucuggcagcccugggcaguccaucacaauuucuugcacgggaaccagcaacgacguuggcgggcagaauuucguguccugguaccagcaacacccgggaacagcuccccagcuccugaucuaugaugugaccaacagaccugccggcgucucuagccgguuuuccgggagcaagucuggaaauacagcgucccuuaccauuagcggccugcgcacagaggacgaagcugauuacuauugugccucuuucaccauccucaacggcguggacuacguuuuugggacgggaaccaaagugacaguccugcuuucccccagccagccuuaucug

SEQ ID NO: 42356 - RNA, 360 nt, Artificial Sequence
  derived and/or modified sequence opt5 from anti-HIV_Chain
aacuucaugcugacccagcccgccagcguguccggcucuccugggcaaagcaucacacucuccugcacgggaaccacaucugacgucagagauagcaauuuuguuuccugguaccaacaggugccgggcaaggcucccaaacugauuaucuaugacgugucugcccggccuagcggggucuccuuccgcuuuagcggaucuaaguccggcaacaccgcgagccuuacaauuucugggcugcaggcugaggaugaagcccucuacuauuguuccagcuucacccccacaaauacccugguguuuggaggcggcacgaaacuuaccguucuggggcagccuaaggccgcucccucugugaca

SEQ ID NO: 42357 - RNA, 360 nt, Artificial Sequence
  derived and/or modified sequence opt5 from anti-HIV_Chain
cagagcgcccugacccaacccccugcugccuccggcgcgccggggcagagagugacaaucucuugcagcggaggcggguccaacgucggaggcaaucucguuucuugguaccagcaguuccccggggcugccccuaagcugauucuucaccgggacggacaacgccccagcggcgugccugauagauuuuccgccucuaaaagcggcacguccgcuagccugaccaucucugggcuccgguccgacgaugaggccacauauuucugugcugccuacgacagcgcggugucucugcccgucuuuggaggcgggaccaaacuuacagugcugucccagccuaaggccgcuccgcucguuacc

SEQ ID NO: 42358 - RNA, 360 nt, Artificial Sequence
  derived and/or modified sequence opt5 from anti-HIV_Chain
cagcuggugcucacccaacccccuagcgucuccggcacaccggggcagaacguuacgaucucuugcagcggaggcgggucccacgugggaggcaaucuggugucuugguaccagcauuuccccggggccgcuccuaaacuucugauucacagagacaaccagcggcccagcggagucccugaucgcuuuuccgcccucaagucuggcaauagcgcgucccuggcuaucagcggccuuagaucugacgaugaggccuucuauuuuugugccguguacgacuccagccugucucucgggcuguucggaggcgggaccaagcugacaguucucucccaacccaaagcugccccuagcgugacc

SEQ ID NO: 42359 - RNA, 360 nt, Artificial Sequence
  derived and/or modified sequence opt5 from anti-HIV_Chain
gacauccagaugacccaaagccccuccucucugagcgccuccgugggcgauagagucucuauucacugccaggcugggcagggaaucggcagcucccucaagugguaccagcaaaaaucugggcgggccccucgccugcuuguucauggagcgagcaaccugcagagaggcgugccgucccgguucagcgggucuggauuucacacaacguucacccucacaauuuccagccugcagcccgacgauguggcuaccuauuggugugccguccuugaguuuuucggcccuggcacaaagguggaaaucaaacgcaccguugccgcucccucuguguuuauuuucccucccuccgacgagcag

SEQ ID NO: 42360 - RNA, 360 nt, Artificial Sequence
  derived and/or modified sequence opt5 from anti-HIV_Chain
gacauccagaugacccaaagccccuccucucugagcgccuccgugggcgauagagucacaauuacgugccaggcuucucaggggaucggaagcucccuccagugguaccaacagaagccuggccgggccccgaaacugcuuguucacggggcgucuaaccugcaucgcggagugcccagcagauucuccggcagcggguuucacaccucuuucacacucaccauuuccagccugcagccugacgauguggcuacauauuuuugugccguccuugaguucuuuggacccggcaccaagguggaaaucaaacggacaguugccgcuccuucuguguucauuuuucccccuuccgacgagcag

SEQ ID NO: 42361 - RNA, 360 nt, Artificial Sequence
  derived and/or modified sequence opt5 from anti-HIV_Chain
gacauccagaugacccaaagccccuccucucugagcgccuccgugggcgauagagucucuauuaacugccaggcugggcagggaaucggcagcucccucaauugguaccagcaaaagcgggggaaagccccuaagcugcuuguucacggagcgucuacacugcagcgcggcgugccgagcagauucuccgggagcggauuucauacgaccuucacacucaccauuucuucccugcagcccgacgauguggcuacauauuuuugugagagcuuccagugguuuggcccuggcaccaaagucgaaaucaagcggacaguggccgcccccucuguuuucauuuuuccucccuccgacgagcaa

SEQ ID NO: 42362 - RNA, 360 nt, Artificial Sequence
  derived and/or modified sequence opt5 from anti-HIV_Chain
uacauccagaugacccaaagccccuccucucugagcgccuccauuggcgacagagugacaaucacgugccaggcugggcagggaauuggcucuagccucaacugguaucagcaaaagccugggaaagccccgaagcugcuuguccacggagcguccaaucugcagcggggcguuucuagccgcuucuccgggagcggauuucauaccacauucacccucacaaucucuucccugagacccgaggaugugggcaccuacuuuugugaaguguaugaguucauuggcccugggacaaaagucgacaucaagcggaccguggcugcccccagcguuuuuaucuucccucccucugaugaacag

SEQ ID NO: 42363 - RNA, 360 nt, Artificial Sequence
  derived and/or modified sequence opt5 from anti-HIV_Chain
gacauccagaugacccaaagccccuccucucugccugccagcgugggcgauacagucacgauuaccugccaggcugggcagggaaucggcuccucucuccagugguaccaacagagaccggggcgggcccccaaccugcuuguuuaugacgcgagcaaucugcagcgcggagugccuuccagauucacaggcaccggguuucacacaaccuucacacucaccauucggggacugcgccccgaggauuuuggcacguacuucugugcuucucuugaauuuuucggcccugggaccaagguggacaucaaaagaacagucgccgcccccagcguguuuauuuucccuccguccgaugagcag

SEQ ID NO: 42364 - RNA, 360 nt, Artificial Sequence
  derived and/or modified sequence opt5 from anti-HIV_Chain
gacauccagaugacccaaagccccuccucucugagcgccuccgugggcgauagagucacaauuacgugccaggcuucucaggggaucggaagcucccuccagugguaccaacagaagccuggccgggccccgaaccugcuuguucacggggcgucuaaucugcaucgcggagugcccagcagauucuccggcagcggguuucacaccacauucucucucaccauuuccggacugcagcgggacgauuuugcuacauauuucugugccgugcuugaguuuuucggcccuggcaccaaagucgacaucaagcgcacaguggccgcucccagcguuuuuauuuucccucccucugaugaacag

SEQ ID NO: 42365 - RNA, 360 nt, Artificial Sequence
  derived and/or modified sequence opt5 from anti-HIV_Chain
gacauccagaugacccaaagccccuccucucugagcguguccgucggcgauagaguuucuauuacaugccgggccacgcaggggaucggaaacagccucaauugguaccagcagaagccuggcaaagcuccgaaggugcugauuuaugggaccacaaaacuucacggaggcgugcccucccgcuucucugggggaggcagcggcuccaccgggacacugaccaucgacagccuccaaccugaggauauugccacauacuucugucagcuguucgaauuuuucggacccggcaccaaggucgagaucaaaagaacgguggcggcuccuucuguuuuuaucuuucccccuuccgacgaacag

SEQ ID NO: 42366 - RNA, 360 nt, Artificial Sequence
  derived and/or modified sequence opt5 from anti-HIV_Chain
gacauccagaugacccaaagccccuccucucugagcgccuccgugggcgauagagucacaauuacgugccaggcugggcagggaaucggcucuagccucaacugguaccagcaaaagccugggcgggccccgaaacugcuuguuuauggagcguccaaucugcagcgcggcgugcccucuagauucagcggguccggauuucacaccacauucacccucacaauuagcucucugcagccugaggacuuugcuaccuacuucuguuccguguaugaauuucuuggccccggcacaaaggucgagaucaaacggaccguggccgccccuagcguuuucauuuuucccccuucugaugaacag

SEQ ID NO: 42367 - RNA, 360 nt, Artificial Sequence
  derived and/or modified sequence opt5 from anti-HIV_Chain
cccauguuccagccuggccaaagcgggggaguggucguucaguccggcgagucucugcaccucagcugcgaagccuccggguuuaaguucgcuucucagaugaugcauugggugagacacgugccgggacggggccuggagugggucgcccuuaucagcugggacggguccggaaaacuguuugcggauucugugcgcggcagauucaccauucaucgguggaacgaccgcaauagccucuaccuggauguuaagaacgugagacccgaagacgcugccaucuauuacuguacacggaauggcuuugaugucugggggcagggcauucuugugacgguuuccagcgccucuaccaaagga

SEQ ID NO: 42368 - RNA, 363 nt, Artificial Sequence
  derived and/or modified sequence opt5 from anti-HIV_HeavyChain
gaggugaagcuggucgaaagcggcgggggacucguucagcccggcgggucccugagacuuucuugcgccgcuagcggauucaccuuuuccucuuucggcaugcacugggugcggcaagccccugagaaagggcuggaauggguggcguacaucagcuccggaucuagcacacuccauuaugcugacacggucaagggccgcuuuaccauuuccagagauaacagcaaaaauucucuguaccuucagaugaaccugcuccgggccgaggacacagccguguauuacugugcucgcggcuccagaaaucugagccaccggcugcucucuuauugggggcagggaacccugguuacaguguccagc

SEQ ID NO: 42369 - RNA, 363 nt, Artificial Sequence
  derived and/or modified sequence opt5 from anti-HIV_HeavyChain
gaggugcagcuggucgaaagcggcgggggacucguucaacccggcgggucccugagacuuucuugcgccgcuagcggauucaccuuuuccucuuucggcaugcacugggugcggcaggccccugggaagggacuggagugggugagcuacaucuccucuggcagcuccacacuccauuaugcggacacggucaagggccgcuuuaccauuagcagagauaacucuaaaaauucccuguaccuucagaugaacagccugcgggcugaagacacagccguguauuacugugcccgcgggucuagaaaucucucccaccggcugcugagcuauuggggacagggcacccucguuacagugucuucc

SEQ ID NO: 42370 - RNA, 363 nt, Artificial Sequence
  derived and/or modified sequence opt5 from anti-HIV_Chain
gacauccagaugacccaaagccccuccucucugagcgccuccgugggcgauagagucacaauuacgugccaggcuucucaggggaucagcaacucccucaauugguaccagcaaaagccuggaaaagccccgcggcugcuuauuuauggcaccucuacacugcagcgcgggguucccagcagauucuccggaagcggcucugggacccgguuuacagugaccaucaacucccuccagccugaggacauugcgacauacuucugucagcacaaugaauuuuucggacgcggcaccaagguggauaucaaaagaacggucgcugcccccagcguguuuaucuucccucccucugacgagcaacug

SEQ ID NO: 42371 - RNA, 363 nt, Artificial Sequence
  derived and/or modified sequence opt5 from anti-HIV_Chain
gacauccagaugacccaaagccccuccucugugagcgccuccgucggcgauagaguuacaauuacgugccaggcuucucgggacaccgauaacagccugacaugguaccagcagaagccugggcgcccgcccaaacuccugaucuaucacguggugaaucuuggaccuggcguccccuccagauucucugggagcgccuccagcgcgacccaaucuacacugauuaucuccgacuuucagccugaugacguggcuaccuacuucugucagaacuaugaguuuuucggacccggcacaaagguugaaauuaaacggaccguggccgccccuagcgucuuuaucuucccgcccucugaugagcag

SEQ ID NO: 42372 - RNA, 363 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucugucagcuccaacaaucuggccugguaccagcagaagccgggacaggcgccccgccuccugaugucuggcgcuagcuccagagccaccgggauuccugaccgguucagcggaucuggcuccgggacagauuuuacccuuacaaucagccgccuggagcccgaagacuucgccguuuaucacugucaacaguacggaucuuccccucccaccuuuggccagggcacaaaaguggagauuaagagaaccguggcugccccuagcgucuucaucuuuccgccc

SEQ ID NO: 42373 - RNA, 363 nt, Artificial Sequence
  derived and/or modified sequence opt5 from anti-HIV_Chain
gacauccagaugacccaaagccccuccucucugagcgccuacgugggcgauagagucacaauuacgugccgggcuucccagaacaucaauaccuaucucaacugguaccagcagcgcccugggaaggccccgaaacugcuuauuuaugcggcuucuacacugcaaagcggaguucccuccagauucucuggcagcggguccggaaccgacuuuacacucaccaucagcaaucuggagacagaagauuucgccguguacuauugucagcagaccuaccggucugugacguuuggccaggggaccaaacuugagauuaagcgcacagucgccgcuccuuccguguucaucuuucccccuagcgac

SEQ ID NO: 42374 - RNA, 363 nt, Artificial Sequence
  derived and/or modified sequence opt5 from anti-HIV_Chain
gacauccagaugacccaaagccccuccucucugagcgccuccgugggcgauagagucacaauuacgugccaggcugggcagggaaucggcucuagccuccagugguaccaacagaagccugggaaagccccgaagcugcuuguucacggagcguccaaccugcaucggggcgugcccucucgcuucagcggguccggauuucacaccacauucagccucaccauuucuggccugcagagagacgauuuugcuacauauuucugugccguggucgaguuuuucggcccugggaccaaaguggacaucaagcggacaguugccgcucccuccguguuuauuuucccucccagcgaugaacagcuu

SEQ ID NO: 42375 - RNA, 363 nt, Artificial Sequence
  derived and/or modified sequence opt5 from anti-HIV_Chain
caggugcaacuggucgagagcggcgccgaacucagaaagcccggggagucccuggaaaucucuugcaaagcuagcggauacuccuucucuagccacuggauuggcugggcccggcagaugccugggaagggacuugaguggaugggcaucauuuauccgggggacuccaacaccaucuacucucccagcuuucagggacagguuacaauuuccgcggauaaaagcaucaauacggcuuaucugcaauggucuucccucaaggccagcgacaccgccauguacuucugugcuucuaacuaucaugauuacuuuuauuggggccagggcacacuggugaccguguccagcgccucuacaaaaggg

SEQ ID NO: 42376 - RNA, 363 nt, Artificial Sequence
  derived and/or modified sequence opt5 from anti-HIV_Chain
uucgugcagcuggucgagagcggcgggggaguugugcaacccggcaccucccucagacugucuugcacaacgagcggguuuaucuucuccgacuacggaaugcacugggugcggcaggccgcuggcaaggggcuugaaugggucgccgugauuuggcaugauggaucuaaccgcuuuuaugcggacagcguuaaaggcagauucaccaucucccgggauaauucuaagaacgcuguguaccuggagaugaauaaccuccgcgucgaagacacagcccuguauuacugugccagaaccagcauggauauugacuauuggggccaggggacaccugugaccguuuccagcgcuucuacaaaagga

SEQ ID NO: 42377 - RNA, 363 nt, Artificial Sequence
  derived and/or modified sequence opt5 from anti-HIV_Chain
gagcccauguuccagccuggccaaagcgggggaguggucguucaguccggcgaaucucugcaccucagcugcgaggccuccggguuuaaguucgcuucucagaugaugcauugggugagacacgugccgggacggggccuggaaugggucgcccuuaucagcugggacggguccggaaaacuguuugcggauucugugcgcggcagauucaccauucaucgguggaacgaccgcaauagccucuaccuggauguuaagaacgugagacccgaggacgcugccaucuauuacuguacacggaauggcuuugaugucugggggcagggcauucuugugacgguuuccagcgccucuaccaaagga

SEQ ID NO: 42378 - RNA, 366 nt, Artificial Sequence
  derived and/or modified sequence opt5 from anti-HIV_Chain
agccagcaccuggugcaauccggcacccaggucaagaaacccggggccucuguuagaaucagcugccaggcuuccggauacucuuucacagacuaugugcuccauugguggcggcaggccccuggccaagggcuggaguggaugggauggauuaagccgguguacggcgcgcgcaacuaugcuagacgguuucaggggcgcaucaauuucgauagagacauuuaccgggaaaucgccuuuauggaucuuagcggacugcgcuccgacgauacggcccucuauuucugugcuagagacggcucuggcgaugacaccagcuggcaccuggaucccugggggcagggaacacuugucauuguguccgcc

SEQ ID NO: 42379 - RNA, 366 nt, Artificial Sequence
  derived and/or modified sequence opt5 from anti-HIV_Chain
gacauccagaugacccaaagccccuccucucugagcgccuccgugggcgauagagucacaauuacgugccgggcuucucagagcaucucccgcuaccucaacugguaucagcagaagccugggaaagccccgaagcugcuuauuuacgcggcuucuagccugcaaggaggcguucccuccagauucagcgggucuggauccggcaccgacuucacacucaccaucagcucucugcagccugaggauuucgccacauauuacugucagcaguccagcucuaaacccuuuaccuucgggggaggcacaaagguggaaauuaaacggaccguggccgcuccuuccgucuuuaucuuucccccuagcgac

SEQ ID NO: 42380 - RNA, 366 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucuauuagcuccaacuaccuggccugguaucagcagaagccgggacaggcgccccgccuccugaucuacggcgcuucuaccagagccacagggauuccugaccgguucagcggauccggcagcgggaccgauuucacacuuucuaucucccgccuggagcccgaagacauugccgucuauuacugucaccaauauggaagcucucagagauucggccagggcaccaaaguugagaucaagcggacaguggcugccccuuccguguuuaucuuucccccuagcgau

SEQ ID NO: 42381 - RNA, 366 nt, Artificial Sequence
  derived and/or modified sequence opt5 from anti-HIV_Chain
gagaucgugaugacccagagccccgccacacuguccgucucuccuggcgacagagcuacgcucagcugccgggccucccaaucuguuagcaccaaccuggcgugguaccagcagaagccggggcaggcuccccgccuucugauuuauggagccuccacaagagccaccggcaucccugcuacauucucugggagcggauuugccaccgaguucacacucaccauuuccagccugcaaucugaagauuuugcuguguacuauugucagcaguacaauaacuggcccccugccuucggccaggggacgaaaguggaaaucaagcggaccgucgcggcccccuccguguuuauuuucccuccgagcgac

SEQ ID NO: 42382 - RNA, 366 nt, Artificial Sequence
  derived and/or modified sequence opt5 from anti-HIV_Chain
gacauccagaugacccaaagccccgccucccugucugcuagcgugggcgauagagucacaauuacgugccgggccucccaggggaucucucacuaccucgcgugguaucagcagaagccuggaaaaguuccgcgccugcuuauuuacgcugccagcagacugcaauccggcgugaccucucgguucagcggguccggaagcggcacagaguuuacccucacaaucucuucccugcuucccgaagacgccgcuguguauuucugucagaaguacgauaccgacccuaugacauuugggcagggaacccgccuggagauuaaaagaacggucgccgcucccagcguguucaucuuuccucccucugau

SEQ ID NO: 42383 - RNA, 366 nt, Artificial Sequence
  derived and/or modified sequence opt5 from anti-HIV_Chain
cagagcgcccugacccaacccccuuccgcuucuggcgccccggggcagagagugacaaucagcugcuccggaggccccucuaacgucgggggaaauuacguuuauugguaccggcaguucccuggcacggcgcccaaccuccugauucuucgcgacgaucagagaccuagcggggugcccgaccgguuuuccgcuucuaagagcggaaauuccgccagccuggccaucucuggccuccgcccugaugacgaggcuuucuauuuuugugccaccuacgauuccgacggcagcauuagacuguucgggggaggcacaacccuuacagugcugucucaaccgaaagcugcccccuccgucacccucuuu

SEQ ID NO: 42384 - RNA, 366 nt, Artificial Sequence
  derived and/or modified sequence opt5 from anti-HIV_Chain
gacauccagaugacccaaagccccuccucucugagcgccuccgugggcgauagagucacaauuaacugccaggcugggcagggaaucggcucuagccucaauugguaccagaagaaaccugggcgggccccgaagcugcuuguucacggagcguccaaccugcaacgcggcgugcccucuagauucagcggguccggauuucauacgaccuucacacucaccauuagcucucugcagccugacgauguggcuacauauuuuugugccgucuuccagugguuuggccccggcaccaaaguggacaucaagcggacaguugccgcuccuuccguguucauuuuucccccuagcgaugagcagcuuaaa

SEQ ID NO: 42385 - RNA, 366 nt, Artificial Sequence
  derived and/or modified sequence opt5 from anti-HIV_Chain
gacauccagaugacccaaagccccuccucucugagcgccuccgugggcgauagagucacaauuacgugccaggcuucucaggggaucggaagcucccuccagugguaccaacagaagccuggccgggccccgaaccugcuuguucacggggcgucuaaacugcaucgcggagugcccagcagauucuccggcagcggguuucacaccacauucucucucaccauuuccggacugcagcgggacgauuuugcuacauauuucugugccgugcuugaguuuuucggcccuggcaccaaggucgaaaucaaacgcacaguggccgcucccagcguuuuuauuuucccucccucugacgagcagcugaag

SEQ ID NO: 42386 - RNA, 366 nt, Artificial Sequence
  derived and/or modified sequence opt5 from anti-HIV_Chain
caggugcaccugguccaaagcggcgccgagguuaagaaacccggggcuuccgugaaggugucuugcaaagucagcggauacacccucuccgaacugucuauccauugggugagacagggcccugggcggggacuugaguggauggccaacuucgacccggaagauggcgagacaauuuaugcgccccaguuucaggggcgcguuacgcugaccgaagacacaagcaccgauacagcuuacaugcaacucaccucccugagaucugaggacacagccguguauuacugugccaccgaucgguauacggacaccggacgcuggggcccuggcacacuugucaccgugagcuccgcuagcacaaagggg

SEQ ID NO: 42387 - RNA, 366 nt, Artificial Sequence
  derived and/or modified sequence opt5 from anti-HIV_Chain
caggugcaacuggucgagagcggcgggggacucauccagcccggcgggucccugagacuuucuugcgaagccagcggauucgcuguuggcgacauuaacuacauguccugggugcggcaggccccugggaagggacuggagugggugucuguccucuauagcggcggcuccucucaguacgcggauagcgugaaagggcgcuuuaccaucuccagagacaauagccggaacacacuguaucuucaaauggauaaucugcgcgcugaagacacggccguuuacuauugugccagaggacuccggguguacuucgaucuguggggccaggggauucuggucaccgugucuuccgcuagcacaaaggga

SEQ ID NO: 42388 - RNA, 366 nt, Artificial Sequence
  derived and/or modified sequence opt5 from anti-HIV_Chain
caggugcaaauggucgccagcggcgggggacugguuaagcccggcgggucccucagacugucuugcgaggcuagcggauucaccuuuuccgacuacuauaugucuugggugcggcaggccccuggcaaagggcuugaauggaucagcuacauuacauccggaggcaacgcgcuguauuacgcugauucugugaagggccgcuucacgaucagcagagacaaugccaaaaacucccucuaucugcagaugaauagccuucgggccgaggauaccgcugucuacuauugugcccgcgaccugcuccacgcucaugauuuugggagacagggaacacuggugaccguuucuuccgccagcacaaagggc

SEQ ID NO: 42389 - RNA, 366 nt, Artificial Sequence
  derived and/or modified sequence opt5 from anti-HIV_Chain
cagcugcaacucguggagagcggcgggggagucguucagcccggcagaucccugcggcuuucuugcgccgcuagcggguucaccuuuuccacauacacgaugcacugggugcgccaggccccuggaaagggccuggaauggguggcggucaucucuuaugacgggaccaacaaauacuaugcugauagcgugaagggaagauucacaauuucccgggacaauucuaaaaacacccucuaccugcagaugaauagccuucgcggcgaggauacagccguuuauuacugugccagauccccgagcuauuacuuugacuacuggggccaagggacccuggugacagucucugcugccuccaccaaggga

SEQ ID NO: 42390 - RNA, 369 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagagucagccugacgcggcaggccuccugggauuucgacaccuauucuuuuuacauggaucuuaaagccgugcgcagcgacgauacagcuauuuauuucugugccagacaacgguccgacuuuugggauuucgacguuuggggaagcggcacccaggugacagucucuucc

SEQ ID NO: 42391 - RNA, 369 nt, Artificial Sequence
  derived and/or modified sequence opt5 from anti-HIV_Chain
caggugcaacugcuccagagcggcgccgucguuaccaagcccggggcuuccgugagagugucuugcgaggccagcggauacaaaauccgggacuauuucauucacugguggcgccaggcgccuggccaggggcugcaaugggucggauggaucaacccgcagacaggccagcccaauauuccuagacccuuucaggggcgggugacgcuuacccgccaugcuuccugggauuucgacacauuuucuuucuacauggaucugaaggcccucagaagcgacgauaccgccaucuauuuuugugcucggcgcagauccgacuacugcgauuucgacguuuggggaucuggcacacacgugaccgucagcucc

SEQ ID NO: 42392 - RNA, 369 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaagggacucagauccgacgauacagccauuuauuuuugugcucggcaacgcucugacuacugggauuucgacguguggggcagcggcacccagguuacaguguccagc

SEQ ID NO: 42393 - RNA, 369 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacuuuuucaggggcgggucucccugacgcgccaugccucuugggauuucgacaccuuuagcuucuacauggaucucaaggccgugagauccgacgauacagcuguuuauuuuugugcccggcagcgcucugacuacugggauuucgacguguggggaagcggcacccaagucacaguguccagc

SEQ ID NO: 42394 - RNA, 369 nt, Artificial Sequence
  derived and/or modified sequence opt5 from anti-HIV_Chain
caggugagacugcuccaaagcggcgccgcugucaccaagcccggggccuccguucgggugucuugcgaggcgagcggauacgaaauccgcgacuauuucauucacugguggagacaggcuccuggccaggggcugcagugggugggauggaucaacccgaaaacaggccaacccaauaacccucggcaguuucaggggcgcgucucccuuacgagacaggccucuugggauuucgacagcuacuccuuuuauauggaucugaaggcccuccggucugacgauaccggaguguacuucugugcucgccaaagaagcgacuauugggauuuugacguuuggggcuccggcacacaggugaccgucagcucu

SEQ ID NO: 42395 - RNA, 369 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaaggcccucagauccgacgauacagcuguguauuuuugugcccggcaacgcucugacuacugggauuucgacguuuggggaagcggcacccaggugacagucuccagc

SEQ ID NO: 42396 - RNA, 369 nt, Artificial Sequence
  derived and/or modified sequence opt5 from anti-HIV_Chain
gaggugcagcuggucgaaagcggcgggggacucauccaaagaggcgggucccugcggcuuucuugcguugccagcggauuccccguguccgacaaccacaugucuugggugcgccaggcuccuggcaaggggcuggagugggucagcauuaucuacuccgauggaggcaccuauuacgccgacucugugaaaggcagauuuacaauuagccgggauaauuccaagaacacgguuuaucuccagaugaauagccugcgcgcgaccgacacagcuguguacuauugugccagagauccgggguuccauuacggacuugacgucuggggccaggggaccacagugaccguuucuuccgccagcacaaaagga

SEQ ID NO: 42397 - RNA, 369 nt, Artificial Sequence
  derived and/or modified sequence opt5 from anti-HIV_Chain
caggugcaacugcaggagagcggccccgggcuccugagaccucuugaaacccugucccucacaugcucugucagcggaggcuccauccggggguacuucuggucuuggguucgccagccggccggaagaggccuggaguggauugggcggaucuauagcuccggaacgacccgcuuuaaccccucucuuaagagcagagugcggcuguccauugacacagcuaaaagcgaagugucucucaauaucaccuccgucacagccgcggauagcgcuucuuacuucugugccggcaccuccccugugcacggcgggcuggaccuguggggacucggccugcgcguuacagugagcucugccuccaccaagggg

SEQ ID NO: 42398 - RNA, 369 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucugucagcuccaaccuggccugguacgcgcagaagccgggacaggcuccccgccucauuaucuauggcgccucuagcagagccuccgcuauuccugaccgguuccgcgggagcggaucuggcaccgauuuuacacugaccaucuccagacuugagcccgaagacuucgccguuuacuauugucagcaauacgaugacgcuccuauuacauuugggcacggaacccggcuggagaucaaacgcacaguggccgcgcccagcguguucaucuuuccuccgucugaugaa

SEQ ID NO: 42399 - RNA, 369 nt, Artificial Sequence
  derived and/or modified sequence opt5 from anti-HIV_Chain
gagaucgugcugacccagagccccggcacacucucccugucuccuggggacagagccgcucuuagcugccgggccuccgaaacgcugucuggaaacagccucgcgugguaccaacagaagcgcggccagccgcccagacugcuuauuuucgcugccuccucucgggccaccgggaucccugagcgcuuuagcggaggcggguccggaacagauuucacccugacaauuaccagacucgaacccgaggacuuugcugucuauuucugucagcaauacguugaugccccuaucacauuuggccagggcacccggcuggaaauuaaacgcacgguggcugcccccagcguguucaucuuuccuccgucugac

SEQ ID NO: 42400 - RNA, 369 nt, Artificial Sequence
  derived and/or modified sequence opt5 from anti-HIV_Chain
gacauccagaugacccaaagccccuccucucugagcgccuccgugggcgauagagucacaauuacgugccgggcuucucaggacaucaccacauaccucgccuggcugcagcagaagccugggaaagcgcccaagagccuuauuuauuccgcuucuaccguucaaagcggagugccgucccgcuucagcggcucuggguccggaacagaguuuacccugacaaucagcggccuccagccugaagauuucgccaccuacuauugucagcaguacaacuauuaccccauuacguuugggcugggaaccagacuugagaucaaacggacaguggccgcuccuucugucuucaucuuucccccuuccgacgaa

SEQ ID NO: 42401 - RNA, 369 nt, Artificial Sequence
  derived and/or modified sequence opt5 from anti-HIV_Chain
gacauccagaugacccaaagccccuccucucugagcgccuccauuggcgauagagugacaaucacgugccgggcuaaccagcacauucgcucuuuccucaauugguaccagcagaccccugggaaggccccgaaacugcuuaucuaugcggcuagcacacugcaaagaggaguccccucccgguuuucuggcagcggguccggaaccgacuucacacucaccauuacaagccuggagcgcgaagaucuugccaccuacuauugucagcagacguacaccucuccuaucacauuuggccaggggaccagacuggagaucaagcggacaguugccgcucccuccguguucauuuuuccucccagcgacgaa

SEQ ID NO: 42402 - RNA, 369 nt, Artificial Sequence
  derived and/or modified sequence opt5 from anti-HIV_Chain
agcgagaucgugcugacccagucccccgccacacucucucugagcccuggcgaauccgcuacgcuuucuugcagagccagccaaucccugucuagcucccucgcgugguaccagcagaagccggggcaggcuccccggcugcuuauuuaugacaccagcgaucgcgccacaggaaucccugccagauucucuggccggggguccggaaccgacuuuacacugaccauuagcucucucgagcccgaagauuucgcugucuacuauugucaacagcgcuccaacugggccaucacauuuggccaggggaccagacuggagauuaaacggacgguugcugccccuagcguguucaucuuucccccuucugac

SEQ ID NO: 42403 - RNA, 369 nt, Artificial Sequence
  derived and/or modified sequence opt5 from anti-HIV_Chain
caggugcugagcgucuccggcacccccgggcaaagaguuaucauuucuugcagcggaacauccucuaacgugggcgggaaucucgugagcugguaccagcaucugccuggagccgcuccgcggcuucugauccaccgcgacgaucagagacccuccggcgucccugaccgguucucugggagcaaguccggaaacagcgccucucucgugauuuccggccugcgcagcgaugacgaggcggauuauuuuugugcugccuacgacucuacguucucccuucccguuuuuggcgggggaaccagacugacagugcucagccagccuaaagccgcucccucugucacccuguaugccccuuccagcgaagag

SEQ ID NO: 42404 - RNA, 369 nt, Artificial Sequence
  derived and/or modified sequence opt5 from anti-HIV_Chain
gacauccagaugacccaaagccccuccucucugagcgccuccgugggcgauagagucacaauuacgugccaggcugggcagggaaucggcucuagccuccagugguaccaacagaagccugggaaagccccgaagcugcuuguucacggagcguccaaccugcaucggggcgugcccucucgcuucagcggguccggauuucacaccacauucagccucaccauuucuggccugcagagagacgauuuugcuacauauuucugugccgugcuugaguuuuucggcccugggaccaaagucgaaaucaagcggacaguggccgcucccuccguuuuuauuuucccucccagcgacgagcagcugaaaucu

SEQ ID NO: 42405 - RNA, 369 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaagggcugaacuucgucguuugguaccagcagaagcgcggacaggcgccgagacuccugauucacgcucccucugaccgggccccuggcgugcccgaucgcuucagcgccagaggguccggaaccgacuucucucuugugaucagcuccgucgagccugaugacuuugcuauuuauuacugucaagaauauagcucuacacccuacaauuucggcccugggacccggguggaucgcaaaagaacaguugccgcuccguccguguuuaucuuucccccuagcgacgagcag

SEQ ID NO: 42406 - RNA, 369 nt, Artificial Sequence
  derived and/or modified sequence opt5 from anti-HIV_Chain
gagaucgugcugacccagagccccacaacgcucucccugucuccuggcgaaagagccacccuuagcugccgggcuucccaaggggucaaccugguugugugguaccagcagaagcgcggacaggccccgagacuccugauuuauggccccucugaccgggcgccuggggugcccgaucgcuucagcgcuagaggauccggcacagaguuuucucuugucaucagcuccguggaaccugacgauuucgcccuguacuauugucaagaguacagcucuacccccuauaauuuugggacaggaacccggguugaccgcaaaagaacaguggccgcuccuuccgucuucauuuuuccgcccagcgaugaacag

SEQ ID NO: 42407 - RNA, 369 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaaggggucaacuucguugugugguaccagcagaagcgcggacaggcgccgagacugcucauuuauggccccucuaaucgggcuccuggggugcccgaccgcuucagcgccagaggauccggcaccgaguucucucuggucaucagcuccguggaaccugaugacuuugcccuuuacuauugucaagaguacagcucuacacccuauaacuucgggccuggaacccggguugaucgcaaaagaacaguggcugccccguccgucuuuauuuuucccccuagcgacgaacag

SEQ ID NO: 42408 - RNA, 369 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaagggcugaacuucgucguuugguaccagcagaagcgcggacaggcgccgagacuccugauucacggccccucucaucgggcuccuggggugcccgaccgcuucagcgccagaggauccggcaccgaguucucucuugugaucagcuccgucgaaccugaugacuuugccauuuauuacugucaagaguauagcucuacacccuacaauuucgggccuggaacccggguggaucgcaaaagaacaguugcugccccguccguguuuaucuuucccccuagcgacgaacag

SEQ ID NO: 42409 - RNA, 369 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaagggcugaacuucgucguuugguaccagcagaagggaggccaggcgccgcgccuccugauucacgggcccaccgacagagcuccuggagugcccgaucgguucucugcccgcggcagcgggacagaguucucccuugugaucucuagcgucgaaccugacgauuuugcccuguauuacugucaagaguauuccagcacccccuacaauuucggaccuggcacaagaguggaccggaaacgcaccguugcugccccgucuguguuuauuuuucccccuuccgaugaacag

SEQ ID NO: 42410 - RNA, 369 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaagggcugaacuucgucguuugguaccagcagaagcgcggacaggcgccgagacuccugauucacgcucccucuggccgggccccuggggugcccgaccgcuucagcgccagaggauccggcaccgaguucucucuugugaucagcuccgucgaaccugaugacuuugcuauuuauuacugucaagaguauagcucuacacccuacaauuucgggccuggaacccggguggaucgcaaaagaacaguugccgcuccguccguguuuaucuuucccccuagcgacgaacag

SEQ ID NO: 42411 - RNA, 369 nt, Artificial Sequence
  derived and/or modified sequence opt5 from anti-HIV_Chain
caggugcaacugguccagagcggcgccgagguuaagaaacccggguccucugugaaggugagcugcaaaaccuccggaggcucuuucagcaacuacgcuuuuuccugggucagacaggccccuggggaaggacucgaguggaugggccggaucauuccgaucuucgggacagcgaaguauacgcagaaacugcaaggacgcgugaccauuacagcugacaaguuuaccucuacaguuuacauggaacuuagcucccugagaagcgaggauaccgccaucuauuacugugccucucuccaccagggccccauuggcuauacaccuuggcaucccccuccccgggcuccucuggggcaguccgugugcgga

SEQ ID NO: 42412 - RNA, 369 nt, Artificial Sequence
  derived and/or modified sequence opt5 from anti-HIV_Chain
caggugcaacuggucgagagcggcgggggacucguucagcccggcgggucccugagaaucucuugcagcgccaccggauucacauuuuccacgcacgcuaugcauugggugcggcaggccccuggcaaggggcuugaauacgugucugcgauuaacagcaauggacgcuccgcuuucuaugccgacucugucaaaggcagagugaccaucagccgggauaacuccaagaauacacuguuucuccagaugaccagccugcgcgccgaggacacagcuguuuacuauugugugaaaggcccgcuucugagauaccucgauucuugggggcaaggaacccuggucacaguguccagcgccucuaccaagggc

SEQ ID NO: 42413 - RNA, 369 nt, Artificial Sequence
  derived and/or modified sequence opt5 from anti-HIV_Chain
gaggugcagcuggucgaaagcggcgggggacucguucaacccggcgggucccugagaaucucuugcagcgccaccggauucacauuuuccacgcacgcuaugcauugggugcggcaggccccuggcaaggggcuugaguacgugucugcgauuaacagcaauggacgcuccgcuuucuaugccgacucugucaaaggcagagugaccaucagccgggauaacuccaagaauacacuguuucuccagaugaccagccugcgcgccgaagacacagcuguuuacuauugugugaaaggcccgcuucugagauaccucgauucuugggggcagggaacccuggucacaguguccagcgccucuaccaagggc

SEQ ID NO: 42414 - RNA, 369 nt, Artificial Sequence
  derived and/or modified sequence opt5 from anti-HIV_Chain
gaggaaagcggccccgggcuggugaagccuucccagacccucucucugacaugcagcgucuccggagacucuguuagcuccggcggguacuucuggucuuggaucagacaacacccgacgaaaggacuugagugucugggcuauguguacuauaccgggaacacauacuauaaucccagccucaaguccccucccaccauugaaguggccauggcuaacaaucaggucagccugaaacuuggaucugugacagccgcggauaccgcuguuuacuauugcgcccggaucaagcgcuuuagaggcggcaacuacuucgacacaugggggcauggacugcucgugaccgucuccagcgccucuacgaaaggc

SEQ ID NO: 42415 - RNA, 369 nt, Artificial Sequence
  derived and/or modified sequence opt5 from anti-HIV_Chain
caggugcaacugcaggagagcggcuccgggcucgucaagcccucuggaacccugagccuuacaugcgccguuuccaacggcccuaucucuagcgggaauuggugguccugggugagacagacgccggaaaaaggacuggaguggauuggcgaaguguaccacucugggagcaccaaccauaaucccucccucaagagccgggcuacaauccuggucgacaaaucuaagaaccaguucucccuuaaucugcgcagcgugaccgccgcggauacagcuguuuauuacugugccagagugcggggaucuuggaacuuugacuauuggggccaaggcauucucgucaccguguccagcgccucuacaaaaggg

SEQ ID NO: 42416 - RNA, 369 nt, Artificial Sequence
  derived and/or modified sequence opt5 from anti-HIV_HeavyChain
gaggugcagcugcaacagagcggcaccguccucgccagacccggggcuuccguuaagaugucuugcaaggccagcggauacacauucacguccuauuggaugcacugggugaagcagcggccuggccaggggcuggaauggaucggagcgauuuacccgggcaacucugacaccagcuauaaucaaaaauuuaaggggaaagcuaaacuuacagccgugaccuccgccucuacagcuuacauggagcugagcucccucaccaacgaagauagcgccgucuauuacuguacacgcuggccccauuauuacggaggcucuagauacuauuucgacuacuggggccaggggaccacgcugaccguguccagc

SEQ ID NO: 42417 - RNA, 372 nt, Artificial Sequence
  derived and/or modified sequence opt5 from anti-HIV_Chain
gugguccagcugguugagagcggcgggggacucgugcaacccggcgggucccugagacuuucuugcgccgcuagcggauucgccuuucgguccuacuggaugucuugggugcgccaggcgccuggcagagggcuggaaugggucgcuaauaucaagcaggacggaagcgagaaauauuacgccgauuccgugaagggccgguucaccauuucucgcgacaauacgaaaaacagccucuaucugcagaugaacucccuuagagccgaagauacagcuguguuuuacugugccagccggggcgaccgcuaugggccgaucgauuacuggggacaaggcacccugguuacagucucuuccgcuagcaccaagggg

SEQ ID NO: 42418 - RNA, 372 nt, Artificial Sequence
  derived and/or modified sequence opt5 from anti-HIV_Chain
caggugcaacugguccagagcggcgccgagaucaagaaacccggggaaucccucaagauuucuugcaaagcuagcggauacaccuucaacgacuauuggaucggcuggguuagacagaugccugggaagggacuggaguggaugggcaucuuuuacccggaugacuccgauucuaauuauagccccuccuuccaggggcgggugacaauuucugccgacaaaagcauuacgaccgcguaccuucaaugguccacacugaaggcuagcgauucugccauguauuuuugugcccgccuccugggagacuccggcgcuuucgauaucuggggccaggggaccauggugaucgucagcucugccuccacaaaggga

SEQ ID NO: 42419 - RNA, 372 nt, Artificial Sequence
  derived and/or modified sequence opt5 from anti-HIV_Chain
caggugcaacugguccagagcggcgggggacucguuaagcccggcgggucccugagacuuucuugcgccgcuagcggauucaccuuuuccucuuacagcaugaacugggugcggcaggccccuggcaaagggcuggaguggguguccucuaucagcuccucuagcuccuauauuuacuaugcggacagcgucaagggacgcuucacaaucucuagagauaaugcuaaaaacucccucuaccugcagaugaauagccuucgggccgaagacacggccguguauuacugugcucgcgagggcucuuauuacuacggcauggauguuugggggcaaggaaccacagugaccgucuccagcgccuccacaaagggc

SEQ ID NO: 42420 - RNA, 372 nt, Artificial Sequence
  derived and/or modified sequence opt5 from anti-HIV_Chain
gagaucgugcugacccagagccccgccacacucuccgucucuccuggcgaaagagcuacgcugagcugccgggccgggcaauccguuucuagcgaccuugcgugguaccagcacaagccgggacaggcuccccgccugcucauuuaugaugccuccaaaagagccaccggcaucccugcucgguucucugggagcggauccggcacagacuuuacccugacaauuagcucucuugagcccgaagauuucgccguguacuauugucagcaucgcaccaacuggccucccuccaucacauuugggcaaggaaccagacuggagauuaagcggacgguggcugccccuagcgucuucaucuuuccgcccucugac

SEQ ID NO: 42421 - RNA, 372 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucugucagcucccgcuaccuggccugguaucagcagaagccgggacaggcgcccagacucauuaucuacgacgcuucuagccgggccuccggcauuccugaucgcuucagcgggucuggauccgagaccgacuuuacacugaccaucacaagacuugaacccgaggauuucgccguuuauuacugucaacuguauggcaccagcccuaaauuuacauucgggcagggaaccaagcucgaaauuaaacggacgguggcugcccccucuguguuuaucuucccuccguccgac

SEQ ID NO: 42422 - RNA, 372 nt, Artificial Sequence
  derived and/or modified sequence opt5 from anti-HIV_Chain
gagaucgugcugacccagagccccggcacacucucccugucuccuggggaaagagccacgcuuagcugccgggcuucccaaucugucagcaacaauuaccuggccugguaucagcagaagccgggacaggcgccccgccuccugauuuacggcgcuuccucuagagccaccgggaucccugaccgguucagcggauccggcagcgggacagauuuuacccuuacaauuucucgccuggagcccgaagacuucgccguuuauuacugucaacaguaugcuaccuccagccucuacacauuuggacagggcaccaaacuggagaucaagagaacgguggccgcuccuucuguguucauuuuucccccuuccgau

SEQ ID NO: 42423 - RNA, 372 nt, Artificial Sequence
  derived and/or modified sequence opt5 from anti-HIV_Chain
cccgccacccuggcugugagcccuggcgagagagccacaaucuccugcaagucuagccagaaccuccuguacuccgcgaauaaccaacacucucuugcuugguaucagcagcggccggggcagcccccuaaacugcuccuguacugggccagcacgcgccuuuccggaguccccgacagauucucuggcagcggguccggaaccgauuucacacugaccauuagcaaucuccaagccgaagacguugcuguguauuacugucagcaguauuacucuccucccccuacauucggccaggggaccaagguggagauccggcgcacagucgccgcuccguccguguuuauuuuucccccuagcgaugaacaacug

SEQ ID NO: 42424 - RNA, 372 nt, Artificial Sequence
  derived and/or modified sequence opt5 from anti-HIV_Chain
cagcccgugcugacccaaccuccgagcgccuccggcgcucccgggcagagagucacaaucucuugcagcggaggcccuuccaacguugggggaaauuacguguauugguaccggcaguuccccggcacggccccuaaccuccugauucuucgcgacgaucagagacccucuggggugccugaccgguuuagcgcguccaagucuggaaauagcgcuucccuggccaucaccggccuccgcccggaugacgaggccuucuauuuuugugcuacauacgauagcgacggcucuauuagacuguucgggggaggcaccgcccuuacaguccugucccaacccaaagcugccccuagcgugacccucuuucccccu

SEQ ID NO: 42425 - RNA, 372 nt, Artificial Sequence
  derived and/or modified sequence opt5 from anti-HIV_Chain
aacuucaugcugacccagcccccuagcgccuccggcgcuccggggcaaagagugacaaucucuugcagcggaggccccuccaaugucgggggaaacuacguuuauugguaccggcaguuuccuggcacggcccccaaucuccugauucuucgcgacgaucagagaccuucuggggugcccgaccgguucagcgcguccaagucuggaaacagcgcuucccuggccaucagcggccuccgcccugaugacgaggccuuuuauuucugugcuaccuacgauucugacggcuccauuagacuguuugggggaggcacaacccuuacagugcugagccagccgaaagccgcucccucugucacccucuucccuccc

SEQ ID NO: 42426 - RNA, 372 nt, Artificial Sequence
  derived and/or modified sequence opt5 from anti-HIV_Chain
gacauccagaugacccaaagcccucccucccugucugccagcgugggcgauagagucacaauuacgugccaggcuucccaggacaucaacaauuuccucaacugguaccagcaaaagccggggaaagcgccccggcugcuuauuuaugaugccucuaaucuggagagcggaguuuccucucgcuuuagcggcuccagaagcgggaccgacuucacacucaccaucucuucccugcuuccugaagauauugcuacauacagcugucagcaguauucuaaccugcccuacaccuuuucccagggaacaaagcucgagaucaaacggaccguggccgccccuagcguguucaucuuucccccuucugacgaacaa

SEQ ID NO: 42427 - RNA, 372 nt, Artificial Sequence
  derived and/or modified sequence opt5 from anti-HIV_Chain
caggugcaacugguccagagcggcaccgccguuaagagacccggggcuuccgugcgggugucuugccaggccagcggauacacauucaucgaccacuuuauuuauugguggcgccaggcgccuggccaagggcucgaguggcugggauggaucaacccgcuuacgucccagcccucuuacccuagcagauuccagggccggcugacccucacacgcgauaccuuugacgaaaugcuguauauggaucuuagagggcugcgguccgacgauacaggaauuuacuucugugcucgcagacauucugacuauugcgauuuugacaucuggggcagcggcacccagauuaucgucuccagcgccucuacaaaaggg

SEQ ID NO: 42428 - RNA, 372 nt, Artificial Sequence
  derived and/or modified sequence opt5 from anti-HIV_Chain
caggugcaacugguccagagcggcgccgcucucaagaaacccggggccucccugagaaucucuugccaggcguacggauauaaguucaccgaccaccuuauuuacugguggcggcaggcuccuggccaagggcuggaguggaucggauggauuaaaccggaaacaggccagcccagcuauuccuacaaguuucaggggcgcguuucucucacgagagauaccuuccaggagauccuguuuauggaccuucggggacugcgcagcgaugacacagccauuuauuucugugccagacggcauuccgauuacugcgacuuugauguguggggcucuggcagccaagugaucgucuccagcgcuucuaccaaaggg

SEQ ID NO: 42429 - RNA, 372 nt, Artificial Sequence
  derived and/or modified sequence opt5 from anti-HIV_Chain
caggugcaacugguccagagcggcgccgcucucaagaaacccggggccucccugagaaucucuugccagaccuacggauauaaguucacagaccaccuuauuuacugguggcggcaggcgccuggccaagggcuggaguggaugggauggaucaaaccggaaacgggccagcccagcuauuccuaccgcuuucaggggagaguuucucucacccgggauacauucgaggaaauuguguuuauggaccugcgcggacuuagaagcgaugacaccgcuaucuauuucugugcccggcgccauuccgauuacugcgacuuugauguguggggcucuggcagccaggucauuguguccagcgccucuacaaagggg

SEQ ID NO: 42430 - RNA, 372 nt, Artificial Sequence
  derived and/or modified sequence opt5 from anti-HIV_Chain
caggugcaacugguccagagcggcgccgcucucaagaaacccggggccucccugagaaucucuugccagaccuacggauauaaguucacagaccaccuuauuuacugguggcggcaggcgccuggccaagggcuggaguggaucggauggauuaaaccggaaacgggccagcccagcuauuccuaccgcuuucaggggagaguuucucucacccgggauacauucgaggaaaucgcuuuuauggaccugcgcggacuuagaagcgaugacaccgccauuuauuucugugcccggcgccauacagauuacugcguguuugacguguggggcuccggcucucagaucaucgucagcuccgcuagcaccaagggg

SEQ ID NO: 42431 - RNA, 372 nt, Artificial Sequence
  derived and/or modified sequence opt5 from anti-HIV_Chain
caggugcaacugguccagagcggcaccgccguuaagagacccggggcuuccgugcgggugucuugccaggccagcggauacacauucacggacuauuuuaucuacugguggcgccaggcgccuggccaagggcucgaguggcugggauggauuaacccgcuuaccucccagcccucuuauccuagcagauuccagggccggcugacacucacccgcgauacauuugacgaaaugcuguacauggaucuuagagggcugcgguccgacgauaccggaaucuauuucugugcucgcagacacucugacuacugcgauuuugacauuuggggcagcggcacacagaucauugucuccagcgccucuaccaaaggg

SEQ ID NO: 42432 - RNA, 372 nt, Artificial Sequence
  derived and/or modified sequence opt5 from anti-HIV_Chain
caggugcaacugguccagagcggcgccgcucucaagaaacccggggccuccguuagaaucucuugccaggcguacggauauaaguucaccgaccaccugauuuacugguggcggcaggcuccuggccaagggcuugaguggaucggauggauuaaaccggaaacaggccagcccagcuaugccuacaaguuucaggggcgcgugacgcugaccagagauacauucgaggaaauccauuuuauggaccuccggggagugcgcaacgaugacaccgccacauauuucugugcuagacggcacuccgauuacugcgacuuugaugucuggggcucuggcagccaggugauuguuuccucugccagcaccaaaggg

SEQ ID NO: 42433 - RNA, 372 nt, Artificial Sequence
  derived and/or modified sequence opt5 from anti-HIV_Chain
caggugcaacugguccagagcggcgccgcucucaagaaacccggggccuccguuagaaucucuugccagaccuacggauauaaguucacagaccaccugauuuacugguggcggcaggcgccuggccaagggcuugaguggaucggauggauuaaaccggaaacgggccagcccagcuauuccuaccgcuuucaggggagagugucucugacccgggauacauucgaggaaaucguguuuauggaccuccgcggacugagaagcgaugacaccgcuauuuauuucugugcccggcgccauuccgauuacugcgacuuugaugucuggggcucuggcagccaggugcuuguuuccagcgccucuacaaagggg

SEQ ID NO: 42434 - RNA, 372 nt, Artificial Sequence
  derived and/or modified sequence opt5 from anti-HIV_Chain
caggugcaacugguccagagcggcgccgcucucaagaaacccggggccucccugagaaucucuugccagaccuacggauauaaguucacagaccaccuuauuuacugguggcggcaggcgccuggccaagggcuggaguggaucggauggauuaaaccggaaacgggccagcccagcuauuccuaccgcuuucaggggagaguuucucucacccgggauacauucgaggaaaucguguuuauggaccugcgcggacuuagaagcgaugacaccgcuauuuauuucugugcccggcgccauuccgauuacugcgacuuugauguguggggcucuggcagccagguccugguguccagcgccucuacaaagggg

SEQ ID NO: 42435 - RNA, 372 nt, Artificial Sequence
  derived and/or modified sequence opt5 from anti-HIV_Chain
caggugcaacugguccagagcggcgccgcucucaagaaacccggggccuccguuagaaucucuugccagaccuacggauauaaguucacagaccaccugauucauugguggcggcaggcgccuggccaagggcuugaguggaucggauggauuaaaccggauacgggccagcccagcuacuccucucgcuuucaggggagagugagccugacccgggacacauucgaagagaucguguuuauggaucuccgcggacugagauccgacgauaccgcuauuuauuucugugcccggcgccacucugacuacugcgauuuugacgucuggggcagcggcucccaggugcuuguuagcucugccuccacaaagggg

SEQ ID NO: 42436 - RNA, 372 nt, Artificial Sequence
  derived and/or modified sequence opt5 from anti-HIV_Chain
caggugcaacugguccagagcggcgccgcucucaagaaacccggggccucccugagaaucucuugccagaccuacggauauaaguucacagaccaccuuauuuacugguggcggcaggcgccuggccaagggcuggaguggaucggauggauuaaaccggaaacgggccagcccagcuauuccuaccgcuuucaggggagaguuucucucacccgggauacauucgaggaaaucguguuuauggaccugcgcggacuuagaagcgaugacaccgcuauuuauuucugugcccggcgccauuccgauuacugcgacuuugauguguggggcucuggcagccaggucaucguguccagcgccucuacaaagggg

SEQ ID NO: 42437 - RNA, 372 nt, Artificial Sequence
  derived and/or modified sequence opt5 from anti-HIV_Chain
caggugcaacugguccagagcggcgccgcucucaagaaacccggggccucccugagaaucucuugccagaccuacggauauaaguucacagaccaccuuauuuacugguggcggcaggcgccuggccaagggcuggaguggaucggauggauuaaaccggaaacgggccagcccagcuauuccuaccgcuuucaggggagaguuucucucacccgggauacauucgaggaaaucguguuuauggaccugcgcggacuuagaagcgaugacaccgcuauuuauuucugugcccggcgccauuccgauuacugcgacuuugauguguggggcggcgggucucaggucaucgugagcuccgccagcacaaaggga

SEQ ID NO: 42438 - RNA, 372 nt, Artificial Sequence
  derived and/or modified sequence opt5 from anti-HIV_Chain
caggugcaacugguccagagcggcgccgcucucaagaaacccggggccucccugagaaucucuugccuuaccuacggauauaaguucacagaccaccugauuuacugguggcggcaggcgccuggccaggggcucgaguggaucggauggauuaaaccggaaacgggccaacccagcuauuccuaccgcuuucaggggagaguuucucugacccgggauacauucgaggaaaucguguuuauggaccuucgcggacugagaagcgaugacaccgcuauuuauuucugugcccggcgccauuccgauuacugcgacuuugauguguggggcucuggcagccaggucaucguguccagcgccucuacaaagggg

SEQ ID NO: 42439 - RNA, 372 nt, Artificial Sequence
  derived and/or modified sequence opt5 from anti-HIV_Chain
caggugcaacugguccagagcggcgccacccucaagaaacccggggcuuccguuagaaucucuugccaggccuacggauauaaguucacagaccaccugauucauugguggcggcaggcgccuggccaagggcuugaguggaucggauggauuaaaccggaaacgggccagcccagcuacgcuuauaaguuucaggggcgcgugucccugaccagagauacauucgaggaaauccucuuuauggaccugcggggacuucgcucugaugacaccgccauuuacuucugugccagacggcacagcgauuauugcgaccuggauguguggggcggcgggacacagcuccuggucuccucugcuagcaccaaagga

SEQ ID NO: 42440 - RNA, 372 nt, Artificial Sequence
  derived and/or modified sequence opt5 from anti-HIV_Chain
caggugcaacugguccagagcggcgccgcucucaagaaacccggggccuccguuagaaucucuugccaggcguacggauauaaguucaccgaccaccugauuuacugguggcggcaggcuccuggccaagggcuugaguggaucggauggauuaaaccggaaacaggccagcccagcuauuccuacaaguuucaggggcgcgugacgcugaccagagauacauucgaggaaauccauuuuauggaccuccggggacugcgcuaugaugacaccgccacauacuucugugccagacggcacucugauuauugcgacuuugauguguggggcagcggcucccaggucucugugagcuccgcuagcaccaaaggg

SEQ ID NO: 42441 - RNA, 372 nt, Artificial Sequence
  derived and/or modified sequence opt5 from anti-HIV_Chain
caggugcaacugguccagagcggcgccgcucucaagaaacccggggccucccugagaaucucuugccaggcguacggauauaaguucaccgaccaccuuauuuacugguggcggcaggcuccuggccaagggcuggaguggaucggauggauuaaaccggaaacaggccagcccagcuauuccuacaaguuucaggggcgcguuucucucacgagagauaccuuccaggagauccuguuuaugaaccuucggggacugcgcagcgacgauacagccauuuauuucugugccagacggcauuccgacuacugcgauuuugacguguggggcucuggcagccaaauccucguguccagcgcuucuaccaaaggg

SEQ ID NO: 42442 - RNA, 372 nt, Artificial Sequence
  derived and/or modified sequence opt5 from anti-HIV_Chain
caggugcaacugguccagagcggcaccgccguuaagaaacccggggcuuccgugagagugucuugccaggccagcggauacacauucacggacuauuuuaucuacugguggcggcaggcgccuggccaagggcucgaguggcugggauggauuaacccgcgcaccucccagcccucuuauccuuacagauuccagggccgggucacacuuacccgcgauaucuuugaagagaugcuguauauggaccucagagggcugcggagcgaugacacaggaauuuacuucugugcucgcagacacuccgauuauugcgacuuugauaucuggggcucuggcacccagauuaucgugagcuccgccagcacaaagggg

SEQ ID NO: 42443 - RNA, 372 nt, Artificial Sequence
  derived and/or modified sequence opt5 from anti-HIV_Chain
caggugcaacugguccagagcggcgccgcucucaagaaacccggggccucccugagaaucucuugccaggcguacggauauaaguucaccgacuaccuuauucacugguggcggcaggcuccuggccaagggcuggaguggaucggauggauuaaaccggaaacaggccagcccagcuauuccuacaaguuucaggggcgcguuucucucacgagagauaccuucgaggaaauccuguuuauggaccuucggggacugcgcagcgaugacacagccauuuauuucugugccagacggcauuccgauuacugcgacuuugauguguggggcggcgggucucaggugcucgucagcuccgcuagcaccaaagga

SEQ ID NO: 42444 - RNA, 372 nt, Artificial Sequence
  derived and/or modified sequence opt5 from anti-HIV_Chain
gaggugcagcugcucgaaagcggcggggcccugguccaacccggaggcucccuuagacugucuugcgcugccagcggguucaccuuuuccacaucuagcauguccuggguucggcaggcgccuggaaagggccucgagugggugucugcuaucgggagcggacgcggcuccacguucuacgccgacagcgugaaaggcagauuuaccauuucucgggauaacuccaagaauacacugagccuucagaugaacucucugaccgccgaagacacagcuaccuauuacuguacaaaaaccgggggacuccugcgcuucccggaggucuggggcaaggggacgaccgugacaguuuccagcgccucuaccaaagga

SEQ ID NO: 42445 - RNA, 372 nt, Artificial Sequence
  derived and/or modified sequence opt5 from anti-HIV_Chain
gaggugcagcuggucgaaagcggcgggggacucguuaagcccggcgggucccugagacuuucuugcgccgacagcggauucaccuuucgguccuacucuaugcacugggugcgccaagcuccuggcaaagggcuggccugggugagcuccaucucuagcacauccaacuauauuuacuaugcggauagcgucaagggaagauucacgaucucucgggacaaugcuaaaaacucccucuaccugcagaugaauagccuucgcgccgaggauaccgccguguauuacugugcuagaacauuuauuaccgccucuugguucgacuccuggggccagggcacacugguuaccgugagcucugcuuccacaaagggg

SEQ ID NO: 42446 - RNA, 372 nt, Artificial Sequence
  derived and/or modified sequence opt5 from anti-HIV_Chain
caggugcaacugguccagagcggcgccgagguuaagaaacccggggcuuccgugaaggugucuugcaaagccagcggauacaccuucacaaacuauggcgucuccugggugagacaggcgccugggcagggacucgaauggaugggcuggaucucuccguacagcgggaauacgaacuaugcucaacggcugcaggaccgcguuaccaugacaaccgauacauccaccaauacagccuacauggagcuuagaucucugcggagcgacgauaccgccguguauuacugugcugcccgcuccuauuacuacuauagcauggacgucuggggacagggcacgaccgugacaguuucuuccgcuagcaccaagggc

SEQ ID NO: 42447 - RNA, 372 nt, Artificial Sequence
  derived and/or modified sequence opt5 from anti-HIV_Chain
caggugcaacugguccagagcggcgccgagcucaagaaacccggguccucuguuaaggugagcugcaaggcuuccggaggcaccuucucuaacuacgccaucaauugggugagacaggcgccugggcagggauuugaauggaugggcgggauuaucccgcuguucgcuacacccacguaugcccaaaaauuucagggacggguccgcauuaccgccgacgauagcacauccaccgcuuacauggagcuuucuagccugagauccgacgauacagccguguauuucugugcucggccuaacguugugcgcagcgcccucgacuacuggggccagggcacccuggucacagugucuuccgcgagcaccaaaggg

SEQ ID NO: 42448 - RNA, 372 nt, Artificial Sequence
  derived and/or modified sequence opt5 from anti-HIV_Chain
caggugcaacuggucgagagcggcgggggaguugugcagcccggcaagucccucagacugucuugcgccgcuagcggguucaccuuuuccacacacgccaugcauugggugcggcaggcgccuggaaaaggccuugacugggucgcugugaucucucacgauggggacaaccaguacuaugccgaugccguuaagggacgcuucacgauuagcagagacgauucccgggacaccguguuucugcaaaugaacucucuccgcacagaagauaccggcgucuacuauugugcugccgacagcuccggcagcaauugguucgauuacugggggcagggaauccuggugacaguuucuuccgcuagcaccaaaggc

SEQ ID NO: 42449 - RNA, 375 nt, Artificial Sequence
  derived and/or modified sequence opt5 from anti-HIV_Chain
caggugcggcugagccaauccggcgggcagaugaagaaacccggagagucuaugcggcucagcugccgcgccuccggcuacgaguuccugaacuguccuaucaauuggauuagacuugcuccggggcggcgccccgaauggaugggauggcugaagccuagaggcggggccgucaacuaugcgcggaaauuucagggacgcguuaccaugacaagagacguguacucugauacggcuuuccucgaacugcggagccuuaccuccgacgauacagccguguauuuuugcacccgcggcaaguacuguacagccagagacuauuacaauugggauuucgagcacuggggcagaggggcucccgucaccgugucuagc

SEQ ID NO: 42450 - RNA, 375 nt, Artificial Sequence
  derived and/or modified sequence opt5 from anti-HIV_Chain
gaggugcagcugguccaaagcggcuccgacguuagaaagcccggggccaccgugacagugucuugcaaagcugaugaagacgaggaugacuucacggccuacaacuauuuuaugcacuggguccggcaggcgccuggacauggccucgaauggaucggguggauuaauccgcgcaccggacagcccaaccacgcuaagcaguuccaaggcagagugacacugacccgggagcgcagcacauccaccguuuuuaugaaacuuacaaaucugagacucgaugacaccgccguguacuucugugcccggccucugcgcgggggagauacguggcauuaucacucuuggggcagaggcaccagccuuacagucuccucu

SEQ ID NO: 42451 - RNA, 375 nt, Artificial Sequence
  derived and/or modified sequence opt5 from anti-HIV_Chain
caggugcaacugguccagagcggcgggggacucguucagcccggcgagucccugagacuuucuugcaccgccagcggguucacauuuuccucuuacaacaugaauugggugcggcaggcuccuggaaagggccuggaauggaucagcuauauuuccgacaaaucuaagaacaaauacuaugccgauagcgugcgcgggagauucacgaucucccgggacaaugcgcaaaacagccucuuucugcagaugucuucccuucgcgaugaggacaccgcugucuacuauuguacaagagaaggaccgcagcggagcuucuacuuugauuauuggggccagggcauucaagugaccguuucuuccgccagcacaaagggg

SEQ ID NO: 42452 - RNA, 375 nt, Artificial Sequence
  derived and/or modified sequence opt5 from anti-HIV_Chain
gaggugcagcuggucgaaagcggcgccgagguuaagaaacccggguccucugugaaggugagcugcaaggcuuccggaggcaccuucucuagcuacuccaucucuugggucagacaagccccugggcagggacucgaauggaugggcgggauuaucccgauuuuugcgacaacgcacuauggacagaaauuccagggccggaucaaaauuaccgcugacaagagcacauccaccgccuacauggagcugagccgccuuagaucugaagauacagccguguauuacugugcucgggaccgcgaguuuuauuucuacggcauggauguuugggggcaaggaaccacagugaccgucuccagcgccucuacgaagggc

SEQ ID NO: 42453 - RNA, 375 nt, Artificial Sequence
  derived and/or modified sequence opt5 from anti-HIV_Chain
cagcugcaacuccaggagagcggccccgggcuggugaagccuugggaaacccuuguccugacaugcuccguuucuggaggcagcaucuccucuggggacuacuauuggggauggauuagacagagcccgggcaaagggcccgaguggaucggaaacauuuucuacuccucuggcaauacguauuacaacaccagccucaagucccgggugacaaucagcguggaugucucuaaaaaucgcuuuucccugaaacuuaccagcaugacagccgcugacaccgccguguauuacuguggcagacugucuaacaaggggugguucgauccuuggggacagggcacacucguuuccgugagcucugcguccaccaagggg

SEQ ID NO: 42454 - RNA, 375 nt, Artificial Sequence
  derived and/or modified sequence opt5 from anti-HIV_Chain
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcgauacagacuuuacccuuacaauuucuucccuggagcccgaagauuucgccguuuauuacugucaacagcgcggaaucuggccucuccagauuaccuuuggccaggggacaagacuggagaucaaacggaccguggcugcccccagcguguucaucuuuccuccgucugacgaa

SEQ ID NO: 42455 - RNA, 375 nt, Artificial Sequence
  derived and/or modified sequence opt5 from anti-HIV_Chain
agcgagaucgugcugacccagucccccggcacacucucucugagcccuggggaaagagccacgcuuuccugccgggcuucucaaagcgucuccucuagcuaccuggccugguaucagcagaagccgguucaggcgccccgccuccugauuuacggagcuuccagcagagccaccggcaucccugaccgguucucuggguccggaagcggcacagauuuuacccuuacaauuucucgccuggagcccgaagacuucgccguguauuacugucaacaguaugggacccuccacccuagaacauuuggacagggcaccaaaguggagaucaagcggacggucgcugcccccuccguguucauuuuuccuccgagcgau

SEQ ID NO: 42456 - RNA, 375 nt, Artificial Sequence
  derived and/or modified sequence opt5 from anti-HIV_Chain
agccaggccguggucacccaacccccuuccguuucuggcgcuccggggcagagagugacaaucagcugcuccggaggccccucuaacgucgggggaaaucugguguacugguauaagcaguucccuggcacggcccccaaacuccugauucggcgcgacgaucagagaccuagcggggugcccgaccgguuuuccggaucuaagagcggcaacuccgcgagccuugcuaucucuggccugcgcccugaugacgaggccuucuacuuuugugccaccuaugauucccacgggagcauuagacucuucggaggcgggacacugcuuaccguucugucucaaccgaaagcugcccccuccgugacacucuuuccuccc

SEQ ID NO: 42457 - RNA, 375 nt, Artificial Sequence
  derived and/or modified sequence opt5 from anti-HIV_Chain
gacauccagaugacccaaagccccuccacacuggccgcuucuauuggcgggacggugagagucagcugccgggccucccagucuaucaccggaaacuggguugcgugguaccagcagcgcccuggcaaggcuccgagacuccugauuuaucgcggggccgcccuucugggaggcgugcccagccgguucuccgggucugcugccggaacagauuuuacccucacaaucggcaaucugcaagcugaggacuucggcaccuuuuacugucagcaguaugauacauacccugggaccuucggacagggcacgaaaguggaagucaagagaaccguggccgcgcccagcguuuuuauuuucccucccuccgacgagcaa

SEQ ID NO: 42458 - RNA, 375 nt, Artificial Sequence
  derived and/or modified sequence opt5 from anti-HIV_Chain
gagaucgugaugacccagagccccgacacacuguccgucucuccuggcgaaagagccacgcucagcugccgggcuucccaaucuguuaacagcaaucuggccugguaccagcagaagccggggcaggcgccccgccuucugauuuauggagcuuccaccagagccacagccgugccugcucgguucucuggcagcggguccggaaccgaguuuacacucaccaucagcucucugcaauccgaagauagcgccguguacuauugucagcaguacuaucaguggcuuucuuacacauucggccaagggaccaaacuggagauuaagcgcacggucgcugcccccuccguguuuaucuucccucccagcgacgaacag

SEQ ID NO: 42459 - RNA, 375 nt, Artificial Sequence
  derived and/or modified sequence opt5 from anti-HIV_Chain
agacaggugcaacugguccagagcggcgccgcucucaagaaacccggggccucccugcggaucucuugccaggcguacggauauaaguucaccgaccaccuuauuuacugguggcgccaggcuccuggccaagggcuggaguggaucggauggauuaaaccggaaacaggccagcccagcuauuccuacaaguuucaggggagaguuucucucacgcgggauaccuuccaggagauccuguuuauggaccuucgcggacugagaagcgaugacacagccauuuauuucugugcccggcgccauuccgauuacugcgacuuugauguguggggcucuggcagccaaauccucguguccagcgcuucuaccaaaggg

SEQ ID NO: 42460 - RNA, 375 nt, Artificial Sequence
  derived and/or modified sequence opt5 from anti-HIV_Chain
caggugcaacugguccagagcggcgccgcucucaagaaacccggggccuccguuagaaucucuugccaggcguacggauauaaguucaccgacuaccugauucacugguggcggcaggcuccuggccaagggcuugaguggaucggauggauuaaaccggaaacaggccagcccagcuauuccuacaaguuucaggggcgcgugacgcugaccagagauacauucgaggaaauccucuuuauggaccugcggggacuucgcucugaugacaccgccauuuauuucugugccagacggcauagcgauuacugcgacuuugauguguggggcuccggcucucaggucaucgugagcuccgcuagcacaaaaggggcc

SEQ ID NO: 42461 - RNA, 375 nt, Artificial Sequence
  derived and/or modified sequence opt5 from anti-HIV_Chain
gaggugcagcuggucgaaagcggcgggggacucguuaagcccggcgggucccugagacuuucuugcgccgcuagcggauucuccuuuucugagcacuacaugagcuggauccggcuggccccuggcaaagggcucgaauggcuguccuauauuucuagcuccacccgcacaacguacagcgcggacucugugagaggacgguucaccaucucccgcgauacagcuaagcaacuucuguuucuccauaugagcucucugagagccgaggacaccgccguguauuacuguguccggcuguauggcggcauuaacgggugguucgaucaguggggacagggcacacucguguccguuagcucugcuuccaccaaaggg

SEQ ID NO: 42462 - RNA, 375 nt, Artificial Sequence
  derived and/or modified sequence opt5 from anti-HIV_Chain
caggugcaacugguccagagcggccccgggcucguuaagccuuccgagacccugucucuuacaugcagcguguccaacggaucuaucagcuccggcggguacuauuggucuuggcugagacaguucccgggaaaaggccucgaauggauugggagcauccacuacacgggacggaccuuuuauaaucccucccugaugggccgcacagcccuuagcauggacaccucuaacaaucaguucucccugaaggugagcucugucacagcugccgauaccgcgcucuacuauugugcuagagagcugcaauggauguuugugguugacccuuggggccaggggacacuggugaccgucuccagcgccucuacgaaagga

SEQ ID NO: 42463 - RNA, 375 nt, Artificial Sequence
  derived and/or modified sequence opt5 from anti-HIV_Chain
caggugcaacugcaggagagcggccccgggcucgucaagccuuccgaaacccugucucuuacaugcagcguuuccaacggaucuaucagcuccggcggguacuauuggucuuggcugagacaguucccgggaaaaggccucgaguggauugggagcauccacuacacgggacggaccauguauaaucccucccugaugggccgcccugcccuuagcauggacacaucuaacaaucaguuuucccugaagcucagaagcgugaccgcugccgauacagcgcuguacuucugugcucgggaccugcaauggauuuuuguggucgaucccuggggccaggggacccucgugacaguuucuuccgccagcaccaaagga

SEQ ID NO: 42464 - RNA, 375 nt, Artificial Sequence
  derived and/or modified sequence opt5 from anti-HIV_Chain
gaggugcagcugcucgaaagcggcgggggacugguccaacccggcgggucccuuagacugucuugcgccguuagcggauucaccuuuggcgggcacgcuguguccugggugcggcaggccccuggaaagggccucgaguggcugucucagaucagcggcacagggucccgcacggacuacgcggaugcugucaaaggaagauucaccgugucucgggacaauagcaagaaaacaguuuaucuucagaugaacucccugcgcguggaagauaccgcccucuuuuacugugccacaagaagcccgggcgggggauaugcuuucgacauuuggggccaaggggccauggucaccgugucuuccgcuagcacaaaggga

SEQ ID NO: 42465 - RNA, 375 nt, Artificial Sequence
  derived and/or modified sequence opt5 from anti-HIV_Chain
caggugcaacugguccagagcggcgccgagguuaagaaacccggguccucugugaaggugagcugcaaagucuccuucuuuucuaacuacggaaucagcugggugagacagcggccuggccaggggcucgaauggaugggacgcauuaucccggcuauugacgauaugaccuaugcccaaacauucagaggccggguuacguuuuccgcggacaaguucaccacaaccgcuuacauggagcugacagggcuuaccuuugaagauacagccaccuauuucugugcccgcgacccccaggugaauagacggggaaacugcuuugaucacuggggccagggcacgcuggucaccgugucuagcgcuuccacaaaaggg

SEQ ID NO: 42466 - RNA, 375 nt, Artificial Sequence
  derived and/or modified sequence opt5 from anti-HIV_Chain
caggugcaacugcaggagagcggccccgggcucgucaagccuuccgaaacccugucucuuacaugcacgguuagcggaggcuccaucucuuacuauuacuggagcuggauuagacagccgcccgggaaaggacuggaguggaucggcgacauuuauuacuccgggaccacagauuauaacccuucucucaagagccgggugaccaucuccguggacacaagcaaaaaucaguucucucugaaacuuuccagcgucaccgccgcugauacagccguguacuauugugcgcgcagacggggacaacgccugcucgcuuacuuugacuacuggggccagggcucucugguuaccguguccagcgccucuacgaagggg

SEQ ID NO: 42467 - RNA, 375 nt, Artificial Sequence
  derived and/or modified sequence opt5 from anti-HIV_Chain
caggugcaacugcaggaaagcggccccgggccugucaagccguccgaaacccucucucugacaugcacgguuagcggaggcuccaugaucucuuacuauuggagcuggauuagacagcccccugggaaaggacuugaguggaucggcuacauuuucaccaacgggcggacaaccuauucccccucucugcgcagcagagugacaaucucccucgacaccagcacaaaucacuuuucucugcggcuuaaguccgugaccgccgcugauacggccauuuacuauugugcgcgccuggacggagaggcuuucagauacuaucucgaucuguggggccagggcaaccuggucaccgugagcucugccuccacaaaaggg

SEQ ID NO: 42468 - RNA, 375 nt, Artificial Sequence
  derived and/or modified sequence opt5 from anti-HIV_Chain
caggugcaacugguccagagcggcgccgagguuaagaaacccggggcuuccgugaaggugucuugcaaaccuagcuccaacaccuucacaucucacuacauccauugggucagacaggccccgggacagggccucgaauggauggggaugauuaaucccggaggcagcacgcgguaugcgccuaaguuucaagggcgcgugacccugacaagagacaccuccacacggaccguuuacauggagcuuucuagccugcgcuccgaagauacagcuguguauuacugugccagaccccaguauaaccucggacgggacccucuggaugucuggggccuuggcaccauggugacgguuagcucugccuccaccaaaggg

SEQ ID NO: 42469 - RNA, 375 nt, Artificial Sequence
  derived and/or modified sequence opt5 from anti-HIV_Chain
caggugcaacugcagcaguggggcgccgggcuccugaagcccagcgagacccuuucccugacaugcgcugucuacggaggcucuuucagcggguauuacugguccuggaucagacagccuccgggaaaaggccucgaauggauuggggagaucaaccacucuggaagcacgaauuauaaccccucccugaagucucggguuaccauuagcguggacacauccaaaaaucaauuuagccuuaagcugucuuccgugaccgccgcggauacagcugucuacuauugugcccgccucccuaucggcagcggcugguacgggagagacuauuggggacagggcacccuggugacaguuucuuccgccagcaccaaaggg

SEQ ID NO: 42470 - RNA, 375 nt, Artificial Sequence
  derived and/or modified sequence opt5 from anti-HIV_Chain
caggugcaacugguccagagcggcgccgagguuaagaaacccggggcuuccgugaaggugucuugcaaagccagcggaaacaccuucacauccuacggcaucacgugggucagacaggcgccugggcagggacucgaauggaugggcuggauuucugcuuauaaugggaacaccaauuacgcccaaaagcugcaggaccggcuuacaaugaccacagauaccagcacauccaccgccuauauggagcugcgcucucucagaagcgacgauacggcuguguacuauugugccuuuucccggcacuacggaagcggcaacuaugacuacuggggccaggggacccugguuacagugucuuccgcuagcaccaaagga

SEQ ID NO: 42471 - RNA, 375 nt, Artificial Sequence
  derived and/or modified sequence opt5 from anti-HIV_Chain
caguucagacuggugcaaagcggccccgaggucaagaacccuggguccucuguuaccgugagcugcaaagccuccggaggcacauuuucugggcucggaaucaauugggugcggcaggcuccgggccaggggcuggaauggcuuggagacauuaagacgauguacggcaccacaaacuaugcccccaaauuccagggccgcgucaccaucacagcggaugagagcaccuccacaucuuacauggaacugagcgggcucagauccgaggacaccgcuguguuuuauuguguucgggaacuguucggacaccauccugccuuuggcgugugggggcaaggaacgagcgucauugugucuuccgccagcaccaagggc

SEQ ID NO: 42472 - RNA, 375 nt, Artificial Sequence
  derived and/or modified sequence opt5 from anti-HIV_Chain
agagugcagcugguccaaagcggcgccgagguuaagaaacccggguccucugugaccgugagcugcaaggcuuccggaggcucuuucagcuccuacgccaucucuuggguccggcaggcgccugggcagggacucgaaugggugggcgggguuaaagugauguuuggaacaguccacuauagccagaaggugcaaggccgcguuacgauuaccgcugacgauuccacaggcaccagcuaccuggagcuuucugggcugagauccgccgacacagccguguauuacugugcucggaacgccggagcuuauuucuacccguuugauaucuggggccaggggacccucauuaucgucagcucugccuccacaaaagga

SEQ ID NO: 42473 - RNA, 375 nt, Artificial Sequence
  derived and/or modified sequence opt5 from anti-HIV_Chain
caggugcaacugcaggagagcggccccgggcucgucaagccuuccgaaacccugucucuuacaugcacgguuagcggaggcuccaucucuagcagauccuacuauuggggguggauucggcagccgcccggaaaaggccuggaguggguggggucuaucuacuauaccggaagcacauacuauuccccuagccucaagucucgcgugaccauuuccgucgacacaagccagaaccaauucucucugaaacuuaauuccgugaccgccgcugauacagccguuuacuauugugcgagacagaagggcagcggcaccucucugcucuacugggggcagggaacgcuggugaccgucuccagcgcuuccacaaaaggc

SEQ ID NO: 42474 - RNA, 375 nt, Artificial Sequence
  derived and/or modified sequence opt5 from anti-HIV_Chain
caggugcaacugguccagagcggcaccgagguuaagaaacccggguccucugugaaggugagcugcaaagccuccggaggcacauucucugacagcgauaucgcuugggucagacaggccccugggcagggacucgaauggaugggcgggauuacgccgauguuugacauggcgaaguccgcucaaaaauuccggggacgccugaucauuaccgccgauaagucuacaggcaccgccuacauggagcuuagcucccugagauaugaagacgcugccguguacuuuugugcucggagcucuggcaacuucgaguuugccuucgaaaucugggggcagggaacaaagauuaucguuucccucgcgagcaccaaaggc

SEQ ID NO: 42475 - RNA, 375 nt, Artificial Sequence
  derived and/or modified sequence opt5 from anti-HIV_Chain
gugguccagcugguucaaagcggcaccgaggugaagaaacccggguccucugugaaggucagcugcaaagccuccggaggcacauucucugggagcgacaucuccugggugagacaggcuccuggacagggccucgaauggaugggagggauuaucccgauguuugauauugaggaccacgcccagaaguuccggggccgccugacgaucaccgcggauaaaucuacaggcgcugccuacauggaacuuagcucccugagaagcgaggacgccgcuguuuauuacugugcccggucuuccgggaacuaugauuuugcuuucgacauuuggggacaaggcacccgccucaucgugagcucugccuccacaaagggg

SEQ ID NO: 42476 - RNA, 375 nt, Artificial Sequence
  derived and/or modified sequence opt5 from anti-HIV_Chain
gugguccagcugguugagagcggcaccgaagugaagaaacccggguccucugugaaggucagcugcaaagccuccggaggcacauucucugggagcgacaucuccugggugagacaagcuccuggacagggccucgaguggaugggagggauuaucccgauguuugauauugaaaaccacgccgagaaguuccggggccgccugacgaucaccgcgguuaaaucuacaggcgcugccuacauggaacuuagcucccugagaagcgaggacgccgcuguguauuacugugcccggucuuccgggaauuaugauuuugcuuacgacauuuggggacagggcacccgcgucaucgugagcucugccuccacaaagggg

SEQ ID NO: 42477 - RNA, 378 nt, Artificial Sequence
  derived and/or modified sequence opt5 from anti-HIV_Chain
caggugcaacugguccagagcggcuccgccaugaagaaacccggggcuucuguuagagugagcugcuggaccuccgaggacaucuucgauacaacggaacucauucacugggugcggcaggccccuggacagggccuggaguggaucgggugggucaaggcggugucuggagcuguuaacuacggcagccuugacuuucgccauagagugucccugacccgggaucgcgaccucucuacagcccacauggauauuagagggcugacccaagacgauacagccaccuauuucugugcucggcagaaauuugcccgcggagaccagggcugguucuuugaucuuuggggcagagggacacugaucgucgugagcuccgcu

SEQ ID NO: 42478 - RNA, 378 nt, Artificial Sequence
  derived and/or modified sequence opt5 from anti-HIV_Chain
caggugcaacugcaggagagcggccccgggcucgucaagccuuccgaaacccugucucuuacaugcacgguuagcggaggcuccaucucuaaccacuacuggagcuggauuagacagccgcccgggaaaggacuggaguggaucggcuauauuuaccauuccgggaauaucaacuauaagucuagccucaaaucccgggccaccauuagcaucgacacaucuaauaaccaguucucccugaaacuuagcucugugaucgcugccgauaccgcgguguacuauugugcucgcaauuuuggaccuggcucccccaacuacggcauggacgucugggggcaaggaacaaccgugacaguuagcucugccuccaccaagggc

SEQ ID NO: 42479 - RNA, 378 nt, Artificial Sequence
  derived and/or modified sequence opt5 from anti-HIV_Chain
caggugcaacugguccagagcggcgggggaguugugcagcccggcagaucccuccggcugucuugcgccgcuagcggguucaccuuuucccaccauggaauccacugggugcgccaggccccuggcgaggggcuugaaugggucgcggugauuucugaggacggaacaaacauccauuacgaagauagcguuagaggccgguucacgauuucccgcgacaauucuaagaacaccguggaucugcaaaugaauagccucagagcugaggacacagccgucuauuacugugccucccugaucagcaugcgggauggcgacgcuuuugaucuuugggggcagggaacccgcgugacaguuucuuccgccagcaccaaaggc

SEQ ID NO: 42480 - RNA, 378 nt, Artificial Sequence
  derived and/or modified sequence opt5 from anti-HIV_Chain
caggugcaacuggucgagagcggcgggggacucggccagcccgggggaucccugagacuuucuugcgccgcuagcggcuucaccuuucggaacuacgccauguccuggguucgccaggcggcugggaagggacuggaaugggugucuggcgugagcggcgggggagacacaacguauuacggcgauuccgucaaagggagauucaccaucucucgggacaauagcaagaacacacucuaucugcagaugaauaaccuucgcgccgaggauaccgccguguacuauugugcuaaagacaagggaguuuggggcuccagcgauuuugacuacugggggcaaggaacacuggugaccgucucuuccgccagcacaaaaggc

SEQ ID NO: 42481 - RNA, 378 nt, Artificial Sequence
  derived and/or modified sequence opt5 from anti-HIV_Chain
gaggugcagcuggucgaaagcggcgggggaguugugcaacccggcagaucccuccggcugucuugcgccgcuagcggguucaccuuuucccaccauggaauccacugggugcgccaggccccuggcgaggggcuugaaugggucgcggugauuucugaggacggaacaaacauccauuacgaagauagcguuagaggccgguucacgauuucccgcgacaauucuaagaacaccguggaucugcagaugaauagccucagagcugaggacacagccgucuauuacugugccucccugaucagcaugcgggauggcgacgcuuuugaucuuugggggcagggaacccgcgugacaguuucuuccgccagcaccaaaggc

SEQ ID NO: 42482 - RNA, 378 nt, Artificial Sequence
  derived and/or modified sequence opt5 from anti-HIV_Chain
agaggccccgugacccuggccgucagccucggggagcgggcuacaaucacgugcaaguccucucagagcguucuggugcacuccaacaauaaaaacuaccuuucuugguaucaacagaagccuggacagccgcccaaacugcucauuuacugggccagcacccgcgaauccggcgugccugagagauucucugggagcggauccggcacagacuuuacccugagcaucucuucccuucaggcggaagaugucgcuguguauuacugucaucaauauuucagcacaccccggaccuuugggcagggaacaaagguugagauuaaaggcaccguggccgccccuucugucuucaucuuucccccuuccgacgaacagcug

SEQ ID NO: 42483 - RNA, 378 nt, Artificial Sequence
  derived and/or modified sequence opt5 from anti-HIV_Chain
agcgagaucgugaugacccagucccccgccacacugucuaugagcccuggcgaaagagcuacgcucuccugccgggccucucugagcgucaacaccaaucuugcgugguaccaacagaagccggggcaggcuccccgccugcucauuuauggagccuccacaagagccaccggcaucccugcucgguucucugggagcggauccggcacagaguuuacccugacaauuagcucucuucaguccgaagacuucgcccuguacuauugucaacaguacaaccacuggccccagaccuuugggcagggaacgaaaguugagaucaagcgcaccguggcugccccuagcguguucauuuuucccccuucugaugaacaaaaa

SEQ ID NO: 42484 - RNA, 378 nt, Artificial Sequence
  derived and/or modified sequence opt5 from anti-HIV_Chain
agcgagaucgugcugacccagucccccgccacacucucucugagcccuggcgaaagagcuacgcuuuccugccgggccucucaaagcauuaacaauuaccuggcgugguaucagcagaagccggggcaggcuccccgccuccugaucuacgacgccuccaacagagccaccggcauuccugcucgguucucuggagggggaagcggcacagauuuuacccuuacaaucuccagccuggagcccgaagacuucgccgucuauuacugucaacagcgcgcuaauuggagacuccugaccuuugggggaggcacaaaaguugagauuaagcggaccguggccgcgccuucuguguucaucuuucccccuuccgaugaacag

SEQ ID NO: 42485 - RNA, 378 nt, Artificial Sequence
  derived and/or modified sequence opt5 from anti-HIV_Chain
caggugcaacugguccagagcggcggggccguuaagaaacccggagcuuccgugaaggugucuugcgagaccuacggcuauacauucacggaccacuuuaugcauugguggagacaggccccugggcagggacucgaauggaugggcuggaucaacccguacagcuccgcggucucuuauagcccccgguaccaagggcgcgugaccaugacaagagauaccuuccuggagacaguuuauauggaacuucggggacugaaauuugacgauaccgcuauuuacuauugugccacaccuaaguccggccgcgacuacuggucuuucgaucucuggggccaggggacccuggugacggucagcuccgccagcaccaaagga

SEQ ID NO: 42486 - RNA, 378 nt, Artificial Sequence
  derived and/or modified sequence opt5 from anti-HIV_Chain
agccaggugcaacuggucgaguccggccccgggcucguuaagccuucugaaacccugagccuuacaugcuccgugucuaacggaagcaucuccucuggcggguacuauuggagcuggcugagacaguucccgggaaaaggccucgaguggauuggguccauccacuacacgggacggaccauguauaaucccagccugaugggccgcccugcccuuucuauggacacauccaacaaucaguuuagccugaagcucucuuccgugaccgcugccgauacagcgcuguacuucugugcuagagaccugcaguggauuuuugucguggaucccuggggccaagggacccucguuacagugagcucugccuccaccaaagga

SEQ ID NO: 42487 - RNA, 378 nt, Artificial Sequence
  derived and/or modified sequence opt5 from anti-HIV_Chain
agcgugguccagcugguugaguccggccccgggcucgugaagccuucugaaacccugagccuuacaugcuccgugucuaacggaagcaucuccucuggcggguacuauuggagcuggcugagacaauucccgggaaaaggccucgaguggauuggguccauccacuacacgggacggaccauguauaaucccagccugaugggccgcccugcccuuucuauggacacauccaacaaucaguuuagccugaagcucagaucugucaccgcugccgauacagcgcuguacuucugugcucgggaccugcaguggauuuuugugguugaucccuggggccaggggacccucgugacagucuccagcgccucuaccaaagga

SEQ ID NO: 42488 - RNA, 378 nt, Artificial Sequence
  derived and/or modified sequence opt5 from anti-HIV_Chain
agcggcgggagacuggugcagcccggaggcucccuccggcugucuugcagcgccuccggguucacccuuucuaacagcgcuauguccuggguccgccaagccccuggaaagggccuggaguggguuucuagcauccucuccagcggggugggaacauuuuacgcggacucugugaaaggcagauucacggucucccgggauaauagccgcaacacccuguaucuucagaugaagucucugagagcugaagacacagcccucuacuauugugccaaagugcagauucagcaacugaauuuuggcguuaucaccgaugcugggcuggacguguggggaaagggcacaacccucauugucuccagcgccucuacaaaaggg

SEQ ID NO: 42489 - RNA, 378 nt, Artificial Sequence
  derived and/or modified sequence opt5 from anti-HIV_Chain
caggugcaacugguccagagcggcgccgcuguuaagaaacccggggccuccgugaaggugucuugcgaggcguacggauauaaauucaccgaccacuuuaugcauugguggagacaggcuccuggccaggggcucgaauggaugggauggaucaacccguacacaagcgccgucaauuauucccccaaguaccaaggccgggugacgaugacccgcgauacauuccuggagaccguuuauauggaacuuagagggcugcggguggacgauacagccauuuacuauugugcuaccccuaaaucuggacgcgacuacuggagcuuugaucucuggggccagggcacacuggucaccguguccucugccagcacgaagggg

SEQ ID NO: 42490 - RNA, 378 nt, Artificial Sequence
  derived and/or modified sequence opt5 from anti-HIV_Chain
caggugcaacugguccagagcggcgccgcuguuaagaaacccggggccuccgugaaggugucuugcgagaccuacggauauaaauucacagaccacuuuaugcauugguggagacaggcgccuggccaggggcucgaauggaugggauggaucaacccguacagcuccgcugucucuuauagcccccgguaccaaggccgcgugacgaugaccagagauacauuccuggagaccguuuauauggaacuucgggggcugcgcuuugacgauacagccauuuacuauugugccaccccuaaguccggaagagacuacuggucuuucgaucucuggggccagggcacacuggugaccgucagcuccgcuagcacgaaaggg

SEQ ID NO: 42491 - RNA, 378 nt, Artificial Sequence
  derived and/or modified sequence opt5 from anti-HIV_Chain
caggugcaacugguccagagcggcgccgcuguuaagaaacccggggccuccgugaaggugucuugcgagaccuacggauauacauucacggaccacuuuaugcauugguggagacaggcgccuggccaggggcucgaauggaugggauggaucaacccguacagcuccgcugucucuuauagcccccgguaccaaggccgcgugaccaugacaagagauaccuuccuggagacaguuuauauggaacuucgggggcugaaauuugacgauaccgccauuuacuauugugccacaccuaaguccggacgcgacuacuggucuuucgaucucuggggccagggcacccuggugacggucagcuccgcuagcaccaaaggg

SEQ ID NO: 42492 - RNA, 378 nt, Artificial Sequence
  derived and/or modified sequence opt5 from anti-HIV_Chain
caggugcaacugguccagagcggcgccgagguuaagaaacccggguccucugugaaggugagcugcaaaaccuccggagucagauucucuagcaacgcuaucuccugggugcggcaggccccuggccaggggcucgaauggaugggacgcacaacgccgaugcugggcggggcgaaucacgcucccucuuuuaagggaagaguuaccauuagcgccgacgaguccacacggaccguguacauggaaaugagcucucuucgcuaugaggauacagccgucuacuauugugcuuccggcagacgggaaggccugaacuuccuccuggacuacugggggcaaggaacccuugugacaguuagcucugccuccaccaaaggc

SEQ ID NO: 42493 - RNA, 378 nt, Artificial Sequence
  derived and/or modified sequence opt5 from anti-HIV_Chain
caggugcaacugcaggagagcggccccgggcucgucaagccuuccgaaacccugucucuuacaugcacgguuagcggaggcuccaucucuaccuacuauuggagcuggauuagacagccgcccgggaaaggacuggaguggaucggcuacauuuccuauucugggagcacaaacuacaauccuucccucaagagccgggugaccaucucuguggacacauccaaaaaccaguucagccugaaacuuucuuccgucaccgccgcugauacagccguguauuacugugcgcgccacaagagcguucugcucugguuuagagaacuggacuauuggggacaaggcacccuggugacggucucuuccgcuagcaccaagggc

SEQ ID NO: 42494 - RNA, 378 nt, Artificial Sequence
  derived and/or modified sequence opt5 from anti-HIV_Chain
caggugcaacugguccagagcggcgccgagguuaagaaacccggggcugccgugaagaucuccugcaaagcgucuagauucaccuuuagcuccuacuauauucacugggugcggcaggcuccuggacagggccucgaauggauggggaucauuaacccgucuggaggcagcacauccaaugcccaaaaguuccaggaccgcgucacgcugaccagagauaugucuacagggaccguguacauggagcuuagccggcugacauccgaagacaccgccguuuauuacugugcuacacccgagccuagcucuaucguggcuccccucuauuacuggggacagggcacccuggucacgguguccagcgccucuaccaaaggc

SEQ ID NO: 42495 - RNA, 378 nt, Artificial Sequence
  derived and/or modified sequence opt5 from anti-HIV_Chain
caggugcaacugguccagagcggcgccgagaugaagaaacccggggcuuccguuaaggugucuugcaaagccagcggacacaccuucacaaacuacuauaugcauugggugagacaggcgccuggccaggggcucgaauggaugggaaugaucaauccgacgggcgacuccacccgguacgcucaacgcuuucaggggagagucacaaugacccgggauacaucuacccgcacaguguauauggagcugagcucccuuagaucugacgauaccgccguuuacuauugugcccgggcucaccaugacuucuggcgcgcccccguggaugucuggggaaagggcacgaccgugacaguuagcuccgcuagcaccaaaggc

SEQ ID NO: 42496 - RNA, 378 nt, Artificial Sequence
  derived and/or modified sequence opt5 from anti-HIV_Chain
caggugguccugauccaaagcggcgccgagguuaagagacccggguccucugugaaagugagcugcaaggcuuccggaggcucuuucccuauuaccuggguccggcaggccccggggcacggacucgaauggaugggcgggaucaaccccuuuuucggaacaacgaauuacgcgcagaaauuucagggccgcgugagcauuaccgcugacgaguccacaucuaccacauaucugcaucuuagcgaucugagauccgaagacaccgccguuuacuucugugcccgggagaaccgcgaaaaguggcucgugcugagaagcugguuugcuccuuggggccaagggacacuugucaccgugucuuccgccagcacgaaagga

SEQ ID NO: 42497 - RNA, 378 nt, Artificial Sequence
  derived and/or modified sequence opt5 from anti-HIV_Chain
agccagcaacuggugcaguccggcgcccaggucaagaaacccggggcuucuguuagagugagcugccaggccuccggauacaccuucacaaaccacuuucuccauugguggcggcaagcgccucgccagggccuggaguggaugggguggaucaauccggugcacggaggcagaaacuaugcucggcgcuuccaggggagaauuaauuuuggacgggacgucuaccaggaaacggccuauauggagcuuucuggccugcgcaacgaugacaccgccacauacuucugugcuagaggcgggggagauggccggaauuggcaucuccaccccugggggcaaggaacccuggugaucguuagcgccgcuuccacaaagggc

SEQ ID NO: 42498 - RNA, 378 nt, Artificial Sequence
  derived and/or modified sequence opt5 from anti-HIV_Chain
gaggugcaggucguugaaagcggcgggggacuggugcaacccggcgggucccucagacugucuugcguggccagcggauucaccuuuuccgaguacuggaugucuuggguccggcaggcuccuggcaaggggcuugaauggguggccacaaucaaacgcgacggaagcgaggaauccuauguugauucugugaagggcagauucacgauuagccgggacaacgcgaaaaauucccuguaccuccagaugaacagccugcgcgcugaggauaccgccgucuauuacugugccagagugcgggacccgaauuauaaccuucacuuugauucuuggggccaggggacacugguuaccguguccagcgcuucuacaaaggga

SEQ ID NO: 42499 - RNA, 378 nt, Artificial Sequence
  derived and/or modified sequence opt5 from anti-HIV_Chain
cuggugcagcucgucgagagcggcgggggaguugugcaacccggcaagucccugagacuuucuugcgccaccagcggguucacauuuuccacguacggaaugcacugggugcggcaggcuccuggcaaagggcuggaaugggucgccgugaucugguaugacggaucuuacaaguauuacgcggauagcguuaaaggccgcuucaccauuuccagagacaacucuaagaauacacucuuucugcagaugaacagccuucgggcugaggauaccgccauguauuacuguggccgcgaaauggccgucgggggaacaaaagcucuggaccauuggggccaggggacccucgugacaguguccagcgccucuaccaaggga

SEQ ID NO: 42500 - RNA, 378 nt, Artificial Sequence
  derived and/or modified sequence opt5 from anti-HIV_Chain
gaguuccagcuggugcaaagcggcgggggacucgucaagcccggcgggucccugagacuuucuugcaccggaagcacauuuuccuucucuagcgacgauaugaacuggguucggcaggccccuggcaaagggcuggaauggguguccucuaugagcgacuccggaagccacaucuacuaugcugauuuugugaagggccgcuucacgauuucuagagacaaugccaaaaagucccucuaccugcagaugaacagccuucgggcggaggauaccgcugucuauuacugugcccagucucgcccgccccaaagacuguauggcauggacgugugggggcagggaacaaccguuacaguguccagcgccucuaccaaaggc

SEQ ID NO: 42501 - RNA, 381 nt, Artificial Sequence
  derived and/or modified sequence opt5 from anti-HIV_Chain
gaggugcagcuggucgaaagcggcgggggaguugugcaacccggcgggucccucagacugucuugcgccgcuagcggauucauguuuaagaacuacgccaugcacugggugcggcagccuccgggcaaagggcuugagugggucgcggugaucugguauggaggccgcgaccagaauuacgcugauuccguuaagggcagauucaccauuucucgggacgauagcgacaacacacuguaucuccagaugaacucccugcgcgccggggauacggccguguacuuuugugcuagaaauucucaagucggacggcuuaugcccgccgcuggcgugugggggcagggaacccugguuacagugagcuccgccagcaccaaaggc

SEQ ID NO: 42502 - RNA, 381 nt, Artificial Sequence
  derived and/or modified sequence opt5 from anti-HIV_Chain
cagggccaccuggugcaaagcgggggaggcgucaagaaacucgggaccuccguuacaaucucuugccuggccagcgaguacacguucaacgaauuugugauucauuggaucagacaggcucccggacagggcccucuuuggcuggggcucauuaagcgguccggacgccugaugaccucuuaucaguuccaagacagacuuagccugcggcgcgauagauccacaggcaccguguuuauggagcuccggggccugcgcgucgacgauacagccguguacuauugugcgagagacgggcugggagaaguugcuccggccuaccucuauggcaucgaugccugggggcagggaaccacagugauugucaccucugcuagcacg

SEQ ID NO: 42503 - RNA, 381 nt, Artificial Sequence
  derived and/or modified sequence opt5 from anti-HIV_Chain
caggugcaacugcucgagagcggcgggggacugguccagagaggcgggucccuucggcugucuugcaccgccagcggauucguuuuuaacaauuacuggaugacaugggugcgccaggcucccggcaacgggcucgaauggguggccaauaucgaccaggauggauccgagaagcacuaucuggacucugucaaaggcagauucacgauuagccgggauaacgcgaaaaauucccuuuaccugcaaaugaacucucuccgcgcugaagacaccgccaucuauuacugugccagagugcgguuuaagguuacagcuuggcaucgcuucgauagcuggggccagggggaccuggugaccgucuccagcacaucuaccaaggga

SEQ ID NO: 42504 - RNA, 381 nt, Artificial Sequence
  derived and/or modified sequence opt5 from anti-HIV_Chain
cagagcgcccugacccaacccccuuccgcuucuggcacaccggggcagagagugacgaucagcugcuccggaucuuaccacaacauuggcagcaaugccgucaacugguaucagcagcuccccgggaccgcgccuaagcugcuuaucuacuccaaugaccaacggcccucuggaguuccugaucgcuucagcggcuccaaaagcgggacaucugcuucccuggccauuagcggacuccagucugaggacgaagccgauuauuacugugcugccugggacgauucccugcauguguuuggcaccggcacaaaggugaccguccuugggcagcccaaagcuaacccuacagugacccuguucccgcccagcucugaggaacuc

SEQ ID NO: 42505 - RNA, 381 nt, Artificial Sequence
  derived and/or modified sequence opt5 from anti-HIV_Chain
cagagcgugcugacccaaguccucuccguuucuggcacacccgggcagagagugaucauuagcugcuccggaacgucuagcaacgugggcgggaaucuggucuccugguaccagcaccuuccuggagccgcuccgcggcugcucauccaucgcgacgaucagagacccucuggcgugccugaccgguucagcggguccaagagcggaaacucugccucccugguuauuagcggccuucgcucugaugacgaggcggauuauuuuugugcugccuacgacuccaccuucagccugcccguguuuggcgggggaacaagacucaccguccugucucaaccuaaagccgcucccuccgugacacuguucccuccgagcuccgaa

SEQ ID NO: 42506 - RNA, 381 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuugucaguuucaggggagagucucccuuacgcggcaugccucuugggauuucgacaccuuuagcuucuacauggaucugaaggcccuccgcuccgacgauacagcuguguauuuuugcgccagacaacggucugacuacugggauuucgacguuuggggaagcggcacccaggugacagucuccagcgcuucuaccaaa

SEQ ID NO: 42507 - RNA, 381 nt, Artificial Sequence
  derived and/or modified sequence opt5 from anti-HIV_Chain
caggugcaacugguccagagcggcggggagguuagaaagcccggauccucugugaaagugccuugcaagaucagcggcaacgccuucuccaauuacggggucaacugggugcggcaggcuccgggacagggccucgaauggguugggcgcauuauccccgugauuggagucgcccaacacgcgccuaaauuucagggcagagugaccaucacagcugacaagucuacgaccacagccuaucuggagcuuagcucccugcggucugaugacaccgccguuuacuucugugcuaaagaucauggcgacccccgcacaggguauuacuuugauuauuggggacagggcgcccucgugaccgucagcuccgcuagcacaaagggg

SEQ ID NO: 42508 - RNA, 381 nt, Artificial Sequence
  derived and/or modified sequence opt5 from anti-HIV_Chain
caggugcaacugggccagagcgggaccgaggucaagaaacccggauucuccguuaaggugucuugcaaagccagcggcggguccucuacagcuuacggauauagcugggugagacaggccccuggccagggguuugaauggaugggacggaucauuccguucuacggcaucauuacguaugcgcccaaguuucaaggccgcgucaccaucacagcugacagauccaccucuacaguguacauggagcucaccagccugacauucgccgauaccgcccuguuuuucugugcucgggacuuuggggauccucgcaacggauauuacuucgacuccugggaucagggccuuuggcucacgguuagcucugccuccaccaaaggg

SEQ ID NO: 42509 - RNA, 381 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcaccuucucuaacuacgccaucagcugggucagacaggcgccugggcagggacucgaauggaugggcgggauuaucccgauuuuugaggcugccuccuaugcccaaaaauuccaggaccggcugacaaucacgaccgaugaaucuacaaccacagcuuacauggaccuuagcucccugcgcagcgaggauaccgccauuuauuacugugcuagagcccagggagacauccucacagaaggcuauuuugauuacuggggccaggggacccuggugacgguuucuuccgcgagcaccaaagga

SEQ ID NO: 42510 - RNA, 381 nt, Artificial Sequence
  derived and/or modified sequence opt5 from anti-HIV_Chain
caggugcaacugcaggagagcggccccgggcucgucaagccuuccgaaacccugucucuuacaugcacgguuagcggaggcuccaucucuagcgccggguacuauugguccuggauuagacagcacccggagaaaggacuggaguucaucggcuacauuuauuaccucgggaccacauauuacaaccccucucuuaagagccggguguccaucagcauugacaccucuaauaaccaguuuucccuggaacugagcucuguguccgcugccgauacagcgaucuauuacugugcucgcgacuacaccgccagcggaagacauuucuuugauuauuggggccaaggcacacucgucaccgugucuuccgccagcacgaaaggg

SEQ ID NO: 42511 - RNA, 381 nt, Artificial Sequence
  derived and/or modified sequence opt5 from anti-HIV_Chain
caggugcaacugguccagagcggcgccgagguuaagaaacccggggcuuccgugaaggugucuugcaaagccccuggauacaccuucaucggccacuauaugcauuggauuagacaggcgccggggcagggacucgaauggaugggcuggaucaaccccaauagcggggacacaaacuacgcucaaacguuucagggacgggucaccaugacacgcgauaccuccauuucuacagccuauauggagcugaccagacuucggagcgacgauacagccguguacuauugugcucgcgaccugagaccuaugcggggcaauugggccaugcacguuuggggcgaagggaccacggugaccgucuccucugcuagcacaaaggga

SEQ ID NO: 42512 - RNA, 381 nt, Artificial Sequence
  derived and/or modified sequence opt5 from anti-HIV_Chain
caggugcaacugcaggagagcggccccgggcucgucaagccuuccgaaacccugucucuuacaugcacgguuuucggagccagcaucagauccuuuuacuggcacuggauucggcagucuccgggcaaagggcuggaguggcucggaagcguguucgacaacggccugaccacauauaaucccucccuuaagaaccgccugucuaucagcgaagauccuuccagaaaucagauuagccucaaccugcggucuaugaccgcugccgacacagcgguguacuauugugcucgcgccgauuacgaccugcucaccuccagcuaucauuuugauucuugggggcaaggaacacuggucaccguguccagcgccucuacgaaaggc

SEQ ID NO: 42513 - RNA, 381 nt, Artificial Sequence
  derived and/or modified sequence opt5 from anti-HIV_Chain
agccagcaacuggugcaguccggcacccaggucaagaaacccggggccucuguuagagugagcugccaggcuuccggauacacauucacggacuaugugcuccacugguggcggcaagccccuggccaggggcuggaguggaugggauggaucaagccggucuacggcgcgcgcaacuaugcucauagauuucaggggcggauuaauuucgaucgcgacguguacagagaaaucgccuauauggaucuuucuggacugcggagcgacgauaccgccguuuacuuuugugcucgcgacggcuccggcgaugccacaucuuggcaccuccaucccugggggcagggaacccuggugauugucagcuccgcuagcacaaaaggc

SEQ ID NO: 42514 - RNA, 381 nt, Artificial Sequence
  derived and/or modified sequence opt5 from anti-HIV_Chain
agccagcaacuggugcaguccggcacccaggucaagaaacccggggccucuguuagagugagcugccaggcuuccggauacacauucacgaacuauauccuccacugguggcggcaagccccuggccgcgggcuggaguggaugggacuuauuaagccgguguacggcgcggucaauuaugcuagacaguuucaggggcggauccagcugacccgcgacauuuacagagaaaucgccuuccucgaucugucuggacuucggcccgacgauacagccguguauuacugugcucgcgacgagagcggcuaugaucugaacuggcaucucgacuccuggggccaagggacccagguuauugugucuccugccagcacaaaagga

SEQ ID NO: 42515 - RNA, 381 nt, Artificial Sequence
  derived and/or modified sequence opt5 from anti-HIV_Chain
agccagcaacuggugcaguccggcgcccaggucaagaaacccggggcuucucucagaguuagcugccaggccuccggauacaccuucaugaacuaucugcuucacugguggcggcaagcgccuggccaggggcuggaguggaugggauggaucaauccgguguacggcgcugugaacuaugcccaucgcuuucaggggagacucacauucucucgggacgucuaccgcgaaauugccuauauggaucugaauggacuuagaagcgacgauacggcuguguacuuuugugcccgggacggcuccggcgaugaccgcaacuggcaccuggaucccugggggcagggaacccucguuaucgugucuagcgcuuccacaaagggc

SEQ ID NO: 42516 - RNA, 381 nt, Artificial Sequence
  derived and/or modified sequence opt5 from anti-HIV_Chain
agccagcaacuggugcaguccggcacccaggucaagaaacccggggccucuguuagaaucagcugccaggcuuccggauacacauucacggacuaugugcuccacugguggcggcaagccccuggccaggggcuggaguggaugggauggauuaagccgguguacggcgcgcgcaacuaugcuagacgguuucaggggcgcaucaauuucgauagagacauuuaccgggaaaucgccuuucuugaucugucuggacuccgcagcgacgauaccgccagauauuucugugcucgggacggcuccggcgaugacacaucuuggcaucugcaccccugggggcagggaacccuugucauugugagcgccgcuuccacaaaaggc

SEQ ID NO: 42517 - RNA, 381 nt, Artificial Sequence
  derived and/or modified sequence opt5 from anti-HIV_Chain
agccagcaacuggugcaguccggcacccaggucaagaaaacaggggccucuguuagagugagcugccaggcuuccggauacgacuucacgaaguaucucauccacugguggcggcaagcccccggccaggggcuggaguggaugggauggaugaaaccuguguacggcgcgaccaacuaugcucaucgcuuucaggggagaauuucuuucacacgggauaucuaccgcgaaauugccuuuauggaccuuaauggacugagaagcgaugacaccgccgucuauuucugugcucgggauggcggcggggacgaucgcacauggcuccuggacgccuggggacagggcacccuugugaucguuuccucugcuagcacaaagggg

SEQ ID NO: 42518 - RNA, 381 nt, Artificial Sequence
  derived and/or modified sequence opt5 from anti-HIV_Chain
agccagcaacuggugcaguccggcacccaggucaagaaacccggggccucuguuagagugagcugccaggcuuccggauacacauucaugaacuauaucauucacugguggcggcaagccccuggccagcgccucgaguggaugggguggaucaauccgguguuuggagcgagaaacuacgcucaucgguuccagggccgcauuaauuuugacagagauaucaaccgggaaacguuccagauggaccugaccgggcuucgcucugaugacacagccgucuauuacugugccagagauggaagcggcgacgcucgggauuggcaucugcaccccuggggccaagggacccucgugauuguuuccucugccagcacaaaggga

SEQ ID NO: 42519 - RNA, 381 nt, Artificial Sequence
  derived and/or modified sequence opt5 from anti-HIV_Chain
agccagcaccuggugcaauccggcacccaggucaagaaacccggggccucuguuagagugagcugccaggcuuccggauacacauucacgaacuauauccuccauugguggcggcaggccccuggccaagggcuggaguggaugggacuuauuaagccgguguuuggcgcggucaauuacgcucgccaguuccaggggagaauccagcugacccgggacauuaaccgcgaaaucgccuuucucgaucugucuggacuuagaagcgacgauacagccguguauuacugugcucgggacgaguccggcgaugaccugaaauggcaccuccaucccuggggccaagggacccagguuauugugucuccugccagcacaaaggga

SEQ ID NO: 42520 - RNA, 381 nt, Artificial Sequence
  derived and/or modified sequence opt5 from anti-HIV_Chain
agccagcaacuggugcaguccggcacccaggucaagaaacccggggccucuguuagagugagcugccaggcuuccggauacacauucaugaacuauaucauucacugguggcggcaagccccuggccagcgccucgaguggaugggguggaucaauccgguguuuggagcgagaaacuacgcucaucgguuccagggccgcauuaauuuugacagagauaucaaccgggaaacguuccagauggagcugaccgggcuucgcucugacgauacagccgucuauuacugugccagagacggaagcggcgaugcucgggacuggcaccuggaucccuggggccaagggacccucgugauuguuuccucugccagcacaaaggga

SEQ ID NO: 42521 - RNA, 381 nt, Artificial Sequence
  derived and/or modified sequence opt5 from anti-HIV_Chain
agccagcaacuggugcaguccggcacccaggucaagaaacccggggccucuguuagaaucagcugccaggcuuccggauacacauucacggacuaugugcuccacugguggcggcaagccccuggccaggggcuggaguggaugggauggauuaagccgguguacggcgcgcgcaacuaugcuagacgguuucaggggcgcaucaauuucgauagagacauuuaccgggaaaucgccuauauggaucuuucuggacugcgcagcgacgauaccgccagauacuuuugugcucgggacggcuccggcgaugacacaucuuggcaucuccaccccugggggcagggaacccuggucauugugagcgccgcuuccacaaaaggc

SEQ ID NO: 42522 - RNA, 381 nt, Artificial Sequence
  derived and/or modified sequence opt5 from anti-HIV_Chain
agccagcaacuggugcaguccggcacccaggucaagaaacccggggccucuguuagaaucagcugccaggcuuccggauacucuuucacagacuaugugcuccacugguaccggcaagccccuggccaggggcuggaguggaugggauggauuaagccgguguauggcgcgcgcaacuacgcuagacgguuucaggggcgcaucaauuucgauagagacauuuaucgggaaaucgccuuuauggaucuuagcggacugcgcuccgacgauacggcccucuacuucugugcuagagacggcucuggcgaugacaccagcugguaucuggaucccugggggcagggaacacuugucauuguguccgccgcuagcaccaaaggc

SEQ ID NO: 42523 - RNA, 381 nt, Artificial Sequence
  derived and/or modified sequence opt5 from anti-HIV_Chain
agccagcaacuggugcaguccggcacccaggucaagaaacccggggccucuguuagaaucagcugccaggcuuccggauacucuuucacagacuaugugcuccacugguggcggcaagccccuggccaggggcuggaguggaugggauggauuaagccgguguacggcgcgcgcaacuaugcuagacgguuucaggggcgcaucaauuucgauagagacauuuaccgggaaaucgccuuuauggaucuuagcggacugcgcuccgacgauacggcccucuauuucugugcuagagacggcucuggcgaugacaccagcuggcaucuggaucccugggggcagggaacacuugucauuguguccgccgcuagcaccaaaggc

SEQ ID NO: 42524 - RNA, 381 nt, Artificial Sequence
  derived and/or modified sequence opt5 from anti-HIV_Chain
agccagcaccuggugcaauccggcacccaggucaagaaacccggggccucuguuagagugagcugccaggcuuccggauacacauucacgaacuauauccuccauugguggcggcaggccccuggccaagggcuggaguggaugggacuuauuaagccgguguuuggcgcggucaauuacgcucgccaguuccaggggagaauccagcugacccgggacauuuaucgcgaaaucgccuuucucgaucugucuggacuuagaagcgacgauacagccguguacuauugugcucgggacgaguccggcgaugaccugaaauggcaccuccaucccuggggccaagggacccagguuauugugucuccugccagcacaaaggga

SEQ ID NO: 42525 - RNA, 381 nt, Artificial Sequence
  derived and/or modified sequence opt5 from anti-HIV_Chain
caggugcaacuggucgagagcggcgggggaguugugcagcccggcaagucccucagacugucuugcgccaucagcggguuccuuuuuaacaauuacggaggccagugggugcggcaggcuccugggaaaggacuggaaugggucgccgcgauuuccuaugacggcaacaaucgcuacuaugcugauucugccaagggcagauuccucaucagccgggacaccccgaaaaacauucuguaccuucaaaucuauucccugcgccucgaugacacagccguguacuauugugcuagagauucuguuagcaaguccuacagcgcucccccugaguuuugggggcagggaacgguggucaccgugucuuccgccagcacaaaaggc

SEQ ID NO: 42526 - RNA, 381 nt, Artificial Sequence
  derived and/or modified sequence opt5 from anti-HIV_Chain
caggugcaccuggaggaaagcggccccgggcucgucaagaccucccaaacacugucucuuacgugcagcguuuccucuuacagcaucuccagaucuggauauuucuggaccuggauucggcagcgcccuggcaaagggcuggaguggaucggauacauuuauuuuaacggcagaacaaccuacaauccgagccucaagucccggaucacaauuagccgcgacaccucucauucccaguucagccugacacuuaacucucuguccgccgcugauaccgccguguauuacugugggagaugccaggacggacucgcgagccggcccaucgauuuuuggggccaaggcacgcuggugaccgucucuuccgcuagcacaaaaggg

SEQ ID NO: 42527 - RNA, 381 nt, Artificial Sequence
  derived and/or modified sequence opt5 from anti-HIV_Chain
caggugcaacuggucgagagcggcgggggaguugugcagcccggcagaucccuccggcugucuugcgccaccagcggguucacauccaagaacuacggagugcacuggguccgccaggcuccuggcaaagggcuugaauggguggccguuaucugguaugacggaucuaauaaguuuuacgcggauagcgugaaaggcagauucacgauuucccgggaccgcucuaagaacauggucuaucugcagaugaauagccucagaguggaggauaccgcuaucuacuauugugcccgggacuccguugccuuugugcuggaaggcccgauugauuacugggggcaaggaacacuugucaccgugagcucugcuuccacaaaaggc

SEQ ID NO: 42528 - RNA, 384 nt, Artificial Sequence
  derived and/or modified sequence opt5 from anti-HIV_Chain
caggugcaacugguccagagcggcgggggaguuaagaaacccggcaccuccgccucuuucagcugcagaacauccgacgauaucuacgacaacgaguuuuucgauucugcuuuuaugcacugggugcggcucauuccugggcagcgcccggaauggaugggauggaugaaucccagaagcggcgccgugaacuaugcgcggcagcugcaaccucgcgucuccauguacagagaccgggaucuuucuacggcuuauauggaguucaagagccugaccuccgccgacacagggaccuacuuuugugcccgcaaaaagagaggagauggcuucaaucucuauuuugaccuguggggccgggggagccaggugaucguuucuuccgcu

SEQ ID NO: 42529 - RNA, 384 nt, Artificial Sequence
  derived and/or modified sequence opt5 from anti-HIV_Chain
cagggccaccuggugcaaagcgggggaggcgucaagaaacucgggaccuccguuacaaucucuugccuggccagcgaggacacguucaacgaauuugugauucauuggaucagacaggcucccggacagggcccucuuuggcuggggcucauuaagcgguccggacgccugaugaccucuuaccaguuccaagauagacuuagccugcggcgcgacagauccacaggcaccguguuuauggagcuccggggccugcgcgucgaugacacagccguguauuacugugcgagagaugggcugggagaaguugcuccggccuaucucuacggcaucgacgccugggggcagggaaccacagugauugucaccucugcuagcacgucc

SEQ ID NO: 42530 - RNA, 384 nt, Artificial Sequence
  derived and/or modified sequence opt5 from anti-HIV_Chain
cagagcgcccugacccaacccccuuccgugucuggcgcuccggggcagagagucacaaucagcugcuccggaggccccucuaacguugggggaaauuacguguauugguaccggcaguucccuggcacggcccccaagcuccugauucuucgcgacgaucagagaccuagcggggugcccgaccgguuuuccgcgucuaaaagcggaaacuccgcuagccuggccaucucuggccuccgcccugaugacgaggccuucuauuuuugugcuaccuacgauucccaaggcagcuucagagucuuugggggaggcacagcccugaccgugcuuucucagccgaaggcugcccccuccguuacacuguauccucccagcucugaagag

SEQ ID NO: 42531 - RNA, 384 nt, Artificial Sequence
  derived and/or modified sequence opt5 from anti-HIV_Chain
aacuucaugcugacccagcccccuagcgccuccggcacaccggggcaaagagugacgaucucuugcagcggaggcggguccaauauuggaggcaaccucgucucuugguaccagcacuuucccggggcugccccuaagcugcuuaucuaucggaaugaccagcgccccagcggaguuccugauagauucuccggcucuaaaagcggcaccuccgcgagccuggcuauuucugggcuccgguccgacgauaaggccacauacuuuugugccgcuuaugacagcacccugucucuucgccuguucggaggcgggacaacccucacagugcugucccagcccaaagccgcuccuagcgugacccuguuuccgcccucuuccgaggaa

SEQ ID NO: 42532 - RNA, 384 nt, Artificial Sequence
  derived and/or modified sequence opt5 from anti-HIV_Chain
aacuucaugcugacccagcccccuagcguguccgccacaccgggccaaacggucaccaucucuugcagcggguccggaucuaauguuggcgggaaccacguguacugguauagacagcuccccggagcugccccuacacuggugauuagcaagaccgaccaucggcccucccgcgucccugauagauucucuggcagcaaauccgggaauagcgcgucucuugcuaucuccggacugcggcccgacgaugaggccguguacuucugugccacauaugacaccggccucagccugcgccuuuuuggcgggggaacaagacugaccguucucucucagccuaaggcugccccguccgugacgcaguuucccccuagcucugaagag

SEQ ID NO: 42533 - RNA, 384 nt, Artificial Sequence
  derived and/or modified sequence opt5 from anti-HIV_Chain
cagagcgcccugacccaacccccuuccgcuucuggcgccccggggcagagagugacaaucagcugcuccggaggccccucuaacgucgggggaaauuacguuuauugguaccggcaguucccuggcacggcgcccaagcuccugauucuucgcgacgaucagagaccuagcggggugcccgaccgguuuuccgcuucuaaaagcggaaacuccgccagccuggccaucucuggccuccgcccugaugacgaggcucuguauuucugugccaccuacgauuccgacggcagcauuagacuuuuugggggaggcacagcucugaccgugcucucucaaccgaaggccgcgcccuccgucacacuguucccucccgggugggaagag

SEQ ID NO: 42534 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacuuuuucaggggcgggucucccugacgcgccaugccucuugggauuucgacaccuuuagcuucuacauggaucucaaggccgugagauccgacgauacagcuguuuauuuuugugcccggcagcgcucugacuacugggauuucgacguguggggaagcggcacccaagucacaguguccagcgcuucuaccaaaggc

SEQ ID NO: 42535 - RNA, 384 nt, Artificial Sequence
  derived and/or modified sequence opt5 from anti-HIV_Chain
caggugcaacugcuccagagcggcgccgucguuaccaagcccggggcuuccgugagagugucuugcgaggccagcggauacaaaauccgggacuauuucauucacugguggcgccaggcgccuggccaggggcugcaaugggucggauggaucaacccgcagacaggccagcccaauauuccuagacccuuucaggggcgggugacgcuuacccgccaugcuuccugggauuucgacacauuuucuuucuacauggaucugaaggcccucagaagcgacgauaccgccaucuauuuuugugcucggcgcagauccgacuacugcgauuucgacguuuggggaucuggcacacacgugaccgucagcuccgccagcacaaaaggc

SEQ ID NO: 42536 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaagccucuugggauuucgacaccauuagcuuuuacauggaucugaaggcccucagacuggacgauacagcuguguauuucugugcccggcagcgcuccgacuacugggauuuugacguuuggggaucuggcacccaggugacagucagcuccgcuagcaccaaaggc

SEQ ID NO: 42537 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaaggcccucagauccgacgauacagcuguguauuuuugugcccggcaacgcucugacuacugggauuucgacguuuggggaagcggcacccaggugacagucuauuccgcuagcaccaaaggc

SEQ ID NO: 42538 - RNA, 384 nt, Artificial Sequence
  derived and/or modified sequence opt5 from anti-HIV_Chain
caggugcaacugcuccccuucggcggggccgucaccaagccuggagcuagcguuagaguguccugcgaggccucuggcuacaacauccgggacuauuuuauucacugguggcgccaggcgccggggcagggacugcagugggugggcuggaucaaucccaaaacagggcaaccuaacaaucccugucaguuccagggaagagucagccuuacgcggccugcuuccugggauuuugacaccauuucuuucuacauggaucugaaggcccuccgccuggacgauacagccguguauuuuugcgcuagacagcggagcgacuacugggauuucgacguuuggggcuccggcacccaagugacagucucuagcgccuccaccaaaggg

SEQ ID NO: 42539 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagagucagccugacgcggcaggccuccugggauuucgacaccuauucuuuuuacauggaucuuaaagcccugcgcagcgacgauacagcuauuuauuucugugccagacaacgguccgacuuuugggauuucgacguguggggaagcggcacccagguuacagugucuuccgcuagcaccaagggc

SEQ ID NO: 42540 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagagucagccugacgcggcaggccuccugggauuucgacaccuauucuuuuuacauggaucuuaaagccgugcgcagcgacgauacagcuauuuauuucugugccagacaacgguccgacuuuugggauuucgacguuuggggaagcggcacccaggugacagucucuuccgcuagcaccaagggc

SEQ ID NO: 42541 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaaaaucuccgaccacuucauucauugguggcggcaggcuccuggccaggggcugcaaugggugggauggaucaacccgaagacaggccagcccaauaacccucgccaguuucaggggagaauuucucuuacgcggcaagccagcugggauuucgacaccuuuuccuucuauauggaucugaaagcccuccgcucugacgauacagcugucuacuuuugugccagacagcggagcgacuauugggauuucgacguguggggauccggcacccagguuacagugagcucugcuuccaccaagggc

SEQ ID NO: 42542 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaagggacucagauccgacgauacagccauuuauuuuugugcucggcaacgcucugacuacugggauuucgacguguggggcagcggcacccagguuacaguguccagcgccucuaccaaaggg

SEQ ID NO: 42543 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaaggcccucagauccgacgauacagcuguguauuuuugugcccggcaacgcucugacuacugggauuucgacguuuggggaagcggcacccaggugacagucuccagcgcuucuaccaaaggc

SEQ ID NO: 42544 - RNA, 384 nt, Artificial Sequence
  derived and/or modified sequence opt5 from anti-HIV_Chain
cacgugcagcugcuccaaagcggcgccgcugucaccaagcccggggccuccguuagagugucuugcgaggcgagcggauacaacauccgggacuauuucauucauugguggcgccaggcuccuggccaggggcugcagugggugggauggaucaauccgaaaacaggccaacccaacaauccuagacaguuucaggggcgggucucccuuacgcgccaggccucuugggauuucgacaccuuuagcuucuacauggaucugaaggcccucagacuggacgauacagcuauuuauuuuugugcccggcaacgcuccgacuacugggauuucgacguguggggaucuggcacccagguuacagugagcuccgcuagcaccaaaggc

SEQ ID NO: 42545 - RNA, 384 nt, Artificial Sequence
  derived and/or modified sequence opt5 from anti-HIV_Chain
caggugcaccugagccauuccggcgccgcugucaccaagcccggggccucuguuagagugagcugcgaggcguccggauacaaaaucucugaccacuucauucauugguggcggcaagcuccuggccaggggcuccagugggugggauggaucaacccgaagacaggccagcccaauaacccucgccaauuucaggggagaauuagccugacgcggcaggccuccugggauuucgacaccuuuucuuucuauauggaucuuaaagcccugcgcagcgacgauacagcugucuacuuuugugccagacagcgguccgacuauugggauuucgacguguggggaagcggcacccaaguuacagugucuuccgcuagcaccaagggc

SEQ ID NO: 42546 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggcuccagugggucggauggaucaacccgaagacaggccaacccaauaacccucgccaguuucaggggagaauuagccugacgcggcaggcuuccugggauuucgacaccuuuucuuucuauauggaucuuaaagcccugcgcagcgacgauacagccguguacuuuugugcuagacaacgguccgacuauugggauuucgacguuuggggaagcggcacccaggugacagucucuuccgccagcaccaagggc

SEQ ID NO: 42547 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggcuccagugggucggauggaucaacccgaagacaggccaacccaauaacccucgccaguuucaggggagaauuagccugacgcggcaggcuuccugggauaucgacaccuucucuuuuuauauggaucuuaaagcccugcgcagcgacgauacagccguguacuucugugcuagacaucgguccgacuauugggauuuugacguuuggggaagcggcacccaagugacagucucuuccgccagcaccaagggc

SEQ ID NO: 42548 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggcuccagugggucggauggaucaacccgaagacaggccaacccaauauuccucgccaguuucaggggagaaucagccugacgcggcaggcuuccggagauuucgacaccuuuucuuucuauauggaucuuaaagcccugcgcagcgacgauacagccguguacuuuugugcuagacaacgguccgacuauugggauuucggcguuuggggcagcgggacccaggugacagucucuuccgccagcaccaaggga

SEQ ID NO: 42549 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucuggccauuucauucacugguggcggcaggcgccugggcagggacuccagugggucggcuggaucaacccgaagacagggcaacccaauaacccucgccaguuucagggaagaauuagccugacgcggcaggcuuccugggacuucgauaccuuuucuuucuauauggaccuuaaagcccugcgcagcgaugacacagccguguacuuuugugcuagacaucgguccgauuauugggacuucgauguuuggggcagcggcacccaagugacagucucuuccgccagcaccaagggg

SEQ ID NO: 42550 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagaauuagccugacgcggcaggccuccugggauuucgacaccuuuucuuucuauauggaucuuaaagcccugcgcagcgacgauacagcugucuacuuuugugccagacaucgguccgacuauugggauuucgacguguggggaagcggcacccaaguuacagugucuuccgcuagcaccaagggc

SEQ ID NO: 42551 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagagucagccugacgcggcaggccuccugggauuucgacaccuauucuuuuuacaugggacuuaaagccgugcgcagcgaugacacagcuauuuauuucugugccagacaacgguccgauuuuugggacuucgauguuuggggcagcggcacccaggugacagucucuuccgcuagcaccaagggg

SEQ ID NO: 42552 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggcuccagugggucggauggaucaacccgaagacaggccaacccaauaacccucgccaguuucaggggagaauuagccugacgcggcaggcuuccugggauuucgacaccuuuucuuucuauauggaucuuaaagcccugcgcagcgacgauacagccguguacuuuugugcuagacaucgguccgacuauugggauuucgacguuuggggaagcggcacccaagugacagucucuuccgccagcaccaagggc

SEQ ID NO: 42553 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggcuccagugggucggauggaucaacccgaagacaggccaacccaauaacccucgccaguuucaggggagaauuagccugacgcggcaggcuuccugggauuucgacaccuuuucuuucuauauggaucuugaagcccugcgcagcgacgauacagccguguacuuuugugcuagacaacgguccgacuauugggauuucgacguuuggggaagcggcacccaggugacagucucuuccgccagcaccaaaggc

SEQ ID NO: 42554 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaauccgggacuauucuauucauugguggcgccaggcuccuggccaggggcuccagugggugggauggaucaacccgcaaacaggccagcccaauauuccuagacccuuccaggggcggaucagccugacgcgccaggccuccugggauuuugacaccuucucuuuuuacauggaucuugaagcccugagaagcgacgauacagcugucuauuucugugcccggcaacgcuccgacuacugggauuuugacguguggggaagcggcacccagguuacagugucuuccgcuagcaccaagggc

SEQ ID NO: 42555 - RNA, 384 nt, Artificial Sequence
  derived and/or modified sequence opt5 from anti-HIV_Chain
caggugcaccugagccaauccggcgccgcugucaccaagcccggggccucuguuagagugagcugcgaggcguccggauacaaaaucucugaccauuucauucacugguggcggcaggcuccuggccaggggcuccagugggugggauggaucaacccgaagacaggccaacccaauaacccucgccaguuucaggggagaauuagccugacgcggcaggccuccugggauuucgacaccuuuucuuucuauauggaucuuaaagcccugcgcagcgacgauacagcugucuacuuuugugccagacaacgguccgacuaucgcgauuucgacguguggggaagcggcacccagguuacagugucuuccgcuagcaccaagggc

SEQ ID NO: 42556 - RNA, 384 nt, Artificial Sequence
  derived and/or modified sequence opt5 from anti-HIV_Chain
caggugcaccugagccaauccggcgccgucguuaccaagcccggggcuucugugagagugagcugcgaggccuccggauacaaaaucucugaccauuucauucacugguggcggcaggcgccuggccaggggccgcagugggucggauggaucaaccccaagacaggccaaccuaauaacccccgccaguuucaggggagaauuagccucacgcggcaggcuuccugggauuucgacaccuuuucuuucuauauggaucugaaagcccuucgcagcgacgauacagccguguacuuuugugcuagacaucgguccgacuauugggauuucgacguuuggggaagcggcacccaagugacagucucuuccgccagcaccaagggc

SEQ ID NO: 42557 - RNA, 384 nt, Artificial Sequence
  derived and/or modified sequence opt5 from anti-HIV_Chain
caggugagacugcuccaaagcggcgccgcugucaccaagcccggggccuccguucgggugucuugcgaggcgagcggauacgaaauccgcgacuauuucauucacugguggagacaggcuccuggccaggggcugcagugggugggauggaucaacccgaaaacaggccaacccaauaacccucggcaguuucaggggcgcgucucccuuacgagacaggccucuugggauuucgacagcuacuccuuuuauauggaucugaaggcccuccggucugacgauaccgcuguguacuucugugcccgccaaagaagcgacuauugggauuuugacguuuggggauccggcacacaggugaccgucagcucugcuuccacaaaaggc

SEQ ID NO: 42558 - RNA, 384 nt, Artificial Sequence
  derived and/or modified sequence opt5 from anti-HIV_Chain
caggugagacugcuccaaagcggcgccgcugucaccaagcccggggccuccguucgggugucuugcgaggcgagcggauacgaaauccgcgacuauuucauucacugguggagacaggcuccuggccaggggcugcagugggugggauggaucaacccgaaaacaggccaacccaauaacccucggcaguuucaggggcgcgucucccuuacgagacaggccucuugggauuucgacagcuacuccuuuuauauggaucugaaggcccuccggucugacgauaccggaguguacuucugugcucgccaaagaagcgacuauugggauuuugacguuuggggcuccggcacacaggugaccgucagcucugccuccacaaaaggg

SEQ ID NO: 42559 - RNA, 384 nt, Artificial Sequence
  derived and/or modified sequence opt5 from anti-HIV_Chain
caggugagacugcuccaaagcggcgccgcugucaccaagcccggggccuccguucgggugucuugcgaggcgagcggauacgaaauccgcgacuauuucauucacugguggagacaggcuccuggccaggggcugcagugggugggauggaucaacccgaaaacaggccaacccaauaacccucggcaguuucaggggcgcgucucccuuacgagacaggccucuugggauuucgacagcuacuccuuuuauauggaucugaaggcccuccggucugacgauaccgcuguguacuucugugcccgccaaagaagcgacuauugggauuuugacguuuggggauccggcagccaggugacagucucuuccgcuagcaccaaaggc

SEQ ID NO: 42560 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuugucaguuucaggggagagucucccuuacgcggcaagccucuugggauuucgacaccauuagcuuuuacauggaucugaaggcccuccgccuggacgauacagcuguguauuucugcgccagacagcgguccgacuacugggauuuugacguuuggggaucuggcacccaggugacagucagcuccgcuagcaccaaaggc

SEQ ID NO: 42561 - RNA, 384 nt, Artificial Sequence
  derived and/or modified sequence opt5 from anti-HIV_Chain
caggugcaacugcuccagagcggcgccgcugucaccaagcccggggccuccguuagagugucuugcgaggcgagcggauacaacauccgggacuauuucauucacugguggcgccaggcuccuggccaggggcugcaaugggugggauggaucaauccgaaaacaggccagcccaacaauccuagacaguuucaggggcgggucucccuuacgcgccaugccucuugggauuucgacaccuuuagcuucuacauggaucugaaggcccucagauccgacgauacagcuguguauuuuugugcccggcaacgcucugacuacugggauuucgacguuuggggaagcggcacccaggugauugucuccagcgcuucuacaaaaggc

SEQ ID NO: 42562 - RNA, 384 nt, Artificial Sequence
  derived and/or modified sequence opt5 from anti-HIV_Chain
caggugcaacugguccagagcggcgccgacguuaagaaacccggggcuaccgugacaguguccugcaagacggaugaggacgaagaugacuucagagcccaccucaugcaguggaugcggcaggcgccuggacaacgccuggagugggucggcuggaucaaaccgcagaccgggcagcccucuuacggacagaaguuucaaggcagagugacacuuacccgggaaguuagcacauccaccguguuccugcagcuccgcaaccugagaucugaugacacagcugucuauuacugugcccggccucgcgggggaagagauaauuggagcuuucauguguggggccggggcacccuuguuacgguguccucugccagcaccaaaggg

SEQ ID NO: 42563 - RNA, 384 nt, Artificial Sequence
  derived and/or modified sequence opt5 from anti-HIV_Chain
gaggugcagcuggucgaaagcggcgccgagguuaagaaacccggggcuuccgugaaggugucuugcaaagucagcggaaacucccucaccgaguucucuauccacugggugagacaagccccuggcaaggggcuggaauggaugggaggcuuugacccggaagagggggagacaguucccgcgcagaaauucaagggacggcuuacgaugaccgaagauacaagcaccaauacagcuuacauggagcuguccucucuccgcagcgaagacaccgccguguauuacuguuccacagagccuagagagaugggcacccugacggccggcuuugaauauugggggcagggaacccuugucacagugagcucugcuuccaccaagggc

SEQ ID NO: 42564 - RNA, 384 nt, Artificial Sequence
  derived and/or modified sequence opt5 from anti-HIV_Chain
agagugcagcugggccaaagcggggccgaggucaagaaacccggagcuuccguuaaggugucuugcaaagugagcggcaacucccucaccgaguucucuauccacuggguccggcaggccccugggaagggacuggaauggaugggcggguuugacccggaagagggagaaacagugcccgcgcagaaauucaagggccgcguuacgaugaccgaggauacaagcaccaauacagcuuacauggagcuuuccucucugagaagcgaagacaccgccguguauuacuguuccacagagccucgggaaaugggcacccucacggccggguuugaguauuggggacagggcacccuggucauugugagcucugcuuccacaaagggg

SEQ ID NO: 42565 - RNA, 384 nt, Artificial Sequence
  derived and/or modified sequence opt5 from anti-HIV_Chain
caggugcaacugguccagagcggcgccgacguuaagaaacccggggcuuccgugaccgugucuugcaagacagaugaggacgaagaugacuucagagcccaccucguccaguggaugcggcaggcgccuggacaacgccuggagugggugggcuggaucaaaccgcagacggggcagcccagcuacgcucagaaguuucaaggaagaguuacccuuacacgggaaguguccaccucuacagucuuccugcagcuccgcaaccugagaagcgaugacaccgccguguauuacugugcccggccucgcggcgggagagauaauugguccuuucauguuuggggacggggcacacuugugaccgucucuagcgcuuccacgaaaggc

SEQ ID NO: 42566 - RNA, 384 nt, Artificial Sequence
  derived and/or modified sequence opt5 from anti-HIV_Chain
caggugcaacugcaggagagcggccccgggcucgucaagccuuccgaaacccugucucuuacaugcagcguuuccggagccucuaucagcaacuucuacuggacguggauuagacagccggcuggcaaagggcuggagugggugggacggcucuauuccucugaccgcaccaauuacaaccccagccugaauggcagagugacaaugucccuugauaccagcaagaaccaguuuucucugcggcucacauccaugaccgacgccgauacagcgaucuauuucugugcucgcgaaaaagggcaauggcugaccgucccucccuacuauuuugacagcuggggacagggcauucuggugacgguuucuuccgccagcaccaagggc

SEQ ID NO: 42567 - RNA, 384 nt, Artificial Sequence
  derived and/or modified sequence opt5 from anti-HIV_Chain
caggugcaacugguccagagcggcgccgagguuagaaagcccggggcuuccgugaaagugucuugcaagaccagcggauacacauucacgaacuccuauauccacuggguccggcaggccccuggccaggggcucgaauggaugggaauuaucaauccgcccggcgggaacaccuacuaugcgcaaaaauuucauggacgcgugacacugaccagagacacaucuaccagcacaguuuacauggagcuuaauucccugcggucugaagauaccgcuguguauuucugugcccgcccucacagccccacgaacauuccuuccagaccccucgacuacuggggccagggcacccuggucacagugagcucugccuccaccaagggg

SEQ ID NO: 42568 - RNA, 384 nt, Artificial Sequence
  derived and/or modified sequence opt5 from anti-HIV_Chain
caggugcaacugcaggagagcggccccgggcucgucaagccuuccggaacccugucucuuacaugcaacguuuacggcgggagcaugaucuccuauuacuggucuuggauuagacagccgcccggaaaaggccuggaauggaucgggcacguguauaauagcggaaacacgaaguacuccccuucucucaaaaaucgggugaccauuagcauggacacaucccgcaaccuguucagccuuaaggucaccucugugacacccgccgauaccgcuguuuauuacugugccagagcggacuaugauaauaucugggacucccggggcggcuuugaucugugggggcagggaacacucgugaccgucagcucugcuuccacgaaaggc

SEQ ID NO: 42569 - RNA, 384 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcacccucucuagcuacacaaucuccugggucagacaggccccugggcagggacuggaauggaugggccggcuuauuccgcugguggacaucacgaccuaugcgcaaaaauuccaggggcgcguuacaauuaccgcugauacaucuaccaacacagccuacauggagcucagcaaucugagauccgaagacaccgccaucuaucacugugcuacgagcaccaugauugccgcugugaucaacgaugccuuugaccuuuggggacagggcacaaccgucacagugucuuccgcgagcaccaaaggc

SEQ ID NO: 42570 - RNA, 384 nt, Artificial Sequence
  derived and/or modified sequence opt5 from anti-HIV_Chain
caggugcaacugguccagagcggcgccgagguuaagaaacccggggcuuccgugaagaucucuugcaaagccagcggauacuccuucagaaacuaugcggugcacuggguccggcaggcuccuggccaggggcucgaauggaugggagagauuaauggcgggaacggaaauaccgaauacucucaaaagagccagggccgccugacaaucacgagagacauuuccgccaccacagccuauauggagcuuucuagccugcgguccgaugacaccgcuguguacuauugugcccgcguugcuuacgugcaugucgugacaaccagaagccucgauaacuggggccaggggacacugguuaccgugucuuccgccagcacgaaagga

SEQ ID NO: 42571 - RNA, 384 nt, Artificial Sequence
  derived and/or modified sequence opt5 from anti-HIV_Chain
caggugagacugagccaauccggcgccgcugucaugaagaccggggccucuguuacaaucagcugcgagacggaaggauucaacuuugugaauuacauuauccacugggugcggagacccccuggccgcggguucgaguggcucggaaugauugacccgcggaacggccaucccugguuugcgcagaccguccgcgggagacugucccuucggcgcgauacauucaaugaaaucguguauaugacccugucuggacucacaaccgacgauacaggccuguacuuuugugcuagaaacgagccucaguaucacagccuucccggcauguucgacuacugggggcagggaaccccuguuacgguguccucugccagcaccaaaggc

SEQ ID NO: 42572 - RNA, 384 nt, Artificial Sequence
  derived and/or modified sequence opt5 from anti-HIV_Chain
caggugagacugagccaauccggcgccgcugucguuaagaccggggccucugugacaaucagcugcgagacggaaggauacaacuucgugaauuauauuauccacuggguccggagacccccuggccgcggguuugaguggcucggaaugauugacccgcggaacggccaucccugguucgcgcagaccgugcgcgggagacugucccuucggcgcgauacauuuaaagaaaccguuuacaugacacugucuggacucaccagcgacgauacaggcguguauuucugugcuagaaaugagccucaguaccacucccugcccggcauguuugacuauugggggcauggaaccccugucacggugucuagcgccuccaccaagggc

SEQ ID NO: 42573 - RNA, 384 nt, Artificial Sequence
  derived and/or modified sequence opt5 from anti-HIV_Chain
cagggccaacuggugcagagcgggggaggcgucaagaaacucgggaccuccguuacaaucucuugccuggccagcgaguacacguucaacgaauuugugauucacuggaucagacaggcucccggacagggcccucuuuggcuggggcucauuaagcgguccggacgccugaugaccucuuaucaauuccaggacagacuuagccugcggcgcgauagauccacaggcaccguguuuauggagcuccggggccugcgcgucgacgauacagccguguacuauugugcgagagacgggcugggagaaguugcuccggccuaccucuauggcaucgaugccugggggcagggaaccacagugauugucaccucugcuagcacgucc

SEQ ID NO: 42574 - RNA, 384 nt, Artificial Sequence
  derived and/or modified sequence opt5 from anti-HIV_Chain
caggugcaacugguccagagcggcgccgagguuaagaaacccggggcuuccgugaaggugucuugcaaagccagcggauacaccuucacauccuaugacaucaacugggucagacaggcgacgggccaggggcucgaauggaugggauggaugaauccuaacucuggcaauaccggguacgcucaaacauuucagggacgggugaccaugacacgcaacaccagcauuuccacagccuauauggagcugucuagccuuagauccgaagauaccgccguuuacuauugugcucgggaccgcuggcugccgcaguacuauuacuacggcauggauguguggggccaggggacgaccgucacagugagcucugccuccaccaaggga

SEQ ID NO: 42575 - RNA, 384 nt, Artificial Sequence
  derived and/or modified sequence opt5 from anti-HIV_Chain
caggugcaacugguccagagcggcgccgagguuaagaaacccggguccucuaugaaggugagcugcaaauccucuggaggcaccuucagcaaccacgcuaucuccugggugagacaggccccugggaagggacucgaauggaugggcgggauuaucccgaugucuggaacaacgaauuaccugcagaaauuucaaggccgggucaccauuacagcggacgaguucgcuaccacagccuauauggaacuuagcucccugaccagcgaggauacagccguguacuauugugcucgcgccagagcugacucucauacccccaucgaugccuuugacauuuggggcccugggacgcggguuaucguguccagcgcgucuaccaaggga

SEQ ID NO: 42576 - RNA, 384 nt, Artificial Sequence
  derived and/or modified sequence opt5 from anti-HIV_Chain
caggugcaacugguccagagcggcgccgagguuaagaaacccggggcuuccgugaaggugucuugcaaagucagcggauacacccucacagaacuguccauccacugggugagacaggccccuggcaagcggcuugaguggaugggaggguucgacccggaagauggcgagcgcauuuaugcgcagaaauuucaagggagaguuacgaugaccgaagacacaucuaccgauacagcuuacauggagcugaacagccuccgguccgacgauaccgccguguauuacugugccacaggaggccuguauugcucuagcaucuccuguauuauggacgucuggggccaggggaccacggugaccguuagcucugcuuccacaaaggga

SEQ ID NO: 42577 - RNA, 384 nt, Artificial Sequence
  derived and/or modified sequence opt5 from anti-HIV_Chain
caggugcaacugguccagagcggcgccgagguuaagaugcccggggcuuccgugaaagugucuugcaaggucagcggauacucccucaccgaacugucuauccacugggugagacaggccccuggcaaacggcuugaguggaugggaggguucgacccggaagaugacgagcgcauuuaugcgcagaaguuucaagauagaguuacaaugacggaagacaccagcacagauaccgcuuacauggaccugaacucccuccggucugaggauacagccguguauuacuguaccacaggcgggcuguauugcagcuccaucagcuguauuauggacgucuggggacagggcaccacggugaucguuucuuccgccagcaccaaaggc

SEQ ID NO: 42578 - RNA, 387 nt, Artificial Sequence
  derived and/or modified sequence opt5 from anti-HIV_Chain
gaggugcagcugagcgaauccggcgggggauucgucaagcccggcgggucucucagacugagcugcgaggccuccggauuuaccuucaacaauuacgcuaugucuuggguucggcaagccccuggcaaagggcuugaaugggugagcgugacauccgcgcacggaggcucugcuuauuacggcgaguuugucaaggggcgcuucacgaugagcagagaccauuuuaucgauaccguguaucuggaaaugaacggacucacaguugaggacaccgccguguacuauuguguccgggugacauucuaccacgagggcuccggguauuacuaccgcgccggaaauuauuuugauagcuggggcaaagggaccagaguuguggucucugcu

SEQ ID NO: 42579 - RNA, 387 nt, Artificial Sequence
  derived and/or modified sequence opt5 from anti-HIV_Chain
gaggugcagcugagcgaauccggcgggggauucgucaagcccggcgggucucucagacugagcugcgaggccuccggauuuaccuucaacaauuacgcuaugucuuggguucggcaagccccuggcaaagggcuugaaugggugagcgugacauccgcgcacggaggcucugcuuauuacggcgaguuugucaaggggcgcuucacgaugagcagagaccauuuuaucgauaccguguaucuggaaaugaaccggcucacaguugaggacaccgccguguacuauuguguccgcgugacauucuaccacgagggauccggcuauuacuacagagccgggaauuauuuugauagcuggggaaaaggcacccggguuguggucucugcu

SEQ ID NO: 42580 - RNA, 387 nt, Artificial Sequence
  derived and/or modified sequence opt5 from anti-HIV_Chain
gaggugcagcugagcgaauccggcgggggagucguuaagcccggcgggucucucagacugagcugcgaggccuccggauucaccuuuucuaacuacgcuaugagcugggugcggcaagccccuggcaaagggcuugaauggguguccgucacaggaggccacggcacguauggguacuauggagaguucgugaagggccgcuuuaccaucucuagagaccauagcauggauacaguuuaccugcagaugaaucggcuccgcguggaagacaccgcggucuauuacugugugagaacaccguauuaccacgaguccagcggguacuauuaccgggcuggaaacuauuucgauuuuuggggcaaagggacccugguuauugugucugcc

SEQ ID NO: 42581 - RNA, 387 nt, Artificial Sequence
  derived and/or modified sequence opt5 from anti-HIV_Chain
gaggugcagcugagcgaauccggcgggggauucgucaagcccggcgggucucucagacugagcugcgaggccuccggauuuaccuucaacaauuacgcuaugggcuggguucggcaagccccugggaaaggacuugaaugggugucugugacaagcgcgcacggcggcuccgcuuauuuuggggaguucgucaagggacgcuuuacgaugucuagagaccauuucaucgauaccguguaccuggaaaugaaccggcucacaguugaggacaccgccguguauuacuguguccgcgugacauuuuaucacgagggcagcggguacuauuacagagccggaaauuacuucgauuccuggggccaggggacccugguuauugugagcgcu

SEQ ID NO: 42582 - RNA, 387 nt, Artificial Sequence
  derived and/or modified sequence opt5 from anti-HIV_Chain
caggugcaacuggucgagagcggcgggggacucguucagcccggcgggucccugagacuuucuugcgccgcuagcggauucaccuuuuccacacacuggaugcauugggugcggcaggccccuggcaaggggcuggugugggucucucgcauccacagcgacggaagauccacgucuuacgcggauagcgugaaaggccgguucaccauuucccgcgacaacgcuaagaauacacucuaucugcagaugaacagccuuagagccgaagauaccgccguuuacuauugugcucggggcgccgcuguguuuggggucgugaucauuggaggcauggaccugugggggcaaggaacaaccguuacagugucuuccgccagcaccaaaggc

SEQ ID NO: 42583 - RNA, 387 nt, Artificial Sequence
  derived and/or modified sequence opt5 from anti-HIV_Chain
caggugcaacuggucgaaagcggcggggcccucguucagcccggaggcucccugagacuuucuugcgcugccagcggguucuccuuuucuagcuacgcgauguccugggugcggcaggcuccuggaaagggccuggaaugggugucugccaucagccgcuccgggggaagcaccuauuacgccgacucugucaaaggcagauucacaauuuccaucgauaauagcaauaacacgcucuaucugcagaugaacucucuucggguggaggacaccgcuguuuacuauugugccaagcgcgaggcuuuuuacuauggcgccgggggauacggcauggaugugugggggcaaggaacaaccgucacaguguccagcgcgucuaccaaaggc

SEQ ID NO: 42584 - RNA, 387 nt, Artificial Sequence
  derived and/or modified sequence opt5 from anti-HIV_Chain
uuccagggccaccuggugcaaagcgggggaggcgucaagaaacccgggaccuccguuacacucucuugccuggccagcgaguacacguuuaccgaguucacaauccauuggauuagacaggcuccuggacagggcccgcuuuggcuggggcucaucaagcgguccggacgccugaugaccucuuauagauuucaggaccggcuuagccugcgcagagaucgguccacaggcaccguguucauggaacuccgcucucugagaacagacgauaccgccguguacuauugugcgcgggacggccugggggaacucgcucccgccuaccacuauggaauugaugccuggggccaagggacgaccgucaucgugacaagcgcuuccaccagc

SEQ ID NO: 42585 - RNA, 387 nt, Artificial Sequence
  derived and/or modified sequence opt5 from anti-HIV_Chain
cagggccugcucgugcaaagcgggggaggcgucaagaaacuggggaccuccguuacaaucucuugccuugccagcgaguacacguucaacgaauuugugauucacuggaucagacaggcucccggacagggcccucuguggcucgggcugauuaagcgguccggacgccuuaugaccucuuaucaguuccaagacagacugagccuccggcgcgauagauccacaggcaccguguuuauggagcugcggggccugcgcgucgacgauacagccguguacuauugugcgagagacgggcucggagaaguugcuccggccuaccuguauggcaucgaugccugggggcagggaaccacagugauugucaccucugcuagcacgaaaggc

SEQ ID NO: 42586 - RNA, 387 nt, Artificial Sequence
  derived and/or modified sequence opt5 from anti-HIV_Chain
aacuucaugcugacccagcccgccagcguguccggcucuccugggcaaagcaucacaauuuccugcucuggaacgggcagcgacaucggggucuacaauuauguuuccugguaccagcagcacccgggaaaggcucccagacucaugauuuaugaugugaccaaccggccuucuggcgugagcaaucgcuucuccgggagcaaaucuggauucacagccucccugaccaucagcggccuucagggcgacgaugaggcggacuacuauuguucuuccuacagcucuacaaacaccuaugucuuugggacaggaacccaugugacgguucugggccaacccaaggcuaauccuaccgugacacucuuucccccuuccagcgaggaacug

SEQ ID NO: 42587 - RNA, 387 nt, Artificial Sequence
  derived and/or modified sequence opt5 from anti-HIV_Chain
cagagcgcccugacccaacccagauccgugucuggcagcccugggcaguccgucacaaucucuugcacgggaaccagcuccgacguuggcgcuuacaacuaugugucuugguaccggcagcacccggggaaggcccccaaacucaugauuaaugaugugagcaagcgcccuuccggaguccccgacagauucagcggcucuaaauccgggaacacagcgagccugaccaucucuggacuucaggcugaggaugaagccgacuauuacuguugcuccuaugccggcacauacagcuauguguuuggcaccgggacaaagguuaccgugcugggacaaccuaaagcuaaucccacggucacccucuucccuccgucuuccgaggaacug

SEQ ID NO: 42588 - RNA, 387 nt, Artificial Sequence
  derived and/or modified sequence opt5 from anti-HIV_Chain
cagggccaacuggugcagagcgggggaggccucaagaaacccgggaccuccgucacaaucucuugccuggccagcgaguacacguucaacgaauuuguuauucacuggaucagacaggcuccuggacagggcccgcuuuggcuggggcucauuaagcgguccggacgccugaugaccgccuauaauuuccaagacagacuuucucugcggcgcgauagaagcacaggcaccguguuuauggagcuccggggccugcgccccgacgauacagcgguguacuauugugcuagagacgggcugggagaagucgccccugauuaccgguauggcaucgacgugugggggcagggauccaccguuauugugacagccgcuucuaccaaaggc

SEQ ID NO: 42589 - RNA, 387 nt, Artificial Sequence
  derived and/or modified sequence opt5 from anti-HIV_Chain
aacuucaugcugacccagcccccuagcgccuccggcgcuccggggcaaagagugacaaucucuugcagcggaggccccuccaaugucgggggaaacuacguuuauugguaccggcaguuuccuggcacggcccccaaucuccugauucuucgcgacgaucagagaccuucuggggugcccgaccgguucagcgcguccaagucuggaaacagcgcuucccuggccaucagcggccuccgcccugaugacgaggccuuuuauuucugugcuaccuacgauucugacggcuccauuagacuguuugggggaggcacaacccuuacagugcugagccagccgaaagccgcucccucugucacccucuucccucccuccagcgaggaacug

SEQ ID NO: 42590 - RNA, 387 nt, Artificial Sequence
  derived and/or modified sequence opt5 from anti-HIV_Chain
cagcuggugcucacccaacccccuagcgucuccggcgccccggggcagagaguuacaaucucuugcagcggaggccccuccaacgucgggggaaaucugguguacugguauaagcaguucccuggcacggcucccaaacuucugauucggcgcgacgaucagagaccuucuggggugcccgaccgguuuagcggauccaagucuggcaacagcgccucccucaccaucagcggccugcgcccugaugacgaggcguucuacuuuugugcuacauaugauucucaaggguccaccagacuuuucggaggcgggacagugcugaccguucucagccagccgaaagccgcccccucugugacacuguuuccucccuccagcgaggaacug

SEQ ID NO: 42591 - RNA, 387 nt, Artificial Sequence
  derived and/or modified sequence opt5 from anti-HIV_Chain
aacuucaugcugacccagcccccuagcguguccggcgccccggggcaaagagucacaaucucuugcagcggaggccccuccaauguugggggaaaccucguguacugguauaagcaguuuccuggcacggcucccaaacugcuuauucggcgcgacgaucagagaccuucuggggugcccgaccgguucagcggauccaagucuggcaauagcgccucccuggcgaucagcggccuccgcccugaugacgaggcuuuuuacuucugugccaccuaugauucucacggguccauuagacuguuuggaggcgggacacuucugaccguccucagccagccgaaagccgcucccucugugacacuguucccucccuccagcgaggaacug

SEQ ID NO: 42592 - RNA, 387 nt, Artificial Sequence
  derived and/or modified sequence opt5 from anti-HIV_Chain
cagagcgcccugaccagaacacccuccgugucuggcgcuccugggcaacgggucacgaucagcugcuccggaggcccgucuaacguugggggaaauuacguguauugguaccagcaguuccccggcgccgcgccuaagcuccugauucgcagagacgaucagcggcccagcggggugccugaccgcuuuuccggaucuaaaagcggcaacuccgcuagccuugccaucucuggccugagacucgaugacgaggccuauuacuucugugcuaccuaugauuccggguggagcauucggcuguuuggaggcgggacacgccuuaccguccugucucaacccaaggccgcuccuuccgugacacucuucccgcccagcucugaggaacug

SEQ ID NO: 42593 - RNA, 387 nt, Artificial Sequence
  derived and/or modified sequence opt5 from anti-HIV_Chain
cagagcgcccugacccaacccccuuccgugucugcuacaccgggccagacggucaccaucagcugcuccgggucuggaagcaacguuggcgggaaucacguguacugguauagacagcuccccggagccgcgccuacacugcuuauuuccaagaccgaccaucggcccucucgcgugccugauagauucagcgcuuccaaaagcggcaacucugccucccuggccaucagcgggcuccggcccgacgaugaggcuauuuacuuuugugccacauaugacaccggacugucucuucgccuguucggcggcgggacaagacucaccguccugucccagccuaaggcugccccgagcgugacgcuguuucccccuucuuccgaggaacuc

SEQ ID NO: 42594 - RNA, 387 nt, Artificial Sequence
  derived and/or modified sequence opt5 from anti-HIV_Chain
caggugcaacugcucgagagcggccccgggcuggucaccccuuccggaacacuuucucuggccugcgcuguuagcggcgccuccaucucuagcucccacugguggacgugggugagacagucuccggggaagggacucgaauggauuggcgagaucgaccggcgcgggaccacaaacuacaaucccagccugagaucccgggugaccauucuucuggauaacagcaaaaaucaguucucucucucccugcgcagcgucacagcggcugacaccgccguguauuacuguacaaagguuuaugccggacuguuuaacgaaagaaccuacggcauggauguguggggccaugggacgaccguccucgugucuuccgcuagcacaaaagga

SEQ ID NO: 42595 - RNA, 387 nt, Artificial Sequence
  derived and/or modified sequence opt5 from anti-HIV_Chain
caggccguggucacccaacccccuagcguuuccgcuacaccgggccagacggugaccaucucuugcagcggguccggaucuaacgugggcgggaaucacgucuacugguauagacagcugcccggagccgcgccuacacuccugauuagcaagaccaaccggcgccccucccaggugccugacagauucucuggcagcaaauccgggaauagcgcuucucuugccaucuccggacugcggcccgaugacgaggccgauuacuuuugugcuacauaugacaccgaucucagccugcgccuuuucggcggcgggacaagacugaccguucucucucaaccuaaggccgcuccguccgugacgcuguuucccccuagcucugaggaacug

SEQ ID NO: 42596 - RNA, 387 nt, Artificial Sequence
  derived and/or modified sequence opt5 from anti-HIV_Chain
cagagcgcccugacccaacccccuuccgugucuggcacaccggggcagaacgucacgaucagcugcuccggaggcgggucugacguuggaggcaaucucgugagcugguaccagcacuuccccggggcugccccuaagcugcuuauucauagagauaaccagcggcccuccggagugccugaccgcuuuucugcgcugaaaagcggcaauuccgcuagccucgccaucucuggccugagauccgaugacgaggccuucuauuuuugugcugucuacgauagcucucuuucccugggacucuucgggggcgggaccaagcugacagugcugagccaacccaaagccgcuccuucuguuacccucuuuccgcccuccagcgaggaacug

SEQ ID NO: 42597 - RNA, 387 nt, Artificial Sequence
  derived and/or modified sequence opt5 from anti-HIV_Chain
cagagcgcccugacccaacccccuuccgcuucuggcacaccggggcagagagugacgaucagcugcuccggaggcgggucuaacauuggaggcaaucucgucagcugguaccagcacuuccccgggaccgccccuaagcugcuuaucuaucggaacgaccagcgccccuccggaguuccugauagauuuucuggcagcaaauccggcacaagcgcgucucugaccauuuccgggcuccggagcgacgaugaggcuacauacuucugugccgccuaugacucuucccugagccuucgccuguuuggaggcgggaccacacucaaugugcugucucaacccaaggcugccccuuccgugacccuguucccgcccagcuccgaggaacuc

SEQ ID NO: 42598 - RNA, 387 nt, Artificial Sequence
  derived and/or modified sequence opt5 from anti-HIV_Chain
cagagcgcccugacccaacccccuuccgugucugcuacaccgggccagacggucaccaucagcugcuccgggucuggaagcaacguuggcgggaaucacguguacugguauagacagcuccccggagccgcgccuacacugcuuauuuccaagaccaaccaucggcccucucaggugccugaccgcuucagcgcuuccaaaagcggcaauucugccucccuggccaucagcgggcucagacccgaugacgaggcugauuacuuuuguggaacauaugacaccucucugucccuucggcuguucggcggcgggacacgccucaccguccugagccaaccuaaggccgcuccgucugugacgcuguuucccccuuccagcgaggaacuc

SEQ ID NO: 42599 - RNA, 387 nt, Artificial Sequence
  derived and/or modified sequence opt5 from anti-HIV_Chain
cagagcgugcugacccaaguccucuccguuucuggcacacccgggcagagagugaucauuagcugcuccggaacgucuagcaacgugggcgggaaucuggucuccugguaccagcaccuuccuggagccgcuccgcggcugcucauccaucgcgacgaucagagacccucuggcgugccugaccgguucagcggguccaagagcggaaacucugccucccugguuauuagcggccuucgcucugaugacgaggcggauuauuuuuguggcgcuuacgacuccaccuucagccugcccguguuugggggaggcacaagacucaccguccugucucaaccuaaagccgcccccuccgugacacuguucccuccgagcuccgaggaacuc

SEQ ID NO: 42600 - RNA, 387 nt, Artificial Sequence
  derived and/or modified sequence opt5 from anti-HIV_Chain
cagagcgcccugacccaacccccugcuacauccggcacgccggggcagagagugaccaucucuugcagcggaggcggguccaacgucggaggcaaucucguuucuugguaccagcaguuccccggggccgcgccuaagcugauucuucaccgggacggacaacgccccagcggcgugccugauagauuuuccgcuucuaaaagcggcacauccgccagccugaccaucucugggcuccgguccgacgaugaggccacauauuucugugcugccuuugacagcgcucugucucuuccccuguucggaggcgggaccaagcucacagugcugucccagccuaaagccgcgccgagcgucacccuguuucccccuucuuccgaggaacuc

SEQ ID NO: 42601 - RNA, 387 nt, Artificial Sequence
  derived and/or modified sequence opt5 from anti-HIV_Chain
cagcuggugcucacccaacccccuagcgucuccgccacaccgggccagacgguuaccaucucuugcagcggguccggaucuaacgugggcgggaaucacguguacugguauagacagcugcccggagcugccccuacacuugucauuagcaagaccgaccaucggcccucccgcgugccugauagauucucuggcagcaaauccgggaacagcgcgucucuggcuaucuccggacuccggcccgacgaugaggccgccuacuuuugugcuacauaugacaccggccugagccuucgccuguucggcgggggaacaagacucgccguucugucucagccuaaggcugccccguccgugacccuguuucccccuagcucugaggaacuc

SEQ ID NO: 42602 - RNA, 387 nt, Artificial Sequence
  derived and/or modified sequence opt5 from anti-HIV_Chain
cagagcgcccugacccaacccccuuccgugucuggcacaccggggcagaacgucacgaucagcugcuccggaggcgggucuaauguuggaggcaaccucgugagcugguaccagcacuuccccggggcugccccuaagcugcuuauucauagagacaaucagcggcccuccggagugccugaucgcuuuucuguccugaaaagcggcaacuccgcgagccucgcuaucucuggccccagauccgacgaugaggccuucuauuuuugugccguguacgacagcucucugucccuugggcuguucggaggcgggaccaagcucacaguucugagccaaccuaaagcugccccgucugugacccuguuucccccuuccagcgaggaacuc

SEQ ID NO: 42603 - RNA, 387 nt, Artificial Sequence
  derived and/or modified sequence opt5 from anti-HIV_Chain
cagaccguggucacacaacccccuagcgccuccggcacgccggggcagagaguuaccaucucuugcagcggaggcggguccaacauuggaggcaaucuggugucuugguaccagcacuuccccggggcugccccuaagcuccugaucuaucggaacgaccagcgccccagcggagugccugauagauuuuccggcucuaaaagcggcacauccgcgagccuuaccauuucugggcugcgguccgacgaugaggcuacauacuucugugccgccuaugacugcacccucagccugcgccuuuuuggaggcgggacaacccugaauguccucucucaacccaaggcugccccuuccgugacgcuguucccgcccagcucugaggaacug

SEQ ID NO: 42604 - RNA, 387 nt, Artificial Sequence
  derived and/or modified sequence opt5 from anti-HIV_Chain
cagagcgcccugacccaaacacccuccgugucuggcgcuccugggcagagagucacgaucagcugcuccggaggcccgucuaacguugggggaaauuacguguauugguaccagcaguuccccggcgccgcgccuaagcuccugauucggcgcgacgaucaaagacccagcggggugccugaccgguuuuccggaucuaaaagcggcaacuccgcuagccuugccaucucuggccugcgccucgaugacgaggccuauuacuucugugcuaccuaugauuccggguggagcauuagacuguuuggaggcgggacacggcuuaccguccugucucagcccaaggccgcuccuuccgugacacucuucccgcccagcucugaggaacug

SEQ ID NO: 42605 - RNA, 387 nt, Artificial Sequence
  derived and/or modified sequence opt5 from anti-HIV_Chain
cagagcgugcugacccaacccccuuccgccucuggcgcuccggggcagagagucacaaucagcugcuccggaggccccucuaacguugggggaaauuacguguauugguaccggcaguucccuggcacggcccccaaccuccugauucuucgcgacgaucagagaccuagcggggugcccgaccgguuuuccgcgucuaagagcggaaauuccgcuagccuggccaucucuggccuccgcccugaugacgaggccuucuauuuuugugcuaccuacgauuccgacggcagcgucagacuguucgggggaggcacaacccuuacagugcugucucaaccgaaagccgcucccuccguuacccucuuuccucccagcaacgggggacgg

SEQ ID NO: 42606 - RNA, 387 nt, Artificial Sequence
  derived and/or modified sequence opt5 from anti-HIV_Chain
cagggccaacuggugcagagcgggggaggcgucaagaaacccgggaccuccguuacaaucucuugccucgccagcgaguacacguucaacgaauuugugauucacuggaucagacaggcuccuggacagggcccgcuguggcuugggcugauuaagcgguccggacgccucaugaccucuuauaaauuccaagacagacugaaucuucggcgcgauagaagcacaggcaccguguuuauggagcugcggggccuccgccccgacgauacagccgucuacuauugugcgagagacgggcugggagaaguggcuccugauuaccgguauggcaucgacguuugggggcagggauccaccgugauugucacagccgccucuaccaagggc

SEQ ID NO: 42607 - RNA, 387 nt, Artificial Sequence
  derived and/or modified sequence opt5 from anti-HIV_Chain
gaggugcagcuggucgaaagcggcgccgagguuaagaaacccggggcuuccgugaagguggccugcaaagucucuggaaagaaacucagcgaccuguccauccacugggugagacaagcgccuggcaaggggcuugaauggaugggaggcuucgaugaggaagacgggaagauuucuuacgagcggaaauuucagggacgcguuaccaugacagaggauacggcuagagacaccgccuucauggaaaugagcucccugcggucugaugacacagccguguauuuuugugcugccgcuccgcgccucgaucugggcgagcuuagcuccggcuuccauuuuugggggcugggaacccucgucagcgugucuuccgccagcacaaagggc

SEQ ID NO: 42608 - RNA, 387 nt, Artificial Sequence
  derived and/or modified sequence opt5 from anti-HIV_Chain
cagggccaacuggugcagagcgggggaggcgggaagaaacucggaaccuccgucacaaucucuugccuggccagcgaguacacguucaacgaauuuguuauucacuggaucagacaggcucccggccaggggccucuuuggcugggacucauuaagcgguccggccgccugaugaccucuuaucaauuccaggacagacuuagccugcggcgcgauagauccacaggcaccguguuuauggagcuccgggggcugcgcguggacgauacagccgucuacuauugugcgagagacggacugggcgaaguggcuccggccuaccucuaugggaucgaugccuggggacagggcaccacaguuauugugucuagcgcuuccaccaaaggg

SEQ ID NO: 42609 - RNA, 387 nt, Artificial Sequence
  derived and/or modified sequence opt5 from anti-HIV_Chain
gaggugcagcuggucgaaagcggcgccgagguuaagaaacccggggcuuccgugaaggugucuugcaaagucagcggauacacccucuccgaccugucuaugcacugggugagacaagccccuggcaaggggcuugaauggaugggaggcuucgaugaggaagacggggagaucacauaugcgcagaaauuucagggacggguuagcaugacggaggauaccucccgcgacacagcuuacauggaacugucuagccucagauccgaggauaccgccguguauuacugugccacagcuccgcggcuggaacuuggcgagcugagcucuggcuuccauuauugggggcucggaacccuggucacaguguccagcgccucuaccaagggc

SEQ ID NO: 42610 - RNA, 387 nt, Artificial Sequence
  derived and/or modified sequence opt5 from anti-HIV_Chain
cagggccaacuggugcagagcgggggaggcgucaagaaaaccgggacauccguuacgaucucuugccucgccagcgaguacaccuucacagaauuuaccauucacuggaucagacaggcucccggacagggcccucuguggcuugggcugauuaagcgguccggacgccucaugacagccaacagauuccaagaccggcugucucuucgcagagaucggagcaccggcacaguguuuauggagcugcgcucccucagaaucgacgauaccgcgguguauuacugugcucgggacggccugggggaacuggccccggccuaucauuacggaauugaugucuggggccaggggacgaccaucaucgugacaucugcuagcaccaaagga

SEQ ID NO: 42611 - RNA, 387 nt, Artificial Sequence
  derived and/or modified sequence opt5 from anti-HIV_Chain
cagggccaacuggugcagagcgggggaggcgucaagaaacucgggaccuccguuacaaucucuugccuggccagcgaguacacguucaacgaauuugugauucacuggaucagacaggcucccggacagggcccucuuuggcuggggcucauuaagcgguccggacgccugaugaccucuuaucaauuccaggacagacuuagccugcggcgcgauagauccacaggcaccguguuuauggagcuccggggccugcgcgucgacgauacagccguguacuauugugcgagagacgggcugggagaaguugcuccggccuaccucuauggcaucgaugccugggggcagggaaccacagugauugucaccucugcuagcacgaaaggc

SEQ ID NO: 42612 - RNA, 387 nt, Artificial Sequence
  derived and/or modified sequence opt5 from anti-HIV_Chain
cagggccaacuggugcagagcgggggaggcgucaagaaacucgggaccuccguuacaauccccugccuggccucugaguacacguucaacgaauuugugauucacuggaucagacaggcuccuggacagggcccgcuuuggcuggggcucauuaagcggagcggacgccugaugaccuccuaucaauuccaggacagacuuucucugcggcgcgauagaagcacaggcaccguguuuauggagcuccggggccugcgcgucgacgauacagccguguacuauugugcgagagacgggcugggagaaguugcucccgccuaccucuauggcaucgaugccugggggcagggaaccacagugauugucaccuccgcuucuacgaaaggc

SEQ ID NO: 42613 - RNA, 387 nt, Artificial Sequence
  derived and/or modified sequence opt5 from anti-HIV_Chain
cagggccaacuggugcagagcgggggaggcgucaagaaacccgggaccuccguuacaaucucuugccucgccagcgaguacacguucaacgaauuugugauucacuggaucagacaggcuccuggacagggcccgguguggcuggggcuuauuaagcgguccggacgccugaugaccucuuauaaauuccaagacagacucagccugcggcgcgauagauccacaggcaccgucuuuauggagcuucggggccugcgccucgacgauacagccguguacuauugugcgagagacgggcugggagaaguugcucccgccuaccuguauggcaucgaugccugggggcagggaucuaaggugauugucaccccugcuagcacaaaaggc

SEQ ID NO: 42614 - RNA, 387 nt, Artificial Sequence
  derived and/or modified sequence opt5 from anti-HIV_Chain
caggccagacuggaccaauggggcaccgggcuccugaagcccagcgagacacuuucccugaaaugcgcuguguucggaguccucuuuacggauuacaacuggaccuggguucggcagucuccuggcaaggaacuggaguggaucgggcaccuugaccaucgcggaggcgggaauuauaacccgagccuggaauccagagugacaauuucucucgauuacagcaaagcccaguucucccugcaccugaagucugugaccgucgcggacacagcucgguauuacugugccggagccgugaaaggcuuuugguucgaugaccccuauaccugguuuggcccuuggagccaggggacacucguuaccguggcuuccgccagcacgaaggga

SEQ ID NO: 42615 - RNA, 387 nt, Artificial Sequence
  derived and/or modified sequence opt5 from anti-HIV_Chain
caggccagacuggaccaauggggcaccgggcuccugaagcccagcgagacacuuucccugaaaugcgcuguguucggaguccucuuuacggauuacaacuggaccuggguucggcagucuccuggcaaggggcuggaauggaucggacaccuugaccaucgcggcgggggaagcuauaauccgucccuggagucuagagugagcauuucccucgauuacucuaaagcccaguucagccugcaccugaaguccgugacagucgcggacaccgcucucuauuacugugccggcgccgugaaaggcuuuugguucgaugaacccagcacaugguuugggccuuggucucagggaaccaugguuacaguggcuuccgccagcaccaagggc

SEQ ID NO: 42616 - RNA, 387 nt, Artificial Sequence
  derived and/or modified sequence opt5 from anti-HIV_Chain
cagggccaccuggugcaaagcgggggaggcgucaagaaacucgggaccuccguuacaaucucuugccuggccagcgaggacacguucaacgaauuugugauucauuggaucagacaggcucccggacagggcccucuuuggcuggggcucauuaagcgguccggacgccugaugaccucuuaccaguuccaagauagacuuagccugcggcgcgacagauccacaggcaccguguuuauggagcuccggggccugcgcgucgaugacacagccguguauuacugugcgagagaugggcugggagaaguugcuccggccuaucucuacggcaucgacgccugggggcagggaaccacagugauugucaccucugcuagcacgaaaggc

SEQ ID NO: 42617 - RNA, 387 nt, Artificial Sequence
  derived and/or modified sequence opt5 from anti-HIV_Chain
caggugcaacugguccagagcgaggccgaaguuaagaaacccggcuccucugugaaggugagcugcaaggcuuccgggggaaccuucagaggcuacacaaucucuuggguccggcaggccccugggcagggacucgaguggaugggccgcauuaucccgauucuggggaaagcgaucuaugcucccagcuuucaaggaagagugacgcuuaccgccgacaaauccacaggcaccgccuacauggaacugucucggcuccgcagcgaugacacagcuguuuauuacugugccaaggugaagaugagaggcuccagcggguauuacuaucuguucgaugacuggggacagggcacccuugucacagugucuuccgcuagcaccaaaggg

SEQ ID NO: 42618 - RNA, 387 nt, Artificial Sequence
  derived and/or modified sequence opt5 from anti-HIV_Chain
caggccagacuggaccaauggggcaccgggcuccugaagcccagcgagacacuuucccugaaaugcgcuguguucggaguccucuuuacggauuacaacuggaccuggguucggcagucuccuggcaaggggcuggaauggaucggacaccuugaccaucgcggcgggggaaauuauaacccgagccuggaguccagagugacaauuucucucgauuacagcaaagcccaguucucccugcaccugaagucugugaccgucgcggacacagcucucuauuacugugccggcgccgugaaaggcuuuugguucgaugaaguuuauaauugguuugggcccuggagccagggaacccuggugacagucgcuuccgccagcaccaagggc

SEQ ID NO: 42619 - RNA, 387 nt, Artificial Sequence
  derived and/or modified sequence opt5 from anti-HIV_Chain
cagggccaacuggugcagagcgggggaggcgucaagaaacccgggaccuccguuacaaucucuugccucgccagcgaguacacguucaccgaauuuacaauucacuggaucagacaggcuccuggacagggcccgcuguggcuugggcugauuaagcgguccggacgccucaugaccgccuauagauuccaagaccggcugucucuucgcagagaucggagcacaggcaccguguuuauggagcugcgcaaccucagaauggacgauacagcgguguacuauugugcucgggacggccugggggaacuggcccccgccuaccaguauggaaucgaugucuggggccaggggaccacggugauuguuuccucugcuagcaccaaagga

SEQ ID NO: 42620 - RNA, 387 nt, Artificial Sequence
  derived and/or modified sequence opt5 from anti-HIV_Chain
caggugagacugguccaaagcggcccccagguuaagcggccuggggccuccauccgccucucuugcgagagcuccggauacagauuccaggacuauauuguggcuuggauccggcagacccgcggccaaggguuugaguucgugggaauggucaacccgagaggcgggcggcccuggccuucuagccgcuuuagagaucgggugacacugacgcgcgacauugaauccgaaaccuucuaccuuggacugaaugaucucacaucugacgauaccgccacauauuuuugugcgagacuggaggcugacggcagcgauuacucccccaaaauguucgacuuuuggggccaggggaccaagaucguugugagcccugccucuacaaaagga

SEQ ID NO: 42621 - RNA, 387 nt, Artificial Sequence
  derived and/or modified sequence opt5 from anti-HIV_Chain
caggugagacugguccaaagcggcccccagguuaagaccccuggggccuccaugcgggugucuugcgaggcuagcggauaccgcuuccucgacuauaucauuguguggaucagacagacacacggccagcauuuugaauacgucgggaugauuaacccgcggggaggcacgcccuggccuuccucuaaauuccgcgauagacugagccuuacccgggacauccacacagauaccuuuuaucuggggcucaauaaccugggauccgacgauacagccauuuacuucugugcgcgccuugaggcugacggcgaugacuauucucccaagauguuugaucauuggggccaagggaccagaaucaucgugagcgccgccuccacaaaagga

SEQ ID NO: 42622 - RNA, 387 nt, Artificial Sequence
  derived and/or modified sequence opt5 from anti-HIV_Chain
caggugagacugguccaaagcggcccccagguuaagaccccuggggccuccauccggcucucuugcgaggcuagcggauaccgcuuccuggacuauuuuauugugugggugagacagacaccgggccagggguucgaauacgucggaaugaucaacccccggggcgggcgcccuugguccucuuggaaauuuagagaucggcuuagccugacgcgcgagauugacaccgauacauucuaucucggacuguccaaucuuagaucugacgauaccgccaucuacuuuugugcgcggcuggaagcugacggcgaugacuauagccccaagaugguggauuacuggggccaagggacaaaaauuaucguuuccgccgccagcaccaaggga

SEQ ID NO: 42623 - RNA, 387 nt, Artificial Sequence
  derived and/or modified sequence opt5 from anti-HIV_Chain
caggugagacugguccaaagcggcccccagguuaagcggccuggggccuccauccgccucucuugcgagaccagcggauacagauuccaggacuauauuguggcuuggauccggcagacacgcggccaaagauuugaguucguggggauggucaacccgcggggaggccgccccuggccuuccucuaaauuuagagaucgggugacgcugacccgcgacauugaaagcgaaacauuccaccuugggcugaaugaucucaccuccgacgauacagccaccuacuuuugugcgagacuggaggcugacggagccgauuauucucccaagauguucgacuuuuggggccagggcacaaaaaucguugugagcccugccuccaccaagggg

SEQ ID NO: 42624 - RNA, 387 nt, Artificial Sequence
  derived and/or modified sequence opt5 from anti-HIV_Chain
caggugagacugguccaaagcggcccccagguuaagaccccuggggccuccaugcggaucucuugcgaggcuagcggauaccgcuuccaggacuauauuaucguguggauuagacagacacacggccaaggguuugaauacgugggaaugaucaacccgcggggcgggacgcccugguccucuagcaaauuccgcgauagacucucccugacccgggacauuuauacagauaccuuuuaccuuggacugaauaaccucggcucugacgauacagccaucuauuucugugcgcgccuggaggcugacggcggggauuacagcccuaagauguuugacuauuggggacagggcaccagaaucauugucuccgccgccagcacaaaaggg

SEQ ID NO: 42625 - RNA, 387 nt, Artificial Sequence
  derived and/or modified sequence opt5 from anti-HIV_Chain
cagggccaacuggugcagagcgggggaggcgucaagaaacccggggccuccguuaccaucucuugccucgcuagcgaguacacauucaacgaauuugugauucacuggaucagacaggccccuggacagggcccgcuguggcuugggcugauuaagcgguccggacgccucaugacggcguauaaauuccaagacagacugucucuucggcgcgauagaagcaccggcacaguguuuauggagcugcggggccuccgccccgaagacaccgcugucuacuauugugccagagaugggcugggagagguggccccugacuaccgguauggcaucgauguuugggggcagggauccacagugauugucucugcugccagcaccaagggc

SEQ ID NO: 42626 - RNA, 387 nt, Artificial Sequence
  derived and/or modified sequence opt5 from anti-HIV_Chain
caggugagacugguccaaagcggcccccagaugaagaccccuggggccucccuccggcugucuugcgagguuagcggauaccgcuuccuugacuauuuuaucgugugggugagacagacaggcgggcagggauucgaauacgucggcaugauuaacccgcgcgggggacggcccugguccucuuggaaauuuagagaucggcugagccucacgcgcgacaucgagaccgauacauucuaucugggccuuaauaaccugagauccgacgauaccgcuauuuacuuuugugcccggcucgaagcggacggcgauaauuauucuccuaagaugguggacuacugggggcaaggaacaaaaaucauuguuagccccgcuuccaccaagggc

SEQ ID NO: 42627 - RNA, 387 nt, Artificial Sequence
  derived and/or modified sequence opt5 from anti-HIV_Chain
caggugagccugguccaauccggcccccagguuaagaccccuggggccucuaugagagugagcugcgagacauccggauaccgguuccucgacuauaucauuguguggauccgccagacgcacggccagcauuuugaauacgucgggaugauuaacccgagaggaggcacccccuggccuucuagcaaauuccgggaucgccugacaaugaccagagacauccacacagauaccuuuuaucuugggcugaauaaccuccgguccgacgauacagcuauuuacuucugugcccgccuggaggcggacggagaugacuauucucccaagauguuugauuacuggggccaaggcaccagaaucaucgugagcgcugccuccacgaaaggg

SEQ ID NO: 42628 - RNA, 387 nt, Artificial Sequence
  derived and/or modified sequence opt5 from anti-HIV_Chain
caggugagacugguccaaagcggcccccagguuaagaccgccggggcuuccaugcgggugucuugcgaggccagcggauaccgcuuccucgacuauaucauuguguggaucagacagacacacggccagcauuuugaauacgucgggaugauuaacccucggggaggcacgccguggcccuccucuaaauuccgcgauagacugacccuuacacgggacaucuauaccgauacauuuuaccuggggcucaauaaccugggaagcggcgacaccgcgauuuauuucugugcucgccuugaggccgauggcgacgauuacuccccuaagauguuugacuauugggggcaaggaacaagaaucaucgugucugccgcuagcaccaaaggc

SEQ ID NO: 42629 - RNA, 387 nt, Artificial Sequence
  derived and/or modified sequence opt5 from anti-HIV_Chain
cagggccaacuggugcagagcgggggaggcgucaagaaacccgggaccuccguuacaaucucuugccucgccagcgaguacacguucaacgaauuugugauucacuggaucagacaggcuccuggacagggcccgguguggcuggggcuuauuaagcgguccggacgccugaugaccucuuauaaauuccaagacagacucagccugcggcgcgauagauccacaggcaccgucuuuauggagcuucggggccugcgccucgacgauacagccguguacuauugugcgagagacgggcugggagaaguugcucccgccuaccuguauggcaucgaugccugggggcagggaucuaccgugauugucacaagcgcuuccaccaagggc

SEQ ID NO: 42630 - RNA, 387 nt, Artificial Sequence
  derived and/or modified sequence opt5 from anti-HIV_Chain
cagggccaacuggugcagagcgggggaggccucaagaaacccgggaccuccgucacaaucucuugccuggccagcgaguacacguucaacgaauuuguuauucacuggaucagacaggcuccuggacagggcccgcuuuggcuggggcucauuaagcgguccggacgccugaugaccgccuauaauuuccaagacagacuucggcugcgcagagaucggucuacaggcaccguguuuauggagcuccgcggccugagacccgacgauacagcgguguacuauugugcucgggacgggcugggagaagucgccccugauuaccgcuauggcaucgacgugugggggcagggaagcaccguuauugugacagccgcuuccaccaaaggc

SEQ ID NO: 42631 - RNA, 387 nt, Artificial Sequence
  derived and/or modified sequence opt5 from anti-HIV_Chain
cagggccaccuggugcaaagcgggggaggcgucaagaaacucgggaccuccguuacaaucucuugccuggugagcgaguacacguucaacgaauuugugauucauuggaucagacaggcccccggacagggcccucuuuggcuggggcucauuaagcgguccggacgccugaugaccucuuaucaguuccaagacagacuuagccugcggcgcgauagauccacaggcaccgucuuuauggagcuccggggccugcgcguggacgauacagcuguuuacuauugugccagagacgggcugggagaaguggcgccggcuuaccucuauggcaucgaugccugggggcagggaaccacagucauugugaccucugccagcacgaaaggc

SEQ ID NO: 42632 - RNA, 387 nt, Artificial Sequence
  derived and/or modified sequence opt5 from anti-HIV_Chain
cagggccaacuggugcagagcgggggaggcgucaagaaacucgggaccuccguuacaaucucuugccuggccagcgaguacacguucaacgaauuugugauucacuggaucagacaggcucccggacagggcccucuuuggcuggggcucauuaagcgguccggacgccugaugaccucuuaucaauuccaggacagacuuagccugcggcgcgauagauccacaggcaccguguuuauggagcuccggggccugcgcgucgacgauacagccguguacuauugugcgagagacgggcugggagaaguugcuccggccuaccucuauggcaucgaugccugggggcagggaaccacagugauugucucuagcgcuuccaccaaaggc

SEQ ID NO: 42633 - RNA, 387 nt, Artificial Sequence
  derived and/or modified sequence opt5 from anti-HIV_Chain
cagggccaccuggugcaaagcgggggaggcgucaagaaacucgggaccuccguuacaaucucuugccuggccagcgaguacacguucaacgaauuugugauucauuggaucagacaggcucccggacagggcccucuuuggcuggggcucauuaagcgguccggacgccugaugaccucuuaucaguuccaagacagacuuagccugcggcgcgauagauccacaggcaccguguuuauggagcuccggggccugcgcgucgacgauacagccguguacuauugugcgagagacgggcugggagaaguugcuccggccuaccucuauggcaucgaugccugggggcagggaaccacagugauugucaccucugcuagcacgaaaggc

SEQ ID NO: 42634 - RNA, 387 nt, Artificial Sequence
  derived and/or modified sequence opt5 from anti-HIV_Chain
caggugcaacugguccagagcggcuccgagcucaagaaacccggggccucuguuaaggugagcugcaaggcuuccggauacaccuucacaucuuaugccaucaacugggugagacaggcgccuggccaggggcuggaauggaugggauggauuaauacgaacaccggcaauccgacauacgcucaaggguuuaccggacgguucgucuuuagccuugagacauccgugucuaccgccuaucugcagaucaacagccucaaagccgaagacacagcuguuuacuauugugcccgcgaucugcuugaguccagaaccuacuauaaugacauucgggauugcuggggccagggcacgcuggugaccgucagcucugcuuccacaaaaggg

SEQ ID NO: 42635 - RNA, 387 nt, Artificial Sequence
  derived and/or modified sequence opt5 from anti-HIV_Chain
caggugcaacugguccagagcggcgccgagguuaagaaacccggggcuuccgugaaggugucuugcaaagccagcggauacaccuucacagacuauuacauccacugggucagacaggcgccuggccaggggcucgaauggaugggauggauuaacccguccacgggcgggaccaauuuugugcaaaaguuccugggacggguuacaaugaccucugauacaagcaucaacaccgcuuauauggagcuucgcagacugaaaaaugacgaugccgccauuuacuauugugcuacauacuccacccggcaguuuuuccauuauuacuacgugacggacgucuggggccagggcaccacagugaccguuucuagcgccuccacaaagggg

SEQ ID NO: 42636 - RNA, 387 nt, Artificial Sequence
  derived and/or modified sequence opt5 from anti-HIV_Chain
uuccagggccaacuggugcagagcgggggaggcgucaagaaacccggguccucuguuaccaucagcugccucgccuccgaguacacauuuacggaguucaccauucacuggaucagacaggcuccuggacagggcccgcuguggcuugggcugauuaagcggucuggacgccucaugacaagcuauggcuuucaagacagacuguccgugcggcgcgauagaucuaccggcacaguguucauggaacuucggagccugcgcaccgacgauacagccgucuacuauugugcgagagacgggcucggagaacuggcucccgccuaccauuauggcaucgaugugugggggcagggaaccacgguuauugugaccuccgccagcacaucu

SEQ ID NO: 42637 - RNA, 387 nt, Artificial Sequence
  derived and/or modified sequence opt5 from anti-HIV_Chain
caggugcaacuggucgagagcggcgggggaguugugcagcccggcagaucccuccggcugucuugcgccgcuagcggguucaccuuuuccucuuacgccaugcacugggugcgccaggcgccuggaaagggccuugaaugggucgcugugaucagcuaugacggguccaacaaauacuaugccgauucuguuaagggaagauucacaauuagccgggacgauuccaaaagcacgguguaccugcagaucaauucucuccgcgccgcugacaccgccgucuauuuuugugcuagagagggcggccugcgguuccuugaauggcuguuuugggggcaaggaacacucgugaccguuuccagcggcgagucuuccgccagcacaaagggg

SEQ ID NO: 42638 - RNA, 390 nt, Artificial Sequence
  derived and/or modified sequence opt5 from anti-HIV_Chain
caggugcaacugguccagagcggcgccguugugaagucccccgggucuagcgcuaaacucuccugcagacugcuuggagacgaguucggcaccuacuuuaucucuuggauucggcaggccccugggcgcggacuggaaugggugggcgggaucgucccgcacagccagcuccaauccucugcgcagaaguuccauggaagauuuuucauuacaggcggcgugacgcccccuaucauuuuucugcagcuuaccaacguuacauucgaggauaccgggacauauuuuugugcucgggaacgcggaagacaccgggaccccaaaaccggcaagagccugcgcgggagauacuucgauuuuuggggacggggcacaggggugaccgucuccccu

SEQ ID NO: 42639 - RNA, 390 nt, Artificial Sequence
  derived and/or modified sequence opt5 from anti-HIV_Chain
cagaucgagcugagacaaagcggcgccgcuaugaagucccccgggucuagcgugaaacucuccugcaccguccugggagaaaacuucggcacauacuuuauuucuuggauccggcaggccccugggcagggacuugaguggguuggcgggauugugccgcacagccagcugcaauccucugcgcagaaguuccauggacgcaucaaaauuagcggcggcgggacgcccccuguggucucccucgaacugaccaaugugacauuugacgauaccggaacauauuucugugcuagagagcggggccgccacguugaacccaagaccggggacagacuugccggacgguacuuugauaucuggggccgcgggacaggacugagagugagcccu

SEQ ID NO: 42640 - RNA, 390 nt, Artificial Sequence
  derived and/or modified sequence opt5 from anti-HIV_Chain
gaggugcagcuggucgaaagcggcgggggacucguuaagcccggcgggucccugagacuuucuugcgaggccagcggauucaccuuuacaaacgcuuggaugaauugggugcggcaagccccuggcaaagggcuggaaugggugggacgcaucaagucccagacgcacggcggcaccacaagauacgcggcuccggucaaagggcgguucaccauuucucgcgacgauagcaagcauacacucuaucugcagauggacagacuuaccacagaggauaccgccguguacuauuguacgggaaccaucacaggcuccaccuuuuacuauuacgggauggacguuuggggacagggcacaaccgugacggucucucccgccagcacaaaaggg

SEQ ID NO: 42641 - RNA, 390 nt, Artificial Sequence
  derived and/or modified sequence opt5 from anti-HIV_Chain
gugguccagcugguucaaagcggccccgggcucgugaagccuucccagacccugucucuuacaugcacggugagcggaggcuccaucucuagcggggacuucuacugguccuggauuagacagccgcccggaaaaggccuggaguggaucggguauauuuacuauucuggaagcaccuacuauaacccuucccucaagagccggcugacaaucucugucgauaccuccaaaaaucaguuuagccuucgccugucuuccgugacagccgcugacaccgccguuuacuauugugcgagagaucucaacagccggauugugggcgcucuggacgccuucgauaucuggggccaagggacaauggucaccgugucuuccgccagcacgaaggga

SEQ ID NO: 42642 - RNA, 390 nt, Artificial Sequence
  derived and/or modified sequence opt5 from anti-HIV_Chain
gaggugcagcugguccaaagcggcgggggacucguucagcccggcagaucccugcggcuuucuugcgccgcuagcggguucaccuuugacgauuacgccaugcacugggugcgccaggcgccuggaaagggccuggaauggguguccgggaucucuuggaacagcggaacaauuggcuaugcugacuccgucagaggccgguucacgaucucucgcgaugacgccaaaagcucccucuaccugcagaugaauagccuuagaaccgaggauacagcccuguauuacugugcuaaggacgggugggugggaucuggcuccagcacccuccgggggucugauuauuggggacaaggcacacugguuaccguguccagcgccucuacaaaaggg

SEQ ID NO: 42643 - RNA, 390 nt, Artificial Sequence
  derived and/or modified sequence opt5 from anti-HIV_Chain
cagagcgugcugacccaacccccuuccgccucuggcagcccggggcaguccaucacaauuucuugcacgggaaccagcuccgacgucggcggguacaacuauguuucuugguaccagcagcccccuggaaaggcucccaaagugaucauuuaugaggugagcaagagaccuuccggcguccccgaucgguucagcgggucuaaauccggaaauacagccagccucaccgugucuggccugcaagcggaagacgaggcugauuacuauuguuccagcuacgccggcucuaacaauuuuguuuucgggacaggaaccgaagugacagucgugggccagccuaaggccaacccgaccguuacgcuuuuucccccuuccagcgaggaacugcuc

SEQ ID NO: 42644 - RNA, 390 nt, Artificial Sequence
  derived and/or modified sequence opt5 from anti-HIV_Chain
caggccguggucacccaagagcccagccugacaguuuccccuggcgggacggugacccucacaugcgcuucuagcaccggagccgugacauccggcuucuacccgcacugguuucagcagaagcccgggcaggcgccuagagcucugaucuauucuaccagcaaccgguacuccuggacacccgcccgcuucucuggaagccuucugggcgggaaagccgcucucacccuguccggaguccaaccugaagacgaggccgaauauuacugucuucugcuccccuauuacggcggcccuuggauuuuugggggaggcacgaagcugaccgugcuggggcagccgaaagcugcccccagcguuacacucuucccucccucuuccgaggaacug

SEQ ID NO: 42645 - RNA, 390 nt, Artificial Sequence
  derived and/or modified sequence opt5 from anti-HIV_Chain
cagagcgcccugacccaacccccuuccgcuucuggcgccccggggcagagagugacaaucagcugcuccggaggccccucuaacgucgggggaaauuacguuuauugguaccggcaguucccuggcacggcgcccacccuccugauucuucgcgacgaucagagaccuagcggggugcccgaccgguuuuccgcuucuaagagcggaaacuccgccagccuggccaucucuggccuccgcccugaugacgagggcuucuauuuuugugcuacauacgauuccgacgggagcauuagacuguucggaggcgggaccgcccuuacagugcugucucaaccgaaagcugcccccuccgucacccucuuuccucccagcucugaggaacugaag

SEQ ID NO: 42646 - RNA, 390 nt, Artificial Sequence
  derived and/or modified sequence opt5 from anti-HIV_Chain
caggugcaacuggucgagagcggcuccgacguuagaaagcccggggccaccgugacagugucuugcaaagcugaugaagacgaggaugacuucacggccuacaacuauuuuaugcacuggguccggcaggcgccuggacauggccucgaauggaucggguggauuaauccgcgcaccggacagcccaaccacgcuaagcaguuccaaggcagagugacacugacccgggagcgcagcacauccaccguuuuuaugaaacuuacaaaucugagacucgaugacaccgccguguacuucugugcccggccucugcgcgggggagauacguggcauuaucacucuuggggcagaggcaccagccuuacagucuccucugcuagcaccaagggg

SEQ ID NO: 42647 - RNA, 390 nt, Artificial Sequence
  derived and/or modified sequence opt5 from anti-HIV_Chain
gaggugcagcuggucgaaagcggcuccgacguuagaaagcccggggccaccgugacagugucuugcaaagcugaugaggacgaagaugacuucacggccuacaacuauuuuaugcacuggguccggcaagcgccuggacauggccucgaguggaucggguggauuaauccgcgcaccggacagcccaaccacgcuaagcaguuccagggcagagugacacugacccgggaacgcagcacauccaccguuuuuaugaaacuuacaaaucugagacucgaugacaccgccguguacuucugugcccggccucugcgcgggggagauacguggcauuaucacucuuggggcagaggcaccagccuuacagucuccucugcuagcaccaagggg

SEQ ID NO: 42648 - RNA, 390 nt, Artificial Sequence
  derived and/or modified sequence opt5 from anti-HIV_Chain
gaggugcagcugguccaaagcggcuccgacguuagaaagcccggggccaccgugacagugucuugcaaagcugaugaagacgaggaugacuucacggccuacgauuauuuuaugcacuggguccggcaggcgccuggacauggccucgaauggaucggguggauuaacccgcgcaccggacagcccaaucacgcuaagcaguuccaaggcagagugacacugacccgggagcgcagcacauccaccguuuuuaugaaacuuacaaaccugagacucgacgauaccgccguguacuucugugcccggccucugcgcgggggagacacguggcauuaucacucuuggggcagaggcaccagccuuacagucuccucugcuagcaccaagggg

SEQ ID NO: 42649 - RNA, 390 nt, Artificial Sequence
  derived and/or modified sequence opt5 from anti-HIV_Chain
caggugcaacugguccagagcggcuccgacguuagaaagcccggggccaccgugacagugucuugcaaagcugaugaggacgaagaugacuucacggccuacaacuauuuuaugcacuggguccggcaggcgccuggacauggccucgaguggaucggguggauuaauccgcgcaccggacagcccaaccacgcuaagcaauuccagggcagagugacacugacccgggaacgcagcacauccaccguuuuuaugaaacuuacaaaucugagacucgaugacaccgccguguacuucugugcccggccucugcgcgggggagauacguggcauuaucacucuuggggcagaggcaccagccuuacagucuccucugcuagcaccaagggg

SEQ ID NO: 42650 - RNA, 390 nt, Artificial Sequence
  derived and/or modified sequence opt5 from anti-HIV_Chain
caggugcaacugguccagagcggcuccgacguuagaaagcccggggccaccgugacagugucuugcaaagcugaugaggacgaagaugacuucacggccuacaacuauuuuaugcacuggguccggcaggcgccuggacauggccucgaguggaucggguggauuaauccgcgcaccggacagcccaaccacgcuaagcaauuccagggcagagugacacugacccgggaacgcagcacauccaccguuuuuaugaaacuuacaaaucugagacucgaugacaccgccguguacuucugugcccggccucugcgcgggggagauacguggcauuaucacucuagaggccggggcaccagccuuacagucuccucugcuagcaccaagggg

SEQ ID NO: 42651 - RNA, 390 nt, Artificial Sequence
  derived and/or modified sequence opt5 from anti-HIV_Chain
gaggugcagcuggucgaaagcggcuccgacguuagaaagcccggggccaccgugacagugucuugcaaagcugaugaggacgaagaugacuucacggccuacaacuauuuuaugcacuggguccggcaagcgccuggacagggccucgaguggaucggguggauuaauccgcgcaccggacagcccaaccaugcuaagcaguuccaaggcagagugacacugacccgggaacgcagcacauccaccguuuuuaugaaacuuacaaaucugagacucgaugacaccgccguguacuucugugcccggccucugcgcgggggagauacguggcacuaucauucuuggggcagaggcaccagccuuacagucuccucugcuagcaccaagggg

SEQ ID NO: 42652 - RNA, 390 nt, Artificial Sequence
  derived and/or modified sequence opt5 from anti-HIV_Chain
gugguccagcugguucaaagcggcuccgacgugagaaagcccggggccaccgugacagucucuugcaaagcugaugaggacgaagaugacuucacggccuacaacuauuuuaugcacugggugcggcaggcgccuggacauggccucgaguggaucggguggauuaauccgcgcaccggacagcccaaccacgcuaagcaguuccaaggcagaguuacacugacccgggaacgcagcacauccaccguguuuaugaaacuuacaaaucugagacucgaugacaccgccgucuacuucugugcccggccucugcgcgggggagauacguggcauuaucacucuuggggcagaggcaccagccuuacaguguccucugcuagcaccaagggg

SEQ ID NO: 42653 - RNA, 390 nt, Artificial Sequence
  derived and/or modified sequence opt5 from anti-HIV_Chain
gaggugcagcugguccaaagcggcuccgacguuagaaagcccggggccaccgugacagugucuugcaaagcugaugaagacgaggaugacuucacggccuacaacuauuuuaugcacuggguccggcaggcgccuggacauggccucgaauggaucggguggauuaauccgcgcaccggacagcccaaccacgcuaagcaguuccaaggcagagugacacugacccgggagcgcagcacauccaccguuuuuaugaaacuuacaaaucugagacucgaugacaccgccguguacuucugugcccggccucugcgcgggggagauacguggcauuaucacucuuggggcagaggcaccagccuuacagucuccucugcuagcaccaagggg

SEQ ID NO: 42654 - RNA, 390 nt, Artificial Sequence
  derived and/or modified sequence opt5 from anti-HIV_Chain
gaggugcagcugguccaaagcggcuccgacguuaagaaacccgggaccacagugacgaucucuugcaaggccgaugaagacgaggaugacuucaccgcuuacaacuauuuuaugcacugggugagacaggccccuggacagggccucgaauggauuggguggaucaauccgcggacaggacagcccaaccaugcgaaacaacugcagggccgcgucacccuuacaagagagcggagcaccuccacaguguucaugaagcugaccaaucuccgccuggaugacacggcuguuuacuuuugugccagaccucuucgcgggggagauaccuggcacuaucauucuuggggccggggcacaagccugauuguguccucugccagcaccaaaggg

SEQ ID NO: 42655 - RNA, 390 nt, Artificial Sequence
  derived and/or modified sequence opt5 from anti-HIV_Chain
caggugcaacuggucgagagcggcgggggacucguuaagcccggcgggucccugagacuuucuugcgccgcuagcggauucuccuuuaacgaauacuauaugucuuggauccggcaggccccuggccaggggcuggaguggguggcgaauauuggaagcuccgacgcuuacaccaucuaugccgauucugugaaaggccgcuucacaauuagcagagacaacgccgaaaauacggucuaccuccagaugaacucccugcggggcgaggauaccgcuguguauuacugugcccgcaucgaaggguauugcagcaauucuagauguuccaacuacuuugacccguggggacaaggcgcucuuguuacagugagcucugccuccaccaagggg

SEQ ID NO: 42656 - RNA, 390 nt, Artificial Sequence
  derived and/or modified sequence opt5 from anti-HIV_Chain
caggugcaacugguccagagcggcgccgagguuaagaaacccggggcuuccgugaaggugucuugcaaagucagcggauacccucucgccgaacuguccgugcacuggguuagacaggugccgggcaaggggcuugagugggucggaggcuucgaccccgaagaggggaaaaccguguaugcgcagaaguuucaaggacggguuacaaugacggaagaucgcucuaccgacacaguguacauggagcugaucagccucagauaugaggauaccgcugucuacuauugugccacagacaacccugugcugcagcuuggcgaacuguccucuagccucgauuacuggggccaggggacccuggugacagucuccagcgccucuaccaaggga

SEQ ID NO: 42657 - RNA, 390 nt, Artificial Sequence
  derived and/or modified sequence opt5 from anti-HIV_Chain
gaggugcagcugguccaaagcggcgccgaaguuaagaaacccggggagucccucagaaucucuugcaagaccagcggauacaacuucaaugacgauuggauugcuugggugcggcagcgcccugacaaaggcccggaauggauggggaucuuuuaucccggagauucccaggccacauacucuccuagcuuccagggccacgugacguuuuccgcggacaccucuauuagcacagcuuaucugcaauggaccucccuuaaggccagcgauacagccaucuacuauugugcuagaacccggugcuucggggccaacuguuuuaauuucauggacgucuggggaaaaggcacagcucugaccgugacgguuucuuccgccagcaccaagggc

SEQ ID NO: 42658 - RNA, 390 nt, Artificial Sequence
  derived and/or modified sequence opt5 from anti-HIV_Chain
caggugcaacugguccagcuccugcagagcggcgccgagguuaagaaacccggguccucugugaaggugagcugccagaucuccggauacggcuucucuaacuaugcuauuagcugggucagacaagccccugggcagggacuugaauggcugggccggaucgugccggcgguugggaugaccgaguacgcucagaaauuucagggacgcgugacauucacggccgacagauccaccauuacagccuauauggaucuccggggccugcgcucugacgauaccgcugucuacuauugugugagagacccccaaguugaagugcggggcaaugccuuugauaucugggggcagggaacaauggucaccgugagcuccgcuagcacaaagggc

SEQ ID NO: 42659 - RNA, 390 nt, Artificial Sequence
  derived and/or modified sequence opt5 from anti-HIV_Chain
caggugcaucugcaacaguggggcgccgggcuccugaagcccagcgagacccuuucccugacaugcgcugucucuggaggcagcuucuccggguuuuucuggacguggaucagacagucuccuggaaaaggccucgaauggauuggggagguuaaccacagcggauuuacccacuccaauccgucucuggaaagccgggccacaaucuccguggcggcuagcaacacccaguucucucuucgccuggccuccgugacagccgcugacaccgccauuuacuuuugugcucucagauauuucgauuggagccccuuucggcgcgacacauacggcaccgaugucuggggccaagggacgaccgugaucguuucuuccgccagcacaaaggga

SEQ ID NO: 42660 - RNA, 390 nt, Artificial Sequence
  derived and/or modified sequence opt5 from anti-HIV_Chain
caggugagacuggagcaaagcggcggggcccuccggaagcccggagcuuccgucacccugucuugccaggccagcggcuacaacuucguuaaauauaucauucacugggugcgccagagaccugggcuuggauuugaaugggugggcaugaucgacccguaccgggggcgccccugguaugcgcauuccuucgcuggaagacugucucucagccgggauacauccacggagacccuguacaugacacuuucuagccugaaguccgacgauaccgccacauauuuuugugcccgcgcugaagccgcuagcgacucucacuccagaccuauuauggauuggaccuggcggauccucugccugcuggccgucgugcccgcgagcacaaaaggc

SEQ ID NO: 42661 - RNA, 390 nt, Artificial Sequence
  derived and/or modified sequence opt5 from anti-HIV_Chain
caggugagacuggagcaaagcggcgccgcuguccggaagcccggggccuccguuacccucucuugccaggcgagcggauacaacuucgugaauuauaucauucacugggugcgccagagaccuggccuggacuuugaaugggucgggaugaucgauccguaccggggacgccccugguccgcucauaaauuccagggcagacuuucucugagccgggacguguccacagagauucucuauaugacgcugaacucucuucgcagcgaugacaccgccacauacuuuugugccagagcugaagccgagucccaaagccacucucggccuaucauguucgauuccugggggcagggaagccgcguuaccgugucuuccgcuagcacaaagggc

SEQ ID NO: 42662 - RNA, 390 nt, Artificial Sequence
  derived and/or modified sequence opt5 from anti-HIV_Chain
caggugagacuggagcaaagcggcgccgcugucaagaaacccggggccuccguuaccaucucuugccaggcgagcggauacaacuucgugaaguuuuucauucacugggugcggcagcgcccuggccagggguuugaaugggucggaaugaucgagccguauagaggccggcccugguccgcugggaauuuccaaggacgccucucucugagcagagacguguccacagaaacgcuuuacaugacccugaacaaucuccggucugaugacacagccguuuauuuuugugcccgccuggaggcugaaagcgauucccauagcagaccuauuauguucgaccacuggggccauggcucucuugugaccgucuccagcgccucuacaaaaggg

SEQ ID NO: 42663 - RNA, 390 nt, Artificial Sequence
  derived and/or modified sequence opt5 from anti-HIV_Chain
caggugagacuggagcaaagcggcgccgcuguccggaagcccggggccuccguuacccucucuugccaggcgagcggauacaacuucgugaauuauaucauucacugggugcgccagagaccuggccuggacuuugaaugggucgggaugaucgauccguaccggggacgccccugguccgcucauaaauucgagggcagacuuucucugagccgggacguguccacagaaguucucuauaugacgcugucuagccuucgcuccgaugacaccgccacauacuuuugugccagagcugaggccgaaagccagucucacucccggccuauuauguucgauuauugggggcaaggaagccgcgugaccgucucuuccgcuagcacaaagggc

SEQ ID NO: 42664 - RNA, 390 nt, Artificial Sequence
  derived and/or modified sequence opt5 from anti-HIV_Chain
caggugagacuggagcaaagcggcaccgccguccggaagcccggggcuuccguuacaaucucuugccaggccagcggauacaacuucgugaaauuuuucauucacggcgugcgccagagaccugggcagggauuugaaugggucggcaugaucgagccguuccgggggcgccccugguccgcgggaaauuuucaaggcagacucucucugagccgggacguguccacggaaacccuuuauaugacacugaacaaucuccgcucugaugacaccgcuguuuacuucugugccagacuggaggccgaaagcgauucccauagccggccuauuauguuugaccacuggggccaugggucucuugugacagucuccagcgcuucuaccaaggga

SEQ ID NO: 42665 - RNA, 390 nt, Artificial Sequence
  derived and/or modified sequence opt5 from anti-HIV_Chain
caggugagacuggagcaaagcggcaccgccaugcggaagcccggggcuuccgucacacucucuugccaggccagcggauacaacuucguuaaauauaucgugcacugggugcgccagaagccuggccugggguuugaaugggucggaaugauugacccguacagaggccggcccugguccgcgcauaaauuccaggggcgccuuucucugagcagagauacguccauggagauccucuauaugacccugacaucucuuaagagcgacgauaccgcuacauacuuuugugcccgggccgaagcugccuccgacagccacucucgcccuauuauguucgaucauuggggacaaggcuccagagugaccguuagcucugcuuccacaaaaggc

SEQ ID NO: 42666 - RNA, 390 nt, Artificial Sequence
  derived and/or modified sequence opt5 from anti-HIV_Chain
caggugagacuggagcaaagcggcgccgcuaugcggaagcccggggccuccgucacccucucuugccaggcgagcggauacaacuucguuaaauauaucgugcacugggugcgccagaagccuggccugggguuugaaugggucggaaugauugacccguacagaggccggcccugguccgcucauaaauuccaggggcgccuuucucugagcagagauacauccauggagauccucuauaugacgcugaccucucuuaagagcgacgauacagccaccuacuuuugugcccgggcugaagccgcuuccgacagccacucucgcccuauuauguucgaucauuggggacaaggcuccagagugacaguuagcucugccuccaccaaaggc

SEQ ID NO: 42667 - RNA, 390 nt, Artificial Sequence
  derived and/or modified sequence opt5 from anti-HIV_Chain
caggugagacuggagcaaagcggcgccgcuaugcggaagcccggggccuccgucacccucucuugccaggcgagcggauacaacuucguuaaauauaucauucacugggugcgccagaagccuggccugggguuugaaugggugggaaugaucgacccguacagaggccggcccugguccgcucauaaauuccaggggcgccuuucucugagcagagauacauccauggagauucucuauaugacgcugaccucucuuaagagcgacgauacagccaccuacuuuugugcccgggcugaagccgcuuccgacagccacucucgcccuaucauguucgaucauuggggacaaggcuccagagucacagugagcucugccuccaccaaaggc

SEQ ID NO: 42668 - RNA, 390 nt, Artificial Sequence
  derived and/or modified sequence opt5 from anti-HIV_Chain
caggugagacuggagcaaagcggcaacgccguccggaagcccggggcuuccguuaccaucucuugccaggccagcggauacaauuucgugaaauuuuucauucacugggugcgccagagaccuggccagggguuugaaugggucggaaugaucgagccguuccggggccgccccugguccgcggggaacuuucaaggaagacucucucugagccgggacguguccacagaaacgcuuuauaugacccugaauaaccuccgcucugaugacacagcuguuuacuucugugccagacuggaggccgaaagcgauucccauagccggccuauuauguuugaccacuggggccauggcucucuugugaccgucuccagcgcuucuacaaagggg

SEQ ID NO: 42669 - RNA, 390 nt, Artificial Sequence
  derived and/or modified sequence opt5 from anti-HIV_Chain
caggugagacuggagcaaagcggcgccgcuguccggaagcccggggccuccguuacccucucuugccaggcgagcggauacaacuucgugcgcuauaucauucacugggugagacagcggccuggccuggacuuugaaugggucgggaugaucgauccguaccgcggaagacccugguccgcucauaaauucggcgggcggcuuucucugacacgcgacgugagcacggagauucucuauaugacccugacaucccuuagaucugaugacaccgccacauacuuuugugcccgggcugaagccgagagccagucccacagccgcccuaucauguucgauucuuggggacaaggcuccagaguuaccgugagcucugcuuccacaaagggc

SEQ ID NO: 42670 - RNA, 390 nt, Artificial Sequence
  derived and/or modified sequence opt5 from anti-HIV_Chain
caggugagacuggagcaaagcggcgccgcuguccggaagcccggggccuccguuacccucucuugccaggcgagcggauacaacuucgugaauuauaucauucacugggugcgccagagaccuggccuggacuuugaaugggucgggaugaucgauccguaccggggacgccccugguccgcucauaaauuccagggcagacuuucucugagccgggacguguccacagagauucucuauaugacgcugucuagccuucgcuccgaugacaccgccacauacuuuugugccagagcugaagccgagagccaaucucacucccggccuaucauguucgauuuuugggggcagggaagccgcguuaccgugucuuccgcuagcacaaagggc

SEQ ID NO: 42671 - RNA, 390 nt, Artificial Sequence
  derived and/or modified sequence opt5 from anti-HIV_Chain
caggugagacuggagcaaagcggcaccgccguccggaagcccggggcuuccguuacaaucucuugccaggccagcggauacaacuucgugaaauuuuucauucacugggugcgccagagaccuggccagggguuugaaugggucggaaugaucgagccguuccggggccgccccugguccgcggggaauuuucaaggaagacucucucugagccgggacguguccacggaaacccuuuauaugacacugaacaaucuccgcucugaugacaccgcuguuuacuucugugccagacuggaggccgaaagcgauucccauagccggccuauuauguuugaccacuggggccauggcucucuugugacagucuccagcgcuucuaccaagggg

SEQ ID NO: 42672 - RNA, 390 nt, Artificial Sequence
  derived and/or modified sequence opt5 from anti-HIV_Chain
caggugagacuggagcaaagcggcgccgcuaugcggaagcccggggccuccgucacccucucuugccaggcgagcggauacaacuucguuaaauauaucgugcacugggugcgccagaagccuggccugggguuugaaugggucggaaugauugacccguacagaggccggcccugguccgcucauaaauuccaggggcgccuuucucugagcagagauacauccauggagauccucuauaugacgcugaccucucuuacaagcgacgauaccgccacauacuuuugugcccgggcugaagccgcuuccgacagccacucucgcccuauuauguucgaucauuggggacaaggcuccagagugaccguuagcucugccuccacaaagggc

SEQ ID NO: 42673 - RNA, 390 nt, Artificial Sequence
  derived and/or modified sequence opt5 from anti-HIV_Chain
gaggugcagcugguccaaagcggcgggggacucguucagcccggcgggucccugagacuuucuugcgccgcuagcggacugaccuuccggaauuuugccauguccugggugcgccaggcgccuggcaaggggcucgaaugggugucuagcaucuccggaucuggcggcagcacauacuaugcugacuccgucaaagggagauucacgauuagccgggauaauucuaagaacacccuguaccuucagaugaacucccugcgcggagaggacacagccguguauuuuugugccaaaggcguuggguacgauauccucaccggacugggcgacgcuuucgauauuugggggcaaggaacaguggucgccgugagcucugcuuccaccaagggc

SEQ ID NO: 42674 - RNA, 393 nt, Artificial Sequence
  derived and/or modified sequence opt5 from anti-HIV_Chain
caggugcaacugguccagagcggcgccgcuguuagaaagcccggggccuccgugaccgugucuugcaaauucgcggaggacgaugacuacagcccucacugggucaacccggcucccgaacauuauauccacuuucuccggcaggccccuggacagcaacuggaguggcuugccuggaugaaucccacaaacggcgcugugaauuacgccuggcagcugcaugggcgccucacggcuaccagagauggauccaugacaaccgccuuccuggaaguucggucucuucgcagcgacgauacagcgguguauuacugugccagagcucagaagcggggccgcuccgagugggccuaugcucacugggggcagggaaccccuguccuggugucuagc

SEQ ID NO: 42675 - RNA, 393 nt, Artificial Sequence
  derived and/or modified sequence opt5 from anti-HIV_Chain
caggugcaacugcagcaguggggcgccgggcuccugaagcccagcgagacccuuucccugacaugcgcugucuacgccggaucuuucagcggcuauuacuggacguggaucagacagccuccggggaaaggacucgaauggauuggcgagguuaaccacgggggauccaccaauuauaaccccucucuuaagagccgggugacacuguccguggacaccucuaaaaaucaauuuagccugaagcucacauccgucaccgcggcugauacagccguguacuauugugcccgcguuagcagauacgacuucuggucuggcaacuauggcuccuacgggcuggauguguggggacagggcaccacggucaccgugagcucugcuuccacaaaaggg

SEQ ID NO: 42676 - RNA, 393 nt, Artificial Sequence
  derived and/or modified sequence opt5 from anti-HIV_Chain
gaggugcagcugguccaaagcggcgggggaguugugcagcccggcagaucccuccggcugucuugcguggucagcggguucaccuuuuccucuuucacauuucacugggugcgccaggccccuggaaagggccuugaauggguugcugggaugagcuuccaugccacguacaucuauuacgcggacuccgugaaaggaagauuuaccauuucucgggaugacagccaggauacacuguaucucgagauggacucccugcgcagcgaagauaccgcuaucuacuauugugccagagacccgggcauucacgauuacggcgacuaugcccccggggcuuucgauuacuggggacaaggcucuccugucacaguguccagcgccucuaccaagggg

SEQ ID NO: 42677 - RNA, 393 nt, Artificial Sequence
  derived and/or modified sequence opt5 from anti-HIV_Chain
caggugcaacugguccagagcggcaccgagguucagaagcccggggccuccgugaaagugucuugcaagacaagcggauacacguucuccaaauauuacauccacugggucagacaggcuccuggccaagggcucgaaugggugggacggauuaacaccgacucuggcgggacagauuaugccgagaaguuucagggacgcguuaccaugacaagagacaccagcaucacaaccguguaccuggaaaugcggggccuuacguccgaugacaccgcggcuuucuauugugcccgcggcccgccccaugccgggggauggacaauuuacuauuacggccuggaugucugggggcagggaaccucugugaucguuagcuccgcuagcacaaaaggc

SEQ ID NO: 42678 - RNA, 393 nt, Artificial Sequence
  derived and/or modified sequence opt5 from anti-HIV_Chain
agaaccguggucacacagcccccuagcguuuccggcgccccggggcaacgggugacgaucucuugcaccggaagcuccucuaacauuggcgcuggguacgacgugcacugguaucagcagcugcccggaacagccccuaagcuccugaucuacggcaauagcaaccgccccuccggggucccugauagauucucuggaagcaaauccggcaccagcgcgucucuugcuauuacaggccugcaggccgaggacgaagccgauuauuacugucaauccuaugacagcucucucuccgggagcggaguguuuggcaccgggacaaagguuaccgugcugggacagcccaaagcuaauccuacggucacccuuuucccgcccucuuccgaggaacug

SEQ ID NO: 42679 - RNA, 393 nt, Artificial Sequence
  derived and/or modified sequence opt5 from anti-HIV_Chain
caggugcaacugcagcaguggggcagcgggcuccugaagcccuccgagacccuuucucugacaugcgccgucuacggaggcagcuucagauccuauuacuggaacuggauccggcagucuccugggaaaggacucgaauggauuggcgagguuagccacuccgggucuacgaauuauaacccggcucuuaagagccgcgugaccaucuccguggacacaagcaaaaaucaauuuucucugaaggucaaauccgugaccgccgcggauacagcucuguacuauuguagcagaggacggggcaagcgcugcucuggcgccuacuguuucgccggguauuuugacuccuggggacagggcgggcucguuguggucagcucugcuuccaccaaggga

SEQ ID NO: 42680 - RNA, 393 nt, Artificial Sequence
  derived and/or modified sequence opt5 from anti-HIV_Chain
caggugcaccugguccaaagcggcgccgagguuaagaaacccggguccucugugagagugagcugcgaggcuuccggauggaccuucggcucugucaacagcgccaucacaugggugcggcaggcgccugggcagggacucgaauggaugggccgcacgauuccguuucuggggaucuccaauuacgcucagaaguuccaaggaagaguuaccauuacagccgacaaaucuaccaacaucgccuauguggaugucacaagccuuaccucccaggacacagcuguguacuauugugcccggcugauuaccggcaugacggcucccugguuuuacuauauggauguuuggggcaaggggaccacagugaccgucagcucugccuccacaaaagga

SEQ ID NO: 42681 - RNA, 393 nt, Artificial Sequence
  derived and/or modified sequence opt5 from anti-HIV_Chain
caggugcaucugcaagagagcggccccagacucguccgguccucugaaacccugagccuuacaugcuccguuccugggggaucuaucgugaacccgauuacgaauuacuauuggagcuggauccgccagucccccagaaagggccugcaguggauuggggacaucuacuauaccggaacaucuagccggaacccuucccucgauagccgcgugucuauuuccauggacgucagcagaaaacagaucucucugacccuuuacuccgugacagccgcugauaccgccguucacuauugugcgagccaaucucuguccugguaccggcccagcggcuauuucgaguccugggggcagggaauccucgugacagucucuagcgcuuccaccaagggc

SEQ ID NO: 42682 - RNA, 393 nt, Artificial Sequence
  derived and/or modified sequence opt5 from anti-HIV_LightChain
augaagcugcccgugagacuccugguccuuauguucuggaucccugccagcuccucugacauuguuaugacccagagcccgcugucccuccccgugacaccuggcgagcccgcuucuaucagcugccgguccucucaacgccugcuuagcuccuacgggcacacguaucugcauugguaccuccagaaaccuggacagagcccccagcugcugauuuaugaagugucuaacagauuuuccggcgucccugaucgguucagcgggucuggauccggcaccgacuuuacacucaagaucagccgcguggaggccgaagauguugggguguacuauuguucucaauccacccacgucccgcugacauucggacagggcaccaaaguggagauuaag

SEQ ID NO: 42683 - RNA, 396 nt, Artificial Sequence
  derived and/or modified sequence opt5 from anti-HIV_Chain
caggugcaacugcaggagagcggccccgggcucgucaagccuuccgaaacccugucuguuacaugcagcguguccggagacucuaugaacaauuacuauuggacguggaucagacagagcccgggcaaagggcuugaguggauuggauacaucuccgaucgggccucugcuaccuauaaccccagccucaauucccgcguggucauuagcagagacacaucuaagaaccagcugucccugaaacuuaauagcgugaccccugccgauacagcgguuuacuauugugcuaccgcccggcgcggccaaagaaucuacgggguggucucuuucggagaauuuuucuauuacuacuccauggacguguggggcaagggcacaaccguuacggugagcucu

SEQ ID NO: 42684 - RNA, 396 nt, Artificial Sequence
  derived and/or modified sequence opt5 from anti-HIV_Chain
caggugcaacugcaggagagcggccccgggcucgucaagccuccggaaacccugucccuuacaugcucuguuagcggagccuccgugaacgacgcuuacuggucuuggaucagacagagccccggcaaacggccugagugggugggguauguccaccauuccggagauacgaauuacaaccccucucugaagcgcagagugaccuucagccucgacacagccaaaaaugaaguuucccugaaacuuguggcgcugaccgcugccgauagcgccgucuauuuuugugcucgggcccuccacggcaagcgcauuuacgggaucguggcucugggagagcuguucacauauuuuuacauggacguuuggggcaagggcaccacagugaccgucucuucc

SEQ ID NO: 42685 - RNA, 396 nt, Artificial Sequence
  derived and/or modified sequence opt5 from anti-HIV_Chain
caggugcaacugcaggagagcggccccgggcucgucaagccuuccgaaacccugucucuuacaugcagcguuuccggagccucuaucagcgacuccuacuggucuuggauuagacggagcccgggcaaagggcuggaguggaucggauaugugcacaaguccggcgauacgaacuacagccccucucucaaaucccgcgugaaucugagccuugacaccucuaagaaccaggucucccugagccucguggcugccacagcggcugauucugggaaauauuacugugccagaacccugcauggacggcgcauuuauggcaucguugccuucaaugaaugguuuacauacuucuauauggacguguggggcaacgggacccaggucacaguguccagc

SEQ ID NO: 42686 - RNA, 396 nt, Artificial Sequence
  derived and/or modified sequence opt5 from anti-HIV_Chain
caggugcaucugcaagagagcggccccgggcucgucaagccuuccgaaacccugucucuuacaugcaacguuagcggaacgcuggugagagacaauuacugguccuggaugcggcagccgcucggcaaacagcccgaguggaucggguaugugcacgauucuggagacaccaacuacaauccuagccugaagucccgcguccaccuuucucuggauaaaagcaacaaucucgugucccugagacugacagccguuaccgcugccgacagcgcgacauauuacugugcuaccacaaagcauggccggcgcauuuaugggaucguggccuucaacgaaugguuuaccuacuucuauauggaugucuggggaaaaggcacgaccgugacaguuucuucc

SEQ ID NO: 42687 - RNA, 396 nt, Artificial Sequence
  derived and/or modified sequence opt5 from anti-HIV_Chain
caggugcaacugcaggagagcggccccgggcucgucaagccuuccgaaacccugucuguuacaugcagcguguccggagacucuaugaacaauuacuauuggacguggaucagacagagcccgggcaaagggcuugaguggauuggauacaucuccgaucgggaaucugccaccuauaaccccagccuuaauucccgcguggucauuagcagagacacaucuaccaaccagcucucccugaagcugaauagcgugaccccugcugauacagccguuuacuauugugcgacagcucggcgcggccaaagaaucuacgggguggucucuuucggagaguuuuucuauuacuacuccauggacguguggggccggggcaccacgguuaccgugagcucu

SEQ ID NO: 42688 - RNA, 396 nt, Artificial Sequence
  derived and/or modified sequence opt5 from anti-HIV_Chain
caggugcaacuggucgagagcggccccgggcucguuaccccuuccgaaacacugucucuuacgugcaccgugagcaacggauccgugucuggcagauucuggagcuggauccggcaguccccggggcgcggacuggaguggauuggcuacuuuucugacacagauagaagcgaauauucccccagccuccggucucgccugacccuuucccuggacgccagcagaaaucagcucucucugaagcugaaauccgucacagcugccgauagcgcgaccuacuauugugcucgggcccagcaagggaagcgcaucuacggaauugugucuuucggcgaguuuuucuauuacuauuacauggacgccuggggcaaagggacagcuguuaccguguccagc

SEQ ID NO: 42689 - RNA, 396 nt, Artificial Sequence
  derived and/or modified sequence opt5 from anti-HIV_Chain
caggugcaacugcaggagagcggccccgggcucgucaagccuccggaaacccugucccuuacaugcucuguuagcggagccuccaucaacgacgcuuacuggucuuggauuagacagagccccggcaaacggccugagugggugggguaugugcaccauuccggagauacgaauuacaaccccucucugaagcgcagagucaccuucagccucgacacagccaaaaaugaagugucccugaaacuuguugaucugaccgcggcugacagcgccguguauuuuugugcccgggcucuccacggcaagcgcaucuacgggauugucgcccugggagagcuguucacauauuuuuacauggauguguggggcaagggcaccacaguuaccgugucuucc

SEQ ID NO: 42690 - RNA, 396 nt, Artificial Sequence
  derived and/or modified sequence opt5 from anti-HIV_Chain
caggugcaacugcaggagagcggccccgggcucgucaagccuccggaaacccugucccuuacaugcucuguuagcggagccuccaucaacgacgcuuacuggucuuggauuagacagagccccggcaaacggccugagugggugggguaugugcaccauuccggagauacgaauuacaaccccucucugaagcgcagagucagcuucucccucgacaccgccaaaaaugaagugagccugaaacuuguugaucugacagcggcugacucugccaucuauuuuugugcccgggcucuccacggcaagcgcauuuacgggaucguggcccugggagagcuguucaccuauuuuuacauggaugucuggggcaagggcacaaccgugacaguuuccagc

SEQ ID NO: 42691 - RNA, 396 nt, Artificial Sequence
  derived and/or modified sequence opt5 from anti-HIV_Chain
caggugcaacugcaggagagcggccccgggcucgucaagccuuccgaaacccugucuguuacaugcagcguguccggagacucuaugaacaauagcuacuggacguggaucagacaguccccgggcaaagggcuugaguggauuggauauaucucuaagagcgaauccgccaacuacaaucccagccugaacucucggguggucauuucccgcgauaccagcaaaaaucagcucucucugaaacuuaacuccgugaccccugcugacacagccguuuauuacugugcgacagcuagacacggccaacggaucuaugggguggucagcuucggagaguuuuucaccuacuauucuauggauguguggggcaagggcacaaccguuacgguguccagc

SEQ ID NO: 42692 - RNA, 396 nt, Artificial Sequence
  derived and/or modified sequence opt5 from anti-HIV_Chain
caggugcaacugcaggagagcggccccgggcucgucaagccuuccgaaacccugucucuuacaugcagcguuuccaacggaucugugagcggcagauucugguccuggauccggcagucuccggggcgcggacuggaguggauuggcuacuuuagcgacacggaaaaauccaauuauaaccccagccucagaucucggcugacccuuuccguggaugccagcaagaaucagcugucucucaaacugaacuccgucacagcugccgacagcgcgaccuacuauugugcucgcacacaacaggggaagagaaucuacggagugguuucuuucggcgaguuuuuccacuauuacuauauggaugccuggggcaaagggaccgccgugacagucuccagc

SEQ ID NO: 42693 - RNA, 396 nt, Artificial Sequence
  derived and/or modified sequence opt5 from anti-HIV_Chain
caggugcaacugguccagagcggcaccgcccucaagucccccgggucuagcgcuaaacuguccugcacaguucuuggagacgaguucggcacguacuuuaucucuuggauuagacaggccccugggcagggacuggaaugggugggcgggaucgugccgcacagccaacuccaguccucugcgcagaaguuccauggacggauuaucauuagcgcuggcgccggcgucacacccccugugguuucccugcagcuuaccaaccugaccuuugaggauacagggaccuauuucugugcccgcgaaagaggacggcaccgcgaccccaaaacaggcgaugcucucagagggcgguacuuugacuucuggggacgcggcaccggggugagcgucucugcc

SEQ ID NO: 42694 - RNA, 396 nt, Artificial Sequence
  derived and/or modified sequence opt5 from anti-HIV_Chain
caggugcaacugguccagagcggcaccgcccucaagucccccgggucuagcgcuaaacuguccugcacaguucuuggagacgaguucggcacguacuuuaucucuuggauuagacaggccccugggcagggacuggaaugggugggcgggaucgugccgcacagccaacuccaguccucugcgcagaaguuccauggacggauuaucauuagcgcuggcgccggcgucacacccccugugguuucccugcagcuuaccaaccugaccuuugaggauacagggaccuauuucugugcccgcgaaagaggacggcaccgcgaccccaaaacaggcaaggcuccuagagggcgguacuuugauuucuggggacgcggcaccggggugacggucagcgcc

SEQ ID NO: 42695 - RNA, 396 nt, Artificial Sequence
  derived and/or modified sequence opt5 from anti-HIV_Chain
caggugcaacugguccagagcggcaccgcccucaagucccccgggucuagcgcuaaacuguccugcacaguucuuggagacgaguucggcacguacuuuaucucuuggauuagacaggccccugggcagggacuggaaugggugggcgggaucgugccgcacagccaacuccaguccucugcgcagaaguuccauggacggauuaccaucagcgcuggcgccggcgucacacccccugugguuucccugcagcuuaccaaccugacauuugaggauaccgggacauauuucugugcccgcgaaagaggacggcaccgcgaccccaaaaccggcgaugcucucagagggcgguacuuugacuucuggggacgcggcacgggggugagagucagcacc

SEQ ID NO: 42696 - RNA, 396 nt, Artificial Sequence
  derived and/or modified sequence opt5 from anti-HIV_Chain
caggugcaacugguccagagcggcgccgcuguuaagucccccgggucuagcgccaaacucuccugcaccgugcugggagacgaguucggcacauacuuuaucucuuggauuagacaggcgccugggcagggacuugaaugggugggcgggaucgucccgcacagccaacugcaguccucugcucagcgguuccauggacgcauuacgaucagcgccggcgccggcgugacacccccuguugugucccuccagcugaccaaccuuaccuuugaugacgcugggacauauuucugugccagagagcggggacgccacagagaucccaagaccggcgacgcucugcgggggcgcuacuuugauuucuggggaagaggcacagggauuagcgucucuccu

SEQ ID NO: 42697 - RNA, 396 nt, Artificial Sequence
  derived and/or modified sequence opt5 from anti-HIV_Chain
gaggugcagcugguccaaagcggcgccgaaguuaagaaacccggggcuuccgugaaggugucuugcaaagucagcggauacacccucacagagcuguccauccacugggugagacaggccccuggcaaggggcuugaauggaugggaggcuucgacccggaggaugacgaagcgauuuaugagcccaaauuucaggggcggcugacgaugaccgaggauacaucuaccgacacagcuuacauggaacucagcucccugcgcucugaggauaccgccguuuauuacugugccacagcugacccuuucaagguggcccaggaugaaggacuuuaugucaucuuugacuacuggggccaaggcacccuggugacgguuagcuccgcuagcaccaagggg

SEQ ID NO: 42698 - RNA, 396 nt, Artificial Sequence
  derived and/or modified sequence opt5 from anti-HIV_Chain
gaggugcagcuggucgaaagcggcgggggacuccugcaacccggcgggucccuuagacugucuugcgccgcuagcggauucuccuuuaacgacuucgagaugaauuggguucggcaggccccuggcaaggggcucgaaugggugucuuacaucagcaacgauggaaccaugauucacuaugcggacuccgugaaaggccgcuuuacaaucucuagagauaaugcuaagaaaagccuguuccuucagaugaacucccugcgggccgaggacacggccgucuacuauugugcucgccucgccgaagugccgcccgcuauuagaggcagcuacuauuacgggauggauguuuggggacagggcaccacagugaccgucgccucugcguccacaaagggg

SEQ ID NO: 42699 - RNA, 396 nt, Artificial Sequence
  derived and/or modified sequence opt5 from anti-HIV_Chain
caggugcaacugaugcagagcggcgccgaggucaagagacccggggcuuccguuaaagugucuugcaaggccuuccggcacagccucaacaaucugggaaucuccuggauucgcagagcgccuggccgggggcuugaauggcugggauggaucaacguguacgagggcaauaccaaauaugggcgcagauuucagggacgggucacaaugacgaccgaccgcucuacaaacaccgugagcauggaacucagaucccugacaucugaugacaccgcuguuuacuauugugcccgggauaaucauuucuggagcggcuccagccgcuacuauuacuuuggcauggacgugugggggcagggaacaaccgucauugugucuuccgccagcacgaagggc

SEQ ID NO: 42700 - RNA, 396 nt, Artificial Sequence
  derived and/or modified sequence opt5 from anti-HIV_Chain
caggugcaacugguccaguggggcgccgggcuccugaagccccuugagacccugagccucacaugcgcuguuuacggaggcuccuucaacggguauuuuuggucuuggaucagacagacgccuggaaaaggccuggaauggauuggggagaucaaucacggaggcagcgccaacuucaauccgucccuuaagucucgggugaccaugagcguggacacauccaaaaaccaguuuucucugaagcucgcgagcgucaccgcugccgauacagccauuuacuauugugcucgcggcagaaucaccauggugcgcggggacccccaacggggaggcguuagaauggaugugugggggcagggaacauccgucaccgugagcucugccuccacgaaaggc

SEQ ID NO: 42701 - RNA, 396 nt, Artificial Sequence
  derived and/or modified sequence opt5 from anti-HIV_Chain
cuggugcagcucguccaaagcggcgccgagguuaagaaacccggggcuuccgugaaggugucuugcaaagucagcggacacacccuguccgaacuuucuaucaacugggugagacauguuccuggcaaggggcuggaguggaugggaggccucgacccggaagauggggaggccauucacgaacccaaauuccagggacggcugacaaugacggaggacaccagcacagauaccgcguacuccacacuuucugugugggcuccugucgccgccgcuauguauuacugugccaccgcugaccccuuuaagguggcccaggaugagggccuguauguuaucuucgacuacuggggccaggggacacucgugaccgucagcuccgcgagcacgaaggga

SEQ ID NO: 42702 - RNA, 396 nt, Artificial Sequence
  derived and/or modified sequence opt5 from anti-HIV_Chain
caggugcaacugcuccagagcggcggggaggucaagaaacccggagccuccguuaaggugucuugcaaagugagcggcuacacccugacagaacuuuccauccacugggucagacaggcuccugggaagggacuggaguggaugggcggguucgacccggaagaugacgaggccauuuaugaacccaaauuucagggacggcucacgaugaccgaggauacaucuaccgacacagcguacauggagcugagcucccuucgcucugaagauaccgcuguguauuacugugccacagccgacccuuucaagguugcucaagaugagggccuguaugugaucuuugacuacuggggccaggggacccucgucacggugagcuccgccagcaccaaggga

SEQ ID NO: 42703 - RNA, 396 nt, Artificial Sequence
  derived and/or modified sequence opt5 from anti-HIV_Chain
caggugcaacugguccagagcggcgccgagguuaagaaacccggggcuuccgugaaggugucuugcaaagucagcggauacacccucacagaacuguccauccacugggugagacaggccccuggcaaggggcuugaguggaugggaggcuucgacucugaagauggggaggcguuuuauaaacagaacuuccaaggacggguuacgaugaccgaagacacaagcaccgauacagcuuacauggagcugcgcagacuccgguccgaggacaccgccguguauuacugugccacagcugaucgcuuuaaggucgcccaggacgaaggccuguucgugauuuuugauuauuggggccaggggacccuuguuacggugucuagcgcuuccaccaaggga

SEQ ID NO: 42704 - RNA, 396 nt, Artificial Sequence
  derived and/or modified sequence opt5 from anti-HIV_Chain
caggugcaccugguccaaagcggcgccgagguuaagaaacccggggcuuccgugagagugucuugcaaggccagcggauacaccuucacaacguauggcaucuccuggguccggcaggcgccugggcagggacucgaauggaugggcuggauuucugcucauagcggggacaccaacuacgcccagaaacugcaagcccgcgugacaaugaccacagauaccuccacaaauaccgcuuauauggagcuuagaucucugacgagcgacgauaccgccguuuacuauugugcucgggaccgcccgagacacuacuaugaucggggaggcuacuacucccccuuugacuauuggggccaggggacacucgugaccgucagcucugccuccacaaaggga

SEQ ID NO: 42705 - RNA, 396 nt, Artificial Sequence
  derived and/or modified sequence opt5 from anti-HIV_Chain
cuggugcagcuccugcaaagcggcgccgaggucaagaaacccggggcuuccguuaaggugucuugcaaagugagcggauacacccuuacagaacuguccauccacugggucagacaggccccuggcaaggggcucgaguggaugggaggcuucgacccggaagaugacgaggcgauuuaugaacccaaauuucaggggcggcugacgaugaccgaggauacaucuaccgacacagcuuacauggagcuuagcucccugcgcucugaagauaccgccguguauuacugugccacagcugacccuuucaagguugcccaggaugagggacucuaugugaucuuugacuacuggggccaaggcacccuggucacggugagcuccgcuagcaccaagggg

SEQ ID NO: 42706 - RNA, 396 nt, Artificial Sequence
  derived and/or modified sequence opt5 from anti-HIV_Chain
caggugcaacugguccagagcggcgccgagguuaagaaacccggggcuuccgugaaggugucuugcaaagucagcggacacacccucuccgaacugucuaucaacugggugagacauguuccuggcaaggggcuugaguggaugggaggccuggacccggaagauggggaggccauucacgaacccaaauuccagggacggcucacaaugacggaggacaccagcacagauaccgcguacguggagcuguccucucuucgcagcgaagacacagcuauguauuacugugccaccgccgauccuuuuaaggucgcucaggacgagggccuguaugugaucuucgauuacuggggccaagggacacucguuaccguguccagcgccucuacgaaggga

SEQ ID NO: 42707 - RNA, 396 nt, Artificial Sequence
  derived and/or modified sequence opt5 from anti-HIV_Chain
caggugcaacugcuccagagcggcgccgaggucaagaaacccggggcuuccguuaaggugucuugcaaagugagcggauacacccugacagaacuuuccaucaacugggucagacaggccccuggcaaggggcuggaguggaugggaggcuucgacccggaagaugacgaggcgauuuaugaacccaaauuucaggggcggcucacgaugaccgaggauacaucuaccgacacagcuuacauggagcugagcucccuucgcucugaagauaccgccguguauuacugugccacagcugacccuuucaagguugcccaagaugagggacuguaugugaucuuugacuacuggggccagggcacccucgucacggugagcuccgcuagcaccaagggg

SEQ ID NO: 42708 - RNA, 396 nt, Artificial Sequence
  derived and/or modified sequence opt5 from anti-HIV_Chain
cagccccaacuggugcagagcggcuccggggccgaggucaagaaaccuggagcuucuguuagaaucagcugcgaagccuccgaguacaacguguucgaccacuuuaugcagugggugcggcaggcgccgggccaagggcucgaauggaugggauggauuaauccccgcggcggguauccuucuuacagccccaccuuccagggaagacugacauuuacgcggcagccuuccugggaugacucuaccaucacauuccauauggagcuucgcggccugggccacgaugacaccgcugucuauuacugugccagaccccauagcccugaugacgccuggucccucgaugugugggggcggggaacacugguuaccgugagcucugcuuccacaaagggc

SEQ ID NO: 42709 - RNA, 396 nt, Artificial Sequence
  derived and/or modified sequence opt5 from anti-HIV_Chain
cagccccaacuggugcagagcggcuccggggccgaggucaagaaaccuggagcuucuguuagaaucagcugcgaagccuccgaguacaacguguucgaccacuuuaugcagugggugcggcaggcgccgggccaagggcucgaauggaugggauggauuaauccccgcggcggguauccuucuuacagccccagauuccagggacggcugaccuuuacacgccagccuuccugggaugacucuagcgucacguuccauauggagcuuagaggccugcggcacgaugacaccgcuguguauuacugugcccgcccccauuccccugaugacgccuggagccucgauguuuggggcagagggacacuggugaccgucucuuccgcuagcacaaaggga

SEQ ID NO: 42710 - RNA, 396 nt, Artificial Sequence
  derived and/or modified sequence opt5 from anti-HIV_Chain
gaggugcagcuggucgaaagcggcgggggaguuguggagcccggcgaaucccucagacugucuugcgccgcuagcggguucaccuuucgguccuacgacauguucugggugcgccaagccacaggaaagucucuugagugggucagcgcgaucggcauugcuggggauacguauuacuccggaucugugaaaggcagauuuaccaucagccgggaaaacgcccgcacaucccuguaucuccagcugagcggccuuagaguugaggacucugccguguacuucuguguccggggguccccuccgcgcauugcugccaccgaguauaauuacuauuacggacuggauguguggggccaggggacaaccguuagcguguuuucugcuuccacaaaggga

SEQ ID NO: 42711 - RNA, 396 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcaccuucacaacguacgacaucucuugggucagacaggccccugggcagggacucgaauggaugggcgggauucugccggauuuuggagcgcccagcuaugcucaaaaauuccaggaccgggugaccaucacaaccgaugaguccucuagcacagccuacauggaacuuaacucccugcgcagcgaggacaccgccauuuauuacugugcuagaggccggggcgaugacuuuuggucuggggaauccccuagcugguauuucgauuacuggggacagggcacacucguuaccgugucuuccgccagcacgaaaggg

SEQ ID NO: 42712 - RNA, 396 nt, Artificial Sequence
  derived and/or modified sequence opt5 from anti-HIV_Chain
cagccccaacuggugcagagcggcuccggggccgaggucaagaaaccuggagcuucuguuagaaucagcugcgaagccuccgaguacaacguguucgaccacuuuaugcagugggugcggcaggcgccgauggaaggccucgaguggaugggguggauuaauccccgcggaggcuauccuucuuacagccccaccuuccaagggagacugacauuuacgcggcagccuuccugggaugacucuaccaucacauuccauauggaacuucgcggacugagacacgaugacaccgcugucuauuacugugcccggccccauagcccugaugacgccuggucccucgauguguggggccgcggcacacugguuaccgugagcucugcuuccacaaagggg

SEQ ID NO: 42713 - RNA, 396 nt, Artificial Sequence
  derived and/or modified sequence opt5 from anti-HIV_Chain
gaggugagacugcucgaaagcggcgggggacugguccagcccggcgggucccuucggcugucuugcagcgccuccggauucaccuuuucuaacagcgcucucuccuggguucgccaagccccuggcaaggggcuggagugggugucuagcguggucuccagcggaggcgacacauucuacgcggauucugugaaaggcagauuuacgaucucccgggacaauagccgcaacacccuuuaucugcagaugaagucucucagagcugaagauacagcccuguacuauugugccaaaguucagauucagcaacugaauuucggggugaucaccgacgcuggaauggaugucuggggcaaggggacaaccgugauuguuuccagcgccucuacaaaagga

SEQ ID NO: 42714 - RNA, 396 nt, Artificial Sequence
  derived and/or modified sequence opt5 from anti-HIV_Chain
caggugcaacuggucgagagcggcgggggaguugugcagcccggcagaucccuccggcugucuugcguggggagcggauucaccuuuuccucuagcggcaugcacuggguccgccaggccccugggaagggacuugaauggguggcuguuaucuccucugacggcagcgaugaguacuauggcgacuccguggaagggagauucacaauuagccgggauaacucuaaaaauacgcuguuucuccagcuggacucccuugaggccgaagauagcgcggucuacuauugugcuaagaccccgccccauuacgacgcccugacaggauauccuucuuccgugcucgaguucuggggccuggggacccugguuacagugagcucugccuccaccaaagga

SEQ ID NO: 42715 - RNA, 396 nt, Artificial Sequence
  derived and/or modified sequence opt5 from anti-HIV_Chain
gaggugcagcugguccaaagcggcgccgaaguuaagaaacccggguccucugugaaggugagcugcaaggcuuccggaggcaccuucacaacguacgacaucucuugggucagacaggccccugggcagggacucgaguggauuggcgggauccugccggauuuuggagcgcccagcuaugcucagaaauuccaagaccgggugaccauuacaaccgaugaauccucucgcacagccuacauggagcuuaacagccugagauccgaagacaccgccaucuauuacugugcucggggccgcggcgaugacuuuuggagcggggagucuccuuccugguauuucgauuacuggggacagggcacacagguuaccgugagcucugccuccacgaaaggg

SEQ ID NO: 42716 - RNA, 396 nt, Artificial Sequence
  derived and/or modified sequence opt5 from anti-HIV_Chain
caggugcaacugcuccagagcggcaccgaggucaagaaacccggguccucuguuaaggugagcugcagagccuccggauggacacugggcaacucuccuaauagcgcuaucgggugggugcggcaggccccgggacagggccuugaauggauugggcgcaucauucccauccuggacgucacgaacuacgcgcaaaaauuccagggaagagugaccauuuccgcugauaagucuacaaauaucgccuauauggagaucagcucccucggcagcgaagacaccgccuuuuacuauugugcucggguuauuacaggcaugaccucuccuugguacuucuauauggauguguggggagaggggacaaccgucaucguguccagcgccucuacgaaaggc

SEQ ID NO: 42717 - RNA, 396 nt, Artificial Sequence
  derived and/or modified sequence opt5 from anti-HIV_Chain
caggugcaccugguccaaagcggcgccgagguuaagaaacccggguccucugugagagugagcugcaaggcuuccggauggaccuucggcgacucugucaacagcgccaucacaugggugcggcaggcgccugggcagggacucgaauggaugggccgcuuuauuccgauccuggggcuuuccaauuacgcucagaaauuccaagauagaguuacgauuaacguggaccggucuaccaauacagccuauauggagcugagcggacuccgcuccgaagauaccgccgucuacuauugugcuagacugaucacaggcaugaacgcccccugguuuuacuauauggacguguggggcaaggggaccacaauuaccguuagcucugcuuccacgaaagga

SEQ ID NO: 42718 - RNA, 396 nt, Artificial Sequence
  derived and/or modified sequence opt5 from anti-HIV_Chain
caggugcaccugguccaaagcggcgccgaggcuaagagacccggguccucuguucgggugagcugccgcgccuccggaggcgacuucucuagcuacacccucuccugggugagacaggcgccugggcagggacuggaacggaugggcggggucgugccgaugcuugauacaguucauuaugcucagaaauuucaaggacgccugacgcucucuguggacgagggcaccagcacagccuacauggaacuguccagccuuagaucugaggauaccgccauguauuacuguacacggggccgccagaccuucagagcuaucugguccgggcccccugucguguuugacauuuggggacagggcacacugguuagcgugucuuccgccagcaccaagggg

SEQ ID NO: 42719 - RNA, 396 nt, Artificial Sequence
  derived and/or modified sequence opt5 from anti-HIV_Chain
caggugcaccugguccaaagcggcgccgaggcuaagagacccggguccucuguucgggugagcugccgcgccuccggaggcgacuucucuagcuacacccucuccugggugagacaggcgccugggcagggaaucgaauggaugggcggggucgugccgaugcuggauacaguucauuaugcucagaaauuucaaggacggcuuacgcugucuguggacgagggcaccagcacagccuacauggaacucuccagccugcgcucugaggauaccgccauguauuacuguacaagaggccggcagaccuuccgcgcuauuugguccgggcccccugccgucuuugacaucuggggacagggcacacuugugauuguuagcucugcuuccaccaagggg

SEQ ID NO: 42720 - RNA, 396 nt, Artificial Sequence
  derived and/or modified sequence opt5 from anti-HIV_Chain
caggugcaacugguccagagcggcgccgagcucaagaaacccggguccucuguuaaggugagcugcaaggcuuccggaggcaccuucaacaaucacacauuuaacugggugagacaggccccugggcagggacuggaauggaugggccggacgaucccgauucuugggucucgcgacuacgcgaaaaccuuccaagauagagucacaaucauugcugacaaaagcaccuccacaguguaucuggagcuccggcgccugaagucugaagauaccggaguuuacuauugugccacaagcauguacuauuuugacuccggcggcuacuauagaaauaccgaucuugacaagugggggcagggaagccuggugacggucucuuccgccagcaccaaaggc

SEQ ID NO: 42721 - RNA, 396 nt, Artificial Sequence
  derived and/or modified sequence opt5 from anti-HIV_Chain
cagguguaccugguccaaagcggccccgagcucaagaaaccuggggccuccguuaagaucucuugcaaagcuagcggauauaacuucccgaaguacgccauucacugggugagacaggcgcccggccaggggcugcaguggaugggauggaucaauggcgacaacggggaugcucgguauucccaaaaacuucagggacgcgugaccccuucuacagacacgagcgccuccgucguguacauggaacugaagagacuccggucugaggauaccgccguuuauuacugugcucgcgcccuguaucccugggaaauuggcggcgugccuagcacaaugggggacgauuacuggggacagggcacccuuaucacagucuccagcgcuucuaccaagggg

SEQ ID NO: 42722 - RNA, 396 nt, Artificial Sequence
  derived and/or modified sequence opt5 from anti-HIV_Chain
caggugcaacugguccagagcggccccgagcucaugaagccuggguccucuguuaaagugagcugcagagccuccggagacaacuuccugaccucuacauuuaauuggcuucggcaggcuccgggccagcgccuggaauggauggggagauucauccccagccucggacugauuacguccgccccuaaguuuucugaucggcuuaccaucacagcggaccaagcuacccugacagccuacauggagcucaccggccugacaagcgaagauaccgcccuguauuacugugcucgcgggcucugcagaggaggcaacugucggcugggccccuccggguggcuugacccuuggggacgcggcacccaggugacggucagcucugccuccacaaaaggg

SEQ ID NO: 42723 - RNA, 396 nt, Artificial Sequence
  derived and/or modified sequence opt5 from anti-HIV_Chain
ggcgugcacuuccaggggcaucugguccaaagcggaggcgggguuaagaaacccggauccucugugaccaucagcugccucgccuccgaguacacauuuacggaguucaccauucacuggaucagacaggcuccuggccaggggccgcuguggcuuggacugauuaagcggucuggccgccucaugacaagcuauagauuucaggaccggcugucccuucgcagagaucggucuaccggcacaguguucauggaacugcgcgggcucagaaucgacgauaccgccgucuacuauugugcgcgggacggacugggcgaaguggcucccgccuaccuguaugggauugauguuuggggacaaggcagcacagugaucgucaccuccgccagcacgucu

SEQ ID NO: 42724 - RNA, 396 nt, Artificial Sequence
  derived and/or modified sequence opt5 from anti-HIV_Chain
caggugcaacugcuccagagcggcgccgaggucaagaaacccggggcuuccguuaaggugucuugcaaagugagcggauacacccugacagaacuuuccauccacugggucagacaggccccuggcaaggggcuggaguggaugggaggcuucgacccggaagaugacgaggcgauuuaugaacccaaauuucaggggcggcucacgaugaccgaggauacaucuaccgacacagcuuacauggagcugagcucccuucgcucugaagauaccgccguguauuacugugccacagcugacccuuucaagguugcccaagaugagggacuguaugugaucuuugacuacuggggccagggcacccucgucacggugagcuccgcuagcaccaagggg

SEQ ID NO: 42725 - RNA, 396 nt, Artificial Sequence
  derived and/or modified sequence opt5 from anti-HIV_Chain
caggugcaacugguccagagcggcgccgagguuaagaaacccggggcuuccgugaaggugucuugcaaagucagcggauacacccucacagaacuguccauccacugggugagacaggccccuggcaaggggcuugaguggaugggaggcuucgacccggaagauggggaggcgucuuuugaacccaaauuccagggacggcugacgaugaccgaggacacaagcaccgauacagcuuauauggagcucuccucucugcgcagcgaagacaccgccguuuacuauugugccacagcugauccuuuuaagguggcccaagacgagggccuuuacgucauuuucgauuauuggggccaggggacccuggugacgguuuccagcgcuucuaccaaggga

SEQ ID NO: 42726 - RNA, 396 nt, Artificial Sequence
  derived and/or modified sequence opt5 from anti-HIV_Chain
ggcgugcacuuccaggggcaucugguccaaagcggaggcgggguuaagaaacccggauccucugugaccaucagcugccucgccuccgaguacacauuuacggaguucaccauucacuggaucagacaggcuccuggccaggggccgcuguggcuuggacugauuaagcggucuggccgccucaugacaagcuauagauuucaggaccggcugucccuucgcagagaucggucuaccggcacaguguucauggaacugcgcgggcucagaaucgacgauaccgccgucuacuauugugcgcgggacggacugggcgaaguggcucccgccuaccuguaugggauugauguuuggggacaaggcacaaccgugaucgucacgagcgccuccaccagc

SEQ ID NO: 42727 - RNA, 396 nt, Artificial Sequence
  derived and/or modified sequence opt5 from anti-HIV_Chain
caggugcaacugggcgagagcgggggaggccucgucgaacccgggggaucccugagacuuucuugcgccgcuagcggcuuccuguuuuccgacuaccagaugucuuggauccggcucgccccugggaagggacuggaguggauuagcuucaucuccggcuuuggcucuguuuauuacgcggauagcguggaagggcgcuucaccauuuccagagacaacgcucggaauagccuuuaucugcagaugaacaaucuccgcgccgaggauacagccguguacuauugugcuagagccuacggaacgggcaacuggcgggggcuguauuacuacuauuacggaauggacgucuggggccacgggaccacagugaccguuucuuccgcuagcacaaaagga

SEQ ID NO: 42728 - RNA, 399 nt, Artificial Sequence
  derived and/or modified sequence opt5 from anti-HIV_Chain
caggugcaacugguccagagcggcaccgcccucaagucccccgggucuagcgcuaaacuguccugcacaguucuuggagacgaguucggcacguacuuuaucucuuggauuagacaggccccugggcagggacuggaaugggugggcgggaucgugccgcacagccaacuccaguccucugcgcagaaguuccauggacggauuaucauuagcgcuggcgccggcgucacacccccugugguuucccugcagcuuaccaaccugaccuuugaggauacagggaccuauuucugugcccgcgaaagaggacggcaccgcgaccccaaaacaggcgaugcucucagagggcgguacuuugacuucuggggacgcggcaccgggcugagagugagcacgucu

SEQ ID NO: 42729 - RNA, 399 nt, Artificial Sequence
  derived and/or modified sequence opt5 from anti-HIV_Chain
gaggugcagcugguccaaagcggcgggggacucguuaagcccggcgggucccugagacuuucuugcgccgcuagcggauucaccuuuaaaaacgccuggauguccugggugcggcaggcgccuggcaaggggcuggaaugggugggacacaucaaaucuaagacagacggcggcacgauugauuacgcugccccggucaaagggcgcuucaccaucagcagagacgauuccaagaauacacucuaucugcagaugaacucucuuaagauugaggacaccgccguguacuauuguacaaccgauaucggaagcggccgggggugggacuuucauuacuaugauuccaaugacuggggacagggcacacugguuaccgugagcucugcuuccacgaaaggg

SEQ ID NO: 42730 - RNA, 399 nt, Artificial Sequence
  derived and/or modified sequence opt5 from anti-HIV_Chain
caggugcaacuggucgagagcggcgggggaguugugcagcccggcagaucccuccggcuguucugcgccgcuucuggguuugccuucaauaccuacggaaugcacugggugcgccaggcgccuggcaaggggcuugaaugggucgcugugacauggcaugacggaagccagaaauauuacgccgauuccguuaagggcagauuuacgaucucucgggacaauagcaaaaacacccuguaucuccaaaugaacucccugcgcgccgaggauacagcuauuuacuauugugccucugaccagggcggguucgaugacagcuccggauacuuugcuccgggcgggauggauguguggggaagaggcaccacagucaucgugagcucugcccccaccaagggg

SEQ ID NO: 42731 - RNA, 399 nt, Artificial Sequence
  derived and/or modified sequence opt5 from anti-HIV_Chain
ggcuacagcgaggugcagcugguccaauccgggcccggacucguuaagccuucucagacccugagccuuacaugcacgguguccggcgggucuaucagcaacggaggccacuauuggaauuggauuagacagcauccggggaaaggacuggaauggaucggccacauuuacaacaucgccaccacauauuacaaucccucccucaagucucgggugagcauuuccgucgacaccagcaaaaaccaguucucucugaaacuuuccagcgugacagcugccgauaccgcgguuuauuacugugcucgcggcucugggagauggacaaucggagcccggaucuauuuugacaauuggggccaaggggcccugguggcugucuccagcgccucuaccaaggga

SEQ ID NO: 42732 - RNA, 399 nt, Artificial Sequence
  derived and/or modified sequence opt5 from anti-HIV_Chain
cagcugcaacucaaggagagcggccccgggauggugaaaccuuccgaaacccugucucuuacaugcagcgucuccggagccucuguugugagcgcuaacgacuacuggggcuggaucagacaggccccggggaagggacuggaguguauuggcaucauucucuauacgggguccaccuucuacaaucccucucugcagagccgggugacaaucucccgcgauccuagcaaaaaccacgucucucuuacccugacauccgugaccgcggcugacagcgccguuuauuacugcgcccggauucccuaucauucugaauccuacuauaauguggucaucggaggcuuugauguguggggccaggggacaagaguuaccgugagcucugcuuccacgaaggga

SEQ ID NO: 42733 - RNA, 399 nt, Artificial Sequence
  derived and/or modified sequence opt5 from anti-HIV_Chain
ugccaggugcaacuggucgagagcggcgggggaguugugcagcccggcagaucccuccggcugucuuguguggggagcggauucaccuuuuccucuagcggcaugcacuggguccgccaggccccugggaagggacuugaauggguggcuguuaucuccucugacggcagcgaugaguacuauggcgacuccguggaagggagauucacaauuagccgggauaacucuaaaaauacgcuguuucuccagcuggacucccuugaggccgaagauagcgcggucuacuauugcgcuaagaccccgccccauuacgacgcccugacaggauauccuucuuccgugcucgaguucuggggccuggggacccugguuacagugagcucugccuccaccaaagga

SEQ ID NO: 42734 - RNA, 399 nt, Artificial Sequence
  derived and/or modified sequence opt5 from anti-HIV_Chain
caggugcaacugguccagagcggcgccgacguuaagaaacccggggcuuccgugaaggugucuugcaaagucagcggauacaccguguccgagcucucuauccacuggguuagacaggccccuggcaaggggcuggaauggaugggaggcuucgauccggaggacgggaaaacagugagcgcgcagaacuuucaaggacgggucacgaugaccgaagauaaguccacaggcaccgcuaauauggagcuucgcucucugagaagcgaagacacagccguguauuacugugccaccacaguucagcucauuguggauuucugcaacggcgggcccuguuauaauuuugacgauuggggacagggcacccuggucacgguguccagcgcuucuaccaagggg

SEQ ID NO: 42735 - RNA, 399 nt, Artificial Sequence
  derived and/or modified sequence opt5 from anti-HIV_Chain
ggccuggaccucgagcacgaugggcaucacaaggaagaacccagagccagcgugaccgucuccugcgaggcuucuggauacaacuucguuaauuauaucauucauugggugcggcugacaccuggccgcggguuugaguggaugggaaugaucgacccgagacggggccgccccuggagcgcccagaaauuccaagggagacuuacgcugacccgggauauugacuccgaacgccucuacaugcagcugucuggacuuagaggcgaugacacagcgguguauuuuugugcucggcaggagccugauuuccacgacggccaugggcacacccugcgcggaauguuugauagcuggggccaggggucccccgucucugugagcuccgccagcacaaaggga

SEQ ID NO: 42736 - RNA, 399 nt, Artificial Sequence
  derived and/or modified sequence opt5 from anti-HIV_Chain
caggugagacugguccaaagcggcgcccagcucaagaaacccggggcuuccguuaccgugucuugcgaggccagcggauacaacuucgugaauuauaucauuaacuggguccggcagacaccuggccgcuccuuugaauggguggggaugaucgacccgagacggggacgccccuggucugcgcagaaguuccaaggcagacugacgcuuacccgggauauugacagcgagaaacuguacaugcaccucuccgggcugcgcggagaugacacagcuguuuauuacugugccagacaggauucugacuuucaugauggccacggccauacccuucgggggauguucgacagcuggggacagggcuccccugugacagucagcucugccuccaccaagggg

SEQ ID NO: 42737 - RNA, 399 nt, Artificial Sequence
  derived and/or modified sequence opt5 from anti-HIV_Chain
caggugagacugagccaauccggcgccgcugucguuaagaccggggccucugugacaaucagcugcgagacggaaggauacaccuucgugaacuauauuauccacuggguccggcagcccccuggccgcggguuugaguggcucggaaugauugacccgagaaauggccaucccugguucgggcagcgguuucgcggaagacugucccuucggcgcgauagaucuacagaaaccguguucaugacacugagcggccucaccuccgacgauaacggcaucuacuuuugugcgcggaaugagccucaguauuacgacgggucuggacacagccugcccggcauguucgauuauugggggcaaggaacacgcguuguggucuccagcgcuucuaccaaaggc

SEQ ID NO: 42738 - RNA, 399 nt, Artificial Sequence
  derived and/or modified sequence opt5 from anti-HIV_Chain
caggugagacugagccaauccggcgccgcugucaugaagaccggggccucuguuacaaucagcugcgagacggaaggauacaacuucgugaauuauauuauccacugggugcggagacccccuggccgcggguuugaguggcucggaaugauugacccgaaaaacggccaucccugguucgcgcaggcuguccgggggcgccugucccuuagacgggauaccuuuaaugaagugguuuacaugacacugucuggacucaccagcgacgauacaggccuguauuucugugcccgcaacgagccucaguaccacgacggcaaugggcauucccuucccggaauguuugauuucuggggccaggggacccuggugacagucucuagcgccuccaccaaggga

SEQ ID NO: 42739 - RNA, 399 nt, Artificial Sequence
  derived and/or modified sequence opt5 from anti-HIV_Chain
caggugagacugagccaauccggcgccgcugucguuaagaccggggccucugugacaaucagcugcgagacggaaggauacaccuucgugaacuauauuauccacuggguccggcagcccccuggccgcggguuugaguggcucggaaugauugacccgagaaauggccaucccugguucgggcagcggcugcagggacgccuuucccugagacgggaucgcucuacagaaaccguguuuaugacacucagcggccugaccuccgacgauacaggcaucuacuucugugcgagaaacgagccucaauauuacgacgggucuggacacagccuucccggcauguuugauuauugggggcagggaacccggguuguggucuccagcgcuucuacgaaaggc

SEQ ID NO: 42740 - RNA, 399 nt, Artificial Sequence
  derived and/or modified sequence opt5 from anti-HIV_Chain
caggugagacugagccaauccggcgccgcugucguuaagaccggggccucugugacaaucagcugcgagacggaaggauacaccuucgugaaccacauuauccauuggguccggcagcccccuggccgcggguuugaguggcucggaaugauugacccgagaaauggccaccccugguucgggcagcggcugcgcggaagacuuucccugcggcgcgauagaucuacagaaaccguguuuaugacacucagcggccugaccuccgacgauaucggcauuuauuucugugcgcggaacgagccucaguacuuugacgggucuggacauagccuucccggcauguucgauuauugggggcaaggaacacgcguuguggucuccagcgcuucuaccaaaggc

SEQ ID NO: 42741 - RNA, 399 nt, Artificial Sequence
  derived and/or modified sequence opt5 from anti-HIV_Chain
caggugcaauucuuucagagcggcuccucuaugaagaaaagcggggccuccgucaccaucucuugcgaggcuacaggauacaacauuaagaaucacauccugcauuggguuagacagaaacccggccggggguucgaaugggugggaaugauugacccuaucaacggccgcccgugguuugggcaggccuucagaggacggcucacgcugacccgcgaucuuagcacagagaccuuuuauaugucccugucuggccucacaagcgacgauaccgcgacauacuucugugcuagacgggaagccgacuaucacgauggcaaugggcauacccugcccggaauguuugacuucuggggcccugggacgcuugugaccgucuccagcgccucuacaaaggga

SEQ ID NO: 42742 - RNA, 399 nt, Artificial Sequence
  derived and/or modified sequence opt5 from anti-HIV_Chain
caggugagacugagccaauccggcgccgcugucguuaagaccggggccucugugacaaucagcugcgagacggaaggauacaccuucgugaacuauauuauccacuggguccggcagucccccggccgcggguuugaguggcucggaaugauugacccuagaaauggccauccgugguucgggcagcggcugcgcggaagacuuucucugcggcgcgauagaagcacagaaaccguguuuaugacacucuccggccugaccucugacgauacagcgaucuacuucugugcucggaacgagccccaguauuacgacggcagcgggcacucccuuccuggaauguuugauuauuggggccaagggacccgcguuguggucagcucugccuccacgaaagga

SEQ ID NO: 42743 - RNA, 399 nt, Artificial Sequence
  derived and/or modified sequence opt5 from anti-HIV_Chain
caggugagacugagccaauccggcgccgcuaugaagaaacccggggccucugucaccaucagcugcgagacagaaggauacacguucauuaacuauaucauucacuggguucggcagccuccgggccgcggguuugaguggcucggaaugaucgaccccagaaauggccggccuugguucgggcaguccgugcagggacgccugucucuuagacgggauaccuacacagaaguggucuauaugacccugagcggccucacauccgacgaugcgggccuguacuuuugugcucgcaacgagccccaauaucaugacgggaauggacacucucuuccuggcauguucgauuacugggggcagggaacccugguggccguuagcuccgccagcacaaagggc

SEQ ID NO: 42744 - RNA, 399 nt, Artificial Sequence
  derived and/or modified sequence opt5 from anti-HIV_Chain
caggugagacugguccaaagcggcgcccagcucaagaaacccggggcuuccguuaccgugucuugcgaggccagcggauacaacuucgugaauuauaucauuaacuggguccggcagacaccuggccgcggguuugaaugggugggaaugaucgacccgagacggggccgccccugguccgcgcagaaguuccaagggagacugacgcuuacccgggauauugacucugagaaacuguacaugcaccucagcggacugcgcggcgaugacacagcuguuuauuacugugccagacaggauuccgacuuucaugauggccacgggcauacccuucggggaauguucgacucuuggggccaggggagcccugugacagucuccagcgccucuaccaaggga

SEQ ID NO: 42745 - RNA, 399 nt, Artificial Sequence
  derived and/or modified sequence opt5 from anti-HIV_Chain
caggugcacaccuuccaaagcggcuccucuaugaagaaaagcggggccuccgucacaaucucuugcgaggcuacgggauacaacauuaagaauuauauccugcauuggguuagacagaaacccggccggggguuugaaugggugggaaugauugacccuaucaacggccgcccgugguucgggcagcccuuuagaggacggcucacccugacacgcgaucuuagcaccgagacauucuacaugucccugucuggccucaccagcgacgauacagccaccuauuuuugugcgagacgggaagcugacuaccacgauggcaaugggcauacgcugccuggaauguucgacuuuuggggccccgggacccuuauuacaguguccagcgccucuaccaaggga

SEQ ID NO: 42746 - RNA, 399 nt, Artificial Sequence
  derived and/or modified sequence opt5 from anti-HIV_Chain
caggugagacuguuccaaagcggcgccgcuaugaagaaacccggggccuccgucaccaucucuugcgaggcgagcggauacaacuuuaugaauuauuucguucacugggugcggcagcgcccuggcagaggguuugaauggcucggaaugauuaacccgcggggcgggcgccccugguccgcucagucugugcagggaagacugacacuuacgcgggacaucagcaccgagauguucuacaugcgccuggauggccucagauccgacgauacagccaccuauuuuugugcccggaaugaagcugacuaccaugauggcaacgggcacucucugcgcggaauguucgacuauuggggccaagggagccuuauuacagucuccagcgccucuaccaaggga

SEQ ID NO: 42747 - RNA, 399 nt, Artificial Sequence
  derived and/or modified sequence opt5 from anti-HIV_Chain
caggugcaacuguuccagagcggcgccgcuaugagaaagcccggggccuccgucaccaucucuugcgaggcgagcggauacaacuuuaugaauuauuucguucacugggugcggcagcgcccuggcagaggguuugaauggcucggaaugauuaacccgcggggcgggcgccccugguccgcucagucugugcaaggaagacugacacuuacgcgggacaccagcacagagauguucuacaugcgccuggauggccucagauccgacgauaccgccacauauuuuugugcccggaaugaagcugacuaccaugauggcaacgggcacucucugcgcggaauguucgacuauuggggccaggggagccuuaucaccgucuccagcgccucuacaaaagga

SEQ ID NO: 42748 - RNA, 399 nt, Artificial Sequence
  derived and/or modified sequence opt5 from anti-HIV_Chain
caggugagacugagccaauccggcgccgcuaucaagaaacccggggccucugucaccauuagcugcgagacagaaggauacacguucaucaacuauauuauccacuggguucggcagccuccgggccgcggguuugaguggcucggaaugauugaccccagaaauggccggccuugguucgggcaguccgugcagggacgccugucucuuagacgggauaccuacacagaaguggucuauaugacccugagcggccucacauccgacgauaccggccuguacuuuugugcgcgcaacgagccccaauaucaugacgggaauggacacucucuuccuggcauguucgauagcugggggcagggaacacugguggcuguuuccagcgccucuaccaagggc

SEQ ID NO: 42749 - RNA, 399 nt, Artificial Sequence
  derived and/or modified sequence opt5 from anti-HIV_Chain
caggugagacuguuccaaagcggcgccgcuaugcggaagcccggggccuccgucaccaucucuugcgaggcgagcggauacaacuuucucaauuauuucguucacugggugcgccagagaccuggccggggguuugaauggcugggaaugauuaacccgcgcggcgggagacccugguccgcucagucugugcagggacggcuuacacugacgcgcgacaccagcacagagauguucuacaugagacucgauggccugcgguccgacgauaccgccacauauuuuugugcccgcaaugaagcugacuaccaugauggcaacgggcacucucuuagaggaauguucgacuauuggggccaagggagccugaucaccgucuccagcgccucuacaaaagga

SEQ ID NO: 42750 - RNA, 399 nt, Artificial Sequence
  derived and/or modified sequence opt5 from anti-HIV_Chain
caggugagacugagccaauccggcgccgcugucaagaaacccggggccucuguuaccaucgugugcgagacagaaggauacaacuucauugacuauaucauucacugggugcggcagccuccgggccgcggguuugaguggcucggaaugaucgaucccagaaauggccggccuuggagcgggcagaagguccauggacgccugucccuuuggagagacacgucuaccgaaaaaguguacaugacacugaccggccucacaagcgaugacaccggccuguauuucugugggcggaacgagccccaguaccacgaugacaauggacauucccuuccuggcaugauugauuauugggggcaaggaacaaugguuaccgugucuagcgcguccacgaagggc

SEQ ID NO: 42751 - RNA, 399 nt, Artificial Sequence
  derived and/or modified sequence opt5 from anti-HIV_Chain
caggugagacugagccaauccggcgccgcuaucaagaaacccggggccucugucaccauuagcugcgagacagaaggauacacguucaucaacuauauuauccacuggguucggcagccuccgggccgcggguuugaguggcucggaaugauugaccccagaaauggccggccuugguucgggcaguccgugcagggacgccugucucuuagacgggauaccuacacagaaguggucuauaugacccugagcggccucacauccgacgaugcgggccauuacuuuugugcucgcaacgagccccaauaucacgacgggaauggacauucucugccuggcauguucgauuacugggggcagggaacccuuguggccguuagcuccgccagcacaaagggc

SEQ ID NO: 42752 - RNA, 399 nt, Artificial Sequence
  derived and/or modified sequence opt5 from anti-HIV_Chain
caggugagacuguuccaaagcggcgccgcuaugcggaagcccggggccuccgucaccaucucuugcgaggcgagcggauacaacuuuaugaauuauuucguucacugggugcgccagagaccuggccggggguuugaauggcucggaaugauuaacccgcgcggcgggagacccugguccgcucagucugugcagggacggcugacacuuacgcgcgacaccagcacagagauguucuacaugagacuggauggccuccgguccgacgauaccgccacauauuuuugugcccgcaaugaagcugacuaccaugauggcaacgggcacucucugagaggaauguucgacuauuggggccaagggagccuuaucaccgucuccagcgccucuacaaaagga

SEQ ID NO: 42753 - RNA, 399 nt, Artificial Sequence
  derived and/or modified sequence opt5 from anti-HIV_LightChain
augaagcugcccgugagacuccugguccuuauguucuggaucccugccagcuccucugacauuguuaugacccagagcccgcugucccuccccgugacaccuggcgagcccgcuucuaucagcugccgguccucucaacgccugcuuagcuccuacgggcacacguaucugcauugguaccuccagaaaccuggacagagcccccagcugcugauuuaugaagugucuaacagauuuuccggcgucccugaucgguucagcgggucuggauccggcaccgacuuuacacucaagaucagccgcguggaggccgaagauguugggguguacuauuguucucaauccacccacgucccgcugacauucggacagggcaccaaaguggagauuaagagaaaa

SEQ ID NO: 42754 - RNA, 402 nt, Artificial Sequence
  derived and/or modified sequence opt5 from anti-HIV_Chain
cagcccuacaucgugcaaagcggcccugccgucaagggggcuggauccucuguuaccgugacaugcaaaguggacggcgaugacgaugggauuuucagcuuuggaacguauuucauggucugggugagacaggccccgggccaggggcugcaguacaugggaggccucguucccuccuaugcgccuaccuacgcucacaaguuugagggccggaucacaauuucugccgccgggacacccccuguggucagccugacccuucugaaccucaccaaugacgaugcugccacauauuucugugcucgcgaaagaggacggcauuacgacuccaaaacccgcgagaacagacggggccgcuauuuugauaugugggggagaggaacgcggaucaccgugucuccc

SEQ ID NO: 42755 - RNA, 402 nt, Artificial Sequence
  derived and/or modified sequence opt5 from anti-HIV_Chain
cagcccuacaucgugcaaagcggcccugccgucaagggggcuggauccucuguuaccgugacaugcagaguggacggcgaugacgaugggauuuucaacuuuggaacguauuucauggucugggugcggcaggccccgggccaggggcugcaguacaugggaggccucguucccagcuaugcgccuaccuacgcucacaaauuugagggccgcaucacaauuuccgccgccgggacacccccuguggucucucugacccuuaucaaucugaccaacgcugacgccgcuacauauuucugugccagagaacggggacgccauuacgauagcaagaccagagagaaucggcgcggcagauauuuugacaugugggggcggggaacgcgcauuaccguguccccc

SEQ ID NO: 42756 - RNA, 402 nt, Artificial Sequence
  derived and/or modified sequence opt5 from anti-HIV_Chain
agagugcacagccagguccaacugguugaguccggccccgggcucgugaagccuucucagacccugagccuuacaugcacgguguccggaggcucuaucagcaacgggggacauuacuggaauuggauucggcagcacccgggcaaagggcuggaauggaucggacauauuuauaacaucgccaccacauacuauaaucccucccucaagucucgcgucagcauuuccguggacaccagcaaaaaccaguucucucugaaacuuuccagcguuacagcugccgauaccgcgguguacuauugugcuagaggcucuggccgguggacaaucggggcccgcaucuacuuugacaauuggggacaaggcgcccuggucgcuguguccagcgccucuaccaagggg

SEQ ID NO: 42757 - RNA, 402 nt, Artificial Sequence
  derived and/or modified sequence opt5 from anti-HIV_Chain
agcguggacgagagacugcucgaguucggcgggcggcugguccagcccggaggcucccuucgccugucuugcagcgccuccggguuuaccuucucuaacagcgcuauguccuggguuagacaagccccuggaaagggccucgaaugggugucuagcauccuguccagcggggugggaacauuuuacgcggauucugucaaaggccgguucacggugucccgcgacaauagcagaaacacccuuuaucugcagaugaagucucuccgggcugaagauacagcccuguacuauugugccaaaguucagauucagcaacugaauuuuggcgugaucaccgacgcugggcucgaugucuggggaaagggcacaacccugauuguguccagcgccucuacaaaaggg

SEQ ID NO: 42758 - RNA, 402 nt, Artificial Sequence
  derived and/or modified sequence opt5 from anti-HIV_Chain
gugcagagccaagucuaccugguucaguccggcggggaggugaagaaacccggaucuagcgugaaggucuccugcaaagccucuggcgacagcuucuccucuagcgugaucaccuggguuagacaggcuccugggcagggaccggaauggaugggccggauuauccccgugcucggggucgccgcguaugcucaaaacuuuuacggacgcgugacaauuuccgccgauacgagcucuaauaccgccuauauggagcuguccagccuuagauucgaagacacagcuguguuuuacugugcccgggagaccggccgcggcgggaaccuggcucucagacaguauuucuuugauucuuggggacagggcacacugguuaccgucuccagcccuucuacaaagggg

SEQ ID NO: 42759 - RNA, 402 nt, Artificial Sequence
  derived and/or modified sequence opt5 from anti-HIV_Chain
cagcugcaacuccaggagagcggccccgggcuggugaagccuuccgaaacccuuucucugacaugcagcgucuccgacggaucuaucaacagcaauuccuacuauugggccuggauuagacagucuccgggcaaagggcucgaguggaucggaagcguuuacuauuucggcgggacguacuauucccccagccugaagucucgggugaccauguccguggaucgcagcaaaaaccaguuuucucuuaaugucuccagcgugacagcugccgacaccgcgauuuacuauugugcuagacacguucggccuuacgaucgcucuggauaccccgaaagaccuaacugguucgaccccuggggccggggcacacuggugaccgucuccagcgccuccacaaagggg

SEQ ID NO: 42760 - RNA, 402 nt, Artificial Sequence
  derived and/or modified sequence opt5 from anti-HIV_Chain
caggugcaacugcaccaguggggcgccgggcuccugaagcccagcgacacccuuucccugacaugcggaauccucggcgucucuccuccggggagccugacgggauacuauuggaccuggauuagacagcccccuggcaaagggcuugaguggaucggagaaguuuaccauuccggcucuacaaacuauaaucccagccuggcuucccgggugaccauuucuaugggcacaaccaagacacaguucagccuccgccugaccuccgugacggccgcggauagcgcugucuacuauugugccucugggaaaguguggggaaucaccgccagaccucgggacgcuggccuggauguuugggggcaaggaacaaccgugacagucaccuccgccagcacgaagggc

SEQ ID NO: 42761 - RNA, 402 nt, Artificial Sequence
  derived and/or modified sequence opt5 from anti-HIV_Chain
caggugcaacugguccagagcggcgccgagguuaagaaacccggguccucugugaaggugagcugcagagcuuccggaggcucuuucgggaacuacgccaucaauuggguccggcaggcgccuaugcagggacucgaauggaugggcgggauuaucccgauuuuuggaaccacaaacuaugcucaaaauuuccgcggcagagugacgaucaacgccgacaccuuuacaaauaccguuaacauggaucugagcucccuucggucugaggacacagccguguacuauuguggccgcagcauuaaugcugccguccccgggcuggaaggaguguacuauuacuauggcauggcuguuugggggcagggaaccacagugaccgucuccagcgccucuacgaaaggc

SEQ ID NO: 42762 - RNA, 402 nt, Artificial Sequence
  derived and/or modified sequence opt5 from anti-HIV_Chain
uucgugcagcuggucgagagcggcgggggacucguucaacccggcgggucccugagacuuucuugcgccgcuagcggauuuaacuucaauaccuacuggaugaacugggugcggcaggccccuggcaaggggcuggaauggguggcgaauaugaaagaggacggauccgaaaaguauuacgucgauucugugaaaggccgcuuuacaaucagcagagacaacgcuaaaaauucccucuaucugcagaugaacucucuucgggccgaggauacggccguuuacuauugugcucgcaauccggaaagcagaugcauugugggccggaaccgcgggugguguagauacuucgaccuguggggacggggcucccucgucaccgugagccccgccucuacaaagggg

SEQ ID NO: 42763 - RNA, 405 nt, Artificial Sequence
  derived and/or modified sequence opt5 from anti-HIV_Chain
cagcugcaacucgaccagcccggcgccgcuaugaaaagccugggguccucucuuaccaucacaugcagagugagcggagaugaccugggcuccuuccacuuugggacguacuucaugauuuggguccggcagggaccuggccaggggcucgaguauaugggaggcauccugccgucuaccaagacacccaccuacgcccauaaguuucgcggcagaguuagcauuuccgcgccuggggugcccccugugcuuucucuggcucucacaaaccugaccuaugaugacacagccaccuacuucugugcccgggaacgcggaagacacuuugagcccaaaaaucgggaucaucuggaaggcaaguuccucgaccugugggggcgcggaacguuugucagagugagcccu

SEQ ID NO: 42764 - RNA, 405 nt, Artificial Sequence
  derived and/or modified sequence opt5 from anti-HIV_Chain
caggugcaacugguccagcccggcaccgccaugaaaagccucggguccucucugacaaucacgugcagaguuagcggagacgaucuuggcuccuuccacuuugggaccuacuucaugauuugggugcggcaggcuccuggacagggccuggaguauaugggagggauccucccgucuacaaagacccccacauacgcccauaaguuucgcggcagagugagcauuuccgcgccuggcgugcccccuguccugucucuugcucugaccaaccucacauaugacgauaccgccacguacuucugugcccgggaacgcgggagacacuuugagcccaaaaaucgggacaaccuggaaggaaaguucuuugaucuguggggccgcgggaccuucguuagagugagcccu

SEQ ID NO: 42765 - RNA, 405 nt, Artificial Sequence
  derived and/or modified sequence opt5 from anti-HIV_Chain
caggugcaacugguccagcccggcaccgccaugaagacacucgggagcucccugacgaucucuugcagaguuagcggagacgauggcaacuuccacuuugggaccuacuucauggcuugggugcgccaggugccuggacagggccuugaguauaugggagggauucugccguccacaaaaucucccaccuacgcccauaaguuucggggcagagucagcaucuccacagcgggcgugccucccguugugucucucgcucugaccaaucuuacauaugacgauaccgccacguacuucugugcccgggaacgcgggagacacuaugacagcaaaaagcaagagaacuaccggggaaaauuuuucgaucuguggggccgcgggaccugggucagaguguccccuaca

SEQ ID NO: 42766 - RNA, 405 nt, Artificial Sequence
  derived and/or modified sequence opt5 from anti-HIV_Chain
caccuggugcagagcggcaccgaggucaagaaacccggguccucuguuacagugagcugcaaggccuacggagugaacacguucggccucuaugcugucaauugggugagacaagccccugggcagucccuggaauacaucggacagauuuggcgguggaaaucuagcgcgucccaucacuuucgcggcagaguucuuaucucugcuguggaccugaccgggagcuccccgcccauuagcucucucgagaucaagaaccugacauccgaugacaccgccgucuauuucuguacaaccacaagcaccuacgaucaguggucuggacuucaucacgacggcgugauggccuuuuccagcuggggccaagggacgcugauuucuguuuccgcugccagcaccaaagga

SEQ ID NO: 42767 - RNA, 405 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcaccuucucuacauacgccuuuagcugggucagacaggcgccuaucgaagggcucgaguggaugggaggcauuaucccgauuuucgggacggaaaacuaugcucagaaauuucaaggacgggugaccaucacagccgacaaauccaccucuacagccuacauggagcugagcucccuucgcagcgaagauaccgcuguuuauuacugugccagagaccggucuuccgcuauuggcuauugcagcucuaucuccuguuacaagggcagcuucgauaucugggggcagggaacaauggugaccgucucuuccgccagcacgaagggc

SEQ ID NO: 42768 - RNA, 405 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcaccuucucuacauacgccuuuagcugggucagacaggcgccugggcagggacucgaauggaugggcgggaucauuccgaucuucggaacggagaacuaugcucaaaaauuucagggccgggugaccauuacagccgacaaauccaccucuacagccuacauggaacugagcucccuucgcagcgaggauaccgcuguuuauuacugugccagagaccggucuuccgcuaucggcuauugcagcucuauuuccuguuacaaggggagcuucgauaucuggggacagggcacaauggugaccgucucuuccgccagcacgaagggg

SEQ ID NO: 42769 - RNA, 405 nt, Artificial Sequence
  derived and/or modified sequence opt5 from anti-HIV_Chain
gaggugcagcuggucgaaagcggcgggggacucguucaacccggcgggucccugagacuuucuugcgccgcuagcggauucaccuuuuccucuuacagcaugaacugggugcggcaggccccuggcaaggggcuggaguggguguccuauaucucuggaagcuccuacacaauuuauuacgcggacagcguccgcggcagauucacgaucucucgggauaaugcuaaaaacucccucuaucugcagaugaauagccuucgcgacgaagauaccgccguguacuuuugugccagagcuacaccgcccaacccucugaaucucuauaacuacgacucuuccggcagcucuuucgauuacugggggcagggaacccugguuacaguguccagcgccuccaccaagggc

SEQ ID NO: 42770 - RNA, 405 nt, Artificial Sequence
  derived and/or modified sequence opt5 from anti-HIV_Chain
gaggugcagcugguccaaagcggcgccgaaguuaagaaacccggguccucugugaaggugagcugcaaggcuuccggaggcaccuucucuacauacgccuuuagcugggucagacaggcgccugggcagggacucgaguggaugggcgggaucauuccgaucuucggaacggaaaacuaugcucagaaauuucaaggccgggugaccauuacagccgacaaauccaccucuacagccuacauggagcugagcucccuucgcagcgaagauaccgcuguuuauuacugugccagagaccggucuuccgcuaucggcuauugcagcucuauuuccuguuacaaggggagcuucgauaucuggggacagggcacaauggugaccgucucuuccgccagcacgaagggg

SEQ ID NO: 42771 - RNA, 405 nt, Artificial Sequence
  derived and/or modified sequence opt5 from anti-HIV_Chain
gaggugcagcuggucgaaagcggcgccgagguuaagaaacccggguccucugugaaggugagcugcaaggcuuccggaggcaccuucucuacauacgccuuuagcugggucagacaagcgccugggcagggacucgaauggaugggcgggaucauuccgaucuucggaacggagaacuaugcucagaaauuucagggccgggugaccauuacagccgacaaauccaccucuacagccuacauggaacugagcucccuucgcagcgaggauaccgcuguuuauuacugugccagagaccggucuuccgcuaucggcuauugcagcucuauuuccuguuacaaggggagcuucgauaucuggggacaaggcacaauggugaccgucucuuccgccagcacgaagggg

SEQ ID NO: 42772 - RNA, 405 nt, Artificial Sequence
  derived and/or modified sequence opt5 from anti-HIV_Chain
ccccuggugcagcucgagccuagcggcgucgaaguuaagaaaagaggggccuccgugaaggugucuugcaaagucagcggauacucccugaccgagcuuucuaugcacugggugcggcaagcuccgggcaaggggcuggaauggaugggcagcuucgacccccucgauggagacacaaucuaugcccagaaauuucaggggcgcguuacgaugaccguggauacauccaccgacacagcguacauggaucugucuagccuuagauucgaggacaccgcugucuauuacugugccacaccuuccaaggccuauuacuaugauagccccaacuacgaaggagacuuuuacauggauguguggggcaagggcaccacgguuauugugucuuccgcuagcaccaaaggg

SEQ ID NO: 42773 - RNA, 408 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagcugacauccgaugacaccgccgucuauuucuguacaaccacaagcaccuacgauaaauggucuggacuucaucacgacggcgugauggccuuuuccagccggggccaagggacgcugaucucuguuuccgcugccagcaccaaggga

SEQ ID NO: 42774 - RNA, 408 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagggacuggaauacauuggccagaucuggcgguggaaauccucugcgagccaucacuuucgcgggagaguucuuauuuccgcuguggaccugaccggaucuagcccgcccaucuccagccucgagauuaaggucacaucugaugacaccgccguguauuucuguacaaccacauccaccuacgaugaauggagcgaccugcaucacgauggcguuauggccuuuucuuccuggggccaagggacgcuuaucagcgugucugcugccuccaccaaagga

SEQ ID NO: 42775 - RNA, 408 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagcugacauccgaugacaccgccgucuauuucuguacaaccacaagcaccuacgaucgguggucuggacuucaucacgacggcgugauggccuuuuccagcuggggccaagggacgcugaucucuguuuccgcugccagcaccaaagga

SEQ ID NO: 42776 - RNA, 408 nt, Artificial Sequence
  derived and/or modified sequence opt5 from anti-HIV_Chain
ugcaaccccagagugcacagcgagguccagcugguugaauccggcgccgaggugaagaaaccuggggcuucugugaaggucgccuguaaagugagcggaaagaaacucuccgaccugucuauccauuggguucggcaagcgccgggcaaggggcuugaauggaugggaggcuucgaugaggaagacgggaagauuagcuacgagcgcaaauuucagggaagaguguccaugaccgaggauacagcucgggacacggccuucauggaaaugucuagccugcgcuccgaugacaccgccgucuauuuuugcgcugccgcucccagacucgaucugggcgagcuuagcucuggcuuccacuuuugggggcugggaacacucgugaccguuuccagcgccucuacaaagggc

SEQ ID NO: 42777 - RNA, 408 nt, Artificial Sequence
  derived and/or modified sequence opt5 from anti-HIV_Chain
aucugggcuccccugauugccgugaccuuccucguccugcacugcgagagccuuggcacauguugcuguugccaggccuccgggggaacguuuaacaccuucgcgaucaauuggguuagacaagcuccuggccaggggcuggaaugggugggaggcauuaucccgguguuugggacagccucuuacgcccagaaguuccagggacgggucaccgugacaaccgacgagagccgcggcacagcuuauauggaacucaacucccugagaucugaggauaccgccguuuacuauugugcucggggccaaacggaccuuaaugaugaccuguggagcgauuacuccacccccggguuugacuauuggggacagggcacacucgugaccgucucuagcgccuccacaaaaggg

SEQ ID NO: 42778 - RNA, 408 nt, Artificial Sequence
  derived and/or modified sequence opt5 from anti-HIV_Chain
cugcagcccagagugcacagcgagguccaacucguugaauccggcgccgaggugaagaaaccuggggcuucugugaaggucagcugcaaaguguccggauacacccugucugaccuuagcaugcauuggguucggcaggccccgggcaaggggcuggaauggaugggaggcuucgaugaggaagacggggagaucacauaugcgcagaaauuucagggacgcguguccaugacggaggauaccucuagagacacagcuuacauggaacucagcucccugcggagcgaggauaccgccgucuauuacugugccacagcuccccgccuugaacugggcgagcucucuuccggcuuccacuauugggggcugggaacccuggugacaguuagcucugccuccaccaagggc

SEQ ID NO: 42779 - RNA, 408 nt, Artificial Sequence
  derived and/or modified sequence opt5 from anti-HIV_Chain
cagagccaagugcaccugguccaguccggcgccgagguuaagaaacccgggucuagcgugaagguguccugccaggcuucuggaggcaccuucaacacauuugccaucaauugggucagacaggcgccugggcaaggacucgaaugggugggcgggauuaucccgguuuucggaacggcuagcuacgcccagaaauuucagggccgggugaccgucacaaccgacgagucccgcggcacagccuauauggaacugaacucucuuagaagcgaggauaccgcuguguacuauugugcccgggggcagacagaccugaaugaugaccucugguccgauuacagcacccccggauucgacuauuggggccaagggacgcugguuaccgugucuuccgcuagcacaaaggga

SEQ ID NO: 42780 - RNA, 408 nt, Artificial Sequence
  derived and/or modified sequence opt5 from anti-HIV_Chain
ggcagcgaggugcagcuggucgaauccggggccgagguuaagaaaagaggagcuucugugaaggugagcugcaaagucuccggcuacucucucaccgaacugagcaugcacugggugcggcaagcccccgggaagggacuugaguggaugggcuccuucgacccucuggauggggacacaaucuaugcgcagaaauuucagggacgcguuacgaugaccguggauacaucuaccgacacagcuuacauggaucucagcucccugagauucgaagacaccgccgucuauuacugugccacaccgagcaaggcuuauuacuaugauucucccaacuacgagggcgacuuuuacauggauguguggggcaaggggaccacgguuauuguguccagcgccucuaccaaagga

SEQ ID NO: 42781 - RNA, 408 nt, Artificial Sequence
  derived and/or modified sequence opt5 from anti-HIV_Chain
caggugcaacugguccagagcggcggggagguuaagaaacccggagccuccgugaaggugucuugcaaagucagcggcuacucccucaccgaacugucuaugcacugggugagacaggcuccugggaagggacuugaguggaugggcguuuucgacccgcuggaaggggauggaguguauguccagaaauuucggggccgcgugaucaugacagaggacacgagcaccgauacagccuacauggaacucaccucccugagaucugaggacacagcgauuuauuacugugcuaccaaggccaaggauuauuacuaugagagcuccgacuacagccccuacuauuacuauuacauggauguuuggggcaaagggacaaccgugacggucucuuccgccagcaccaaggga

SEQ ID NO: 42782 - RNA, 408 nt, Artificial Sequence
  derived and/or modified sequence opt5 from anti-HIV_Chain
gaggugcagcugguccaaagcggcgccgaaguuaagaaacccggggcuuccgugaaggugucuugcaaagucagcggauacacccucacagagcuguccaugcacugggugagacaggccccuggcaaggggcuugaauggaugggaguuuucgacccgcuggagggcgaugggguguaugcggaaaaauuucggggacgcgucaucaugacggaggacaccucuacagauaccggcuacauggagcucacaagccugagauccgaagacaccgcuauuuauuacugugccacaaaggccaaggauuauuacuaugagucuagcgacuacucccccuacuauuacuauuacauggauguguggggcaaagggaccacgguuaccgugagcucugcuuccacaaaggga

SEQ ID NO: 42783 - RNA, 408 nt, Artificial Sequence
  derived and/or modified sequence opt5 from anti-HIV_Chain
caggugcaacugguccagagcggcgccgagguuaagaaacccggggcuuccgugaaggugucuugcaaagccagcggauacaccuucacaagauaucacauccauuggguccggcacgcgccuggccaggggcucgaauggaugggaaagauuaacccgucccgcgcuucuacgaaauacgccaagaaguuucaggacagagugaccaugacacgggauaccagcacauccaccguuuauauggagcugucuagccuucgcggcgacgauacagccguguacuauugugggagagaaaugggaaccuucacgcugcucggcgucgugaucgaccauuacgauuuuuaucccauggacguuuggggccaagggaccccugugacagucuccagcgcuucuaccaaagga

SEQ ID NO: 42784 - RNA, 408 nt, Artificial Sequence
  derived and/or modified sequence opt5 from anti-HIV_Chain
agcagacccccuuccugccugcucggcuguuggugcuguucuggguuccugcuuccggccgugauccugcccaaccuccacagcccuugccugucccuucuggagucucagcccccuagccucgcugaccuggucuccgccuuugcgguuauggauauucccaucuacauuggaaccuaucggucucaagcuagccugcauuccagcucuacaaaguucccuacggacuuucucggcucccagaccgggagcguggccgugggacagggccagaucucucaucugcgcuccgucgaauggagacuucggaugugggaguucauuacagcccugaaagugcacauguuucucagccgcucugauagagggccgcgguggaagaauguuuccagccugcuuaacucccgc

SEQ ID NO: 42785 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguuauuaucucugcuguggaccuuaccgggagcuccccgcccauuagcccucuggagaucaagaaccucacaucugaugacaccgccgucuauuucuguacaaccacauccaccagcgaucgguggucuggacugcaucacgacggcgugauggccuuuuccagcuggggccaagggacgcuuaucucuguuuccgcugccagcaccaaagga

SEQ ID NO: 42786 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguuauuaucucugcuguggaccuuaccgggagcuccccgcccauuagcucucuggagaucaagaaccucacauccgaugacaccgccgucuauuucuguacaaccgccagcacauacgauaaauggucuggacugcaucacgacggcgugauggcuuuuuccagcuggggccaagggacccuuaucucuguuuccgccgcuagcacgaaggga

SEQ ID NO: 42787 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggccgagcccucccaucuccagccucgagauuaagaaccugacaucugaugacaccgccgucuauuucuguacaaccacauccaccuacgauaaauggagcggacuucaucacgacggcgugauggccuuuucuuccuggggccaagggacgcugaucagcguuucugcugccuccaccaaggga

SEQ ID NO: 42788 - RNA, 411 nt, Artificial Sequence
  derived and/or modified sequence opt5 from anti-HIV_HeavyChain
cagauccaccuggugcaaagcggcaccgaggucaagaaacccggguccucuguugccgugagcugcaaggcuuacggagugaacacauucggccucuaugccgucaauugggugagacaggcgccugggcagucccuggaauacauuggacagaucuggcgguggaaaucuagcgcuucccaugacuuucgcggcagaguuauuaucucugccguggaucuuacggggagcuccccgcccauuagcucucuggagaucaagaaccucaccuccgacgauacagccgucuauuucuguaccgcuacaagcaccccugacuacuggucuggacugcaccaugauggcgugauggccuuuuccagcuggggccaagggacacuuaucucuguuuccgcugccagcaccaaagga

SEQ ID NO: 42789 - RNA, 411 nt, Artificial Sequence
  derived and/or modified sequence opt5 from anti-HIV_HeavyChain
cagauccaccuggugcaaagcggcaccggggucaagaaacccggauccucuguuacagugagcugcaaggccuacggcgugaacacguucgggcucuaugcugucaauugggugagacaggccccuggacagggccuggaguacauugggcagaucuggcgguggaaauccucugcgagccaucacuuucgcggaagaguucuuauuuccgcuguggaccugaccggcucuagcccgcccaucacaucccucgaaauuaagaacgucaccagcgaugacacagccguguauuucuguaccacaaccucuacguacgauaaaugguccggccuguaucaugacgggguuauggccuuuagcucuuggggacaaggcacccuuaucuccgugagcgcugccucuacaaagggg

SEQ ID NO: 42790 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguuauuaucucugcuguggaccuuaccgggagcuccccgcccauuagcucucuggagaucaagaaccucacauccgaugacaccgccgucuauuucuguacaaccacaagcaccucugauuacugguccggacugcaucacgacggcgugauggccuuuagcucuuggggccaagggacgcuuaucuccguuagcgcugccuccaccaaagga

SEQ ID NO: 42791 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagaaccugacauccgaugacaccgccgucuauuucuguacaaccacaagcaccuacgaucgguggucuggacuucaucacgacggcgugauggccuuuuccagcuggggccaagggacgcugaucucuguuuccgcugccagcaccaaagga

SEQ ID NO: 42792 - RNA, 411 nt, Artificial Sequence
  derived and/or modified sequence opt5 from anti-HIV_HeavyChain
cagauccaccuggugcaaagcggcaccgaggucagaaagcccggguccucuguuacagugagcugcaaagccuacggagugaacacguucggccucuaugcugucaauugggugcggcaggccccugggcagucccuggaauacauuggacagaucuggcgcuggaagucuagcgcgucccaucacuuuagaggccggguucuuauuucugcuguggaccugaccgggagcuccccgcccaucagcucucucgagauuaaaaaccugacauccgaugacaccgccgucuauuucuguacaaccacaagcaccuacgauaaguggucuggacuucaucacgacggcgugauggccuuuuccagcuggggccaagggacgcugaucucuguuuccgcugccagcaccaaagga

SEQ ID NO: 42793 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagaaccugacauccgaugacaccgccgucuauuucuguacaaccacaagcaccuacgaucaauggucuggacuucaucacgacggcgugauggccuuuuccagcuggggccaggggacgcugaucucuguuuccgcugccagcaccaaagga

SEQ ID NO: 42794 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucuccugggugagacaggccccugggcagcggcuggaauacauuggacagauccgcagauggaaaucuagcgcgucccaucacuuucggggccgcguuaccgugucugcugucgacccgacagggagcuccccucccauuagcucucuugagaucagagaucugaccacagacgauaccgccguguauuucuguacaaccacguccaccagcgacuacuggucuggacuccauaaugaacggggcacagccuuuuccagcuggggccaagggacccugauuucuguuuccgcugccagcacaaaggga

SEQ ID NO: 42795 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagggacuggaauacauuggccagaucuggcgguggaaauccucugcgagccaucacuuucgcgggagaguucuuauuuccgcuaucgaccugaccggaucuagcccgcccauuuccagccucgagaucaagaacgugacaucugaugacaccgccgucuauuucuguacaaccauguccacauacgauaaauggagcggccugcaucacgacggcgugauggccuuuucuuccugggggcaaggaacccuuaucagcguuucugcugccuccacgaagggc

SEQ ID NO: 42796 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacgaagugaacacguucggacucuaugcugucaauugggugagacaggccccuggccagucccuggaguacauugggcagaucuggcgguggaaaucuagcgcgucccaucacuuucgcggaagaguucuuauuucugcuguggaccugaccggcagcuccccgcccaucagcucucucgaaauuaagaacgucacauccgaugacaccgccguguauuucuguacaaccacaagcacccaugauaaauggucugggcugcaccaugacggaguuauggccuuuuccagcuggggccaaggcacgcuuaucucuguguccgcugccagcaccaagggg

SEQ ID NO: 42797 - RNA, 411 nt, Artificial Sequence
  derived and/or modified sequence opt5 from anti-HIV_HeavyChain
cagauccaccuggugcaaagcggcaccgaggucaagaaacccggguccucuguuacagugagcugcaaggccuacggagugaacacguucggccucuaugcugucaauugggugagacaggccccugggcagggacuggaauacauuggccagaucuggcgguggaaauccucugcgagccaucacuuucgcgggagaguucuuauuuccgcuguggaccugaccggaucuagcccgcccaucuccagccucgagauuaagaacgucacaucugaugacaccgccguguauuucuguacaaccacauccaccuacgauaaauggagcggccugcaucacgacggcguuguggccuuuucuuccugggggcaaggaacgcuuaucagcgucucugcugccuccaccaagggc

SEQ ID NO: 42798 - RNA, 411 nt, Artificial Sequence
  derived and/or modified sequence opt5 from anti-HIV_Chain
caggugacccugguccaaagcggcgccgagguuaagaaacccggggcuuccgugagaaucucuugccgggccagcggauucacauuugacgauuacuccgacuauucuuucauuccuacgaccuaccucauccacugguuucgccaggcgccgggccaggggcuggaauggauggcuuggauuaacagcgugaauggaggcagaaacaucgcccggcaguuccaagggcgcgucacaguggccagagaucgguccaauucuauugcuuuucuugaguucagcggacugcgccaugacgauaccgccguuuauuuuugugcuagagaccggcgcgaugacgauagagccuggcuccuggaccccuggggccagggcacacgggugaccgucuccagcgcgucuacaaagggg

SEQ ID NO: 42799 - RNA, 411 nt, Artificial Sequence
  derived and/or modified sequence opt5 from anti-HIV_Chain
cagauccaccuggugcaaagcggcaccgaggucaagaaacccggguccucuguuacagugagcugcaaggccuacggagugaacacguucggccucuaugcugucaauugggugagacaggccccugggcagucccuggaauacauuggacagaucuggcgguggaaaucuagcgcgucccaucacuuucgcggcagaguucuuauuucugcuguggaccugaccgggagcuccccgcccaucagcucucucgagauuaagaaccugacauccgaugacaccgccgucuauuucuguacaaccacaagcaccuacgauaaauggucuggacuucaucacgacggcgugauggccuuuuccagcuggggccaagggacgcugaucucuguuuccgcugccagcaccaaggga

SEQ ID NO: 42800 - RNA, 414 nt, Artificial Sequence
  derived and/or modified sequence opt5 from anti-HIV_Chain
gugguccagcugguucaaagcggcgccgaggugagaaagcccggguccucucucaaagugagcugcaaguccucuggaggcaccuucagccgguuugucgugaacuggguucgccaggcuccugggcagggacuggaauggaugggcgggaugaucccgauuuucggaaucgccaaauacgcgcagaaguuucaagacagagugacaaugacggcugaugaguccaaaaauaccgucuaucuugacuucucuagccugcgguccgaugacacagccguguacuauugugcccgcgauagaggcgacacccggcuccuggauuacggcgacuaugaagaugagcgcuacuauuacgggauggacguuuggggacagggcacaaccgugauugucagcucugcuuccacaaagggg

SEQ ID NO: 42801 - RNA, 414 nt, Artificial Sequence
  derived and/or modified sequence opt5 from anti-HIV_Chain
caggugcaacugguccagagcggcgccgagguuagaaagcccggguccucucucaaagugagcugcaaguccucuggaggcaccuucagccgguuuguggucaacugggugcgccaggcuccugggcagggacuggaauggaugggcgggaugaucccgauuuucggaaucgccaaauacgcgcaaaaguuucaggacagaguuacaaugacggcugaugaguccaaaaauaccguguaucuugacuucucuagccugcgguccgaugacacagccgucuacuauugugcccgcgauagaggcgacacccggcuccuggauuacggcgacuaugaagaugagcgcuacuauuacgggauggacguguggggacagggcacaaccguuauugugagcucugcuuccacaaagggg

SEQ ID NO: 42802 - RNA, 414 nt, Artificial Sequence
  derived and/or modified sequence opt5 from anti-HIV_Chain
gaggugcagcuggucgaaagcggcgccgagguuagaaagcccggguccucucucaaagugagcugcaaguccucuggaggcaccuucagccgguuuguggucaacugggugcgccaagcuccugggcagggacuggaauggaugggcgggaugaucccgauuuucggaaucgccaaauacgcgcagaaguuucaggacagaguuacaaugacggcugaugaguccaaaaauaccguguaucuugacuucucuagccugcgguccgaugacacagccgucuacuauugugcccgcgauagaggcgacacccggcuccuggauuacggcgacuaugaagaugagcgcuacuauuacgggauggacguguggggacaaggcacaaccguuauugugagcucugcuuccacaaagggg

SEQ ID NO: 42803 - RNA, 414 nt, Artificial Sequence
  derived and/or modified sequence opt5 from anti-HIV_Chain
caggugcaacuggucgagagcggcgccgaaguuagaaagcccggguccucucucaaagugagcugcaaguccucuggaggcaccuucagccgguacguggucaacugggugcgccaggcuccugggcagggacuggaguggaugggcgggaucauuccgaucuuuggaauugccaaauaugcgcagaaguuccaagacagaguuacaaugacggcugaugaacccaaaaauaccguguaccuugacuuuaacucccugcggucugaugacacagccgucuauuacugugcccgcgauagaggcgacacccggcuccuggauuauggcgacuacgaggaugaacgcuauuacuacgggauggacguguggggacagggcacaaccguuaucgugagcuccgcuagcacaaagggg

SEQ ID NO: 42804 - RNA, 414 nt, Artificial Sequence
  derived and/or modified sequence opt5 from anti-HIV_Chain
caggugcaacugguccagagcggcgccgagguuagaaagcccggguccucucucaaagugagcugcaaguccucuggaggcaccuucagccgguacguggucaacugggugcgccaggcuccugggcagggacuggaauggaugggcgggaugaucccgauuuuuggaaucgccaaauaugcgcaaaaguuccaggacagaguuacaaugacggcugaugaguccaaaaauaccguguaccuugacuuuucuagccugcgguccgaugacacagccgucuauuacugugcccgcgauagaggcgacacccggcuccuggauuauggcgacuacgaagaugagcgcuauuacuacgggauggacguguggggacagggcacaaccguuauugugagcucugcuuccacaaagggg

SEQ ID NO: 42805 - RNA, 414 nt, Artificial Sequence
  derived and/or modified sequence opt5 from anti-HIV_Chain
caggugcaacugguccagagcggcgccgagguuagaaagcccggguccucucucaaagugagcugcaaguccucuggaggcaccuucagccgguacguggucaacugggugcgccaggcuccugggcagggacuggaauggaugggcgggaucauuccgaucuuuggaauugccaaauaugcgcaaaaguuccaggacagaguuacaaugacggcugaugaguccaaaaauaccguguaccuugacuuuucuagccugcgguccgaugacacagccgucuauuacugugcccgcgauagaggcgacacccggcuccuggauuauggcgacuacgaagaugagcgcuauuacuacgggauggacguguggggacagggcacaaccguuaucgugagcucugcuuccacaaagggg

SEQ ID NO: 42806 - RNA, 414 nt, Artificial Sequence
  derived and/or modified sequence opt5 from anti-HIV_Chain
caggugcaacuggucgagagcggcgccgaaguuagaaagcccggguccucucucaaagugagcugcaaguccucuggaggcaccuucagccgguacguggucaacugggugcgccaggcuccugggcagggacuggaguggaugggcgggaucauuccgaucuuuggaauugccaaauaugcgcagaaguuccaagacagaguuacaaugacggcugaugaauccaaaaauaccguguaccuugacuuuucuagccugcgguccgaugacacagccgucuauuacugugcccgcgauagaggcgacacccggcuccuggauuauggcgacuacgaggaugaacgcuauuacuacgggauggacguguggggacagggcacaaccguuaucgugagcucugcuuccacaaagggg

SEQ ID NO: 42807 - RNA, 414 nt, Artificial Sequence
  derived and/or modified sequence opt5 from anti-HIV_Chain
caggugcaacugguccagagcggcgccgagguuagaaagcccggguccucucucaaagugagcugcaaguccucuggaggcaccuucagccgguacguggucaacugggugcgccaggcuccugggcagggacuggaauggaugggcgggaucauuccgaucuuuggaauugccaaauaugcgcaaaaguuccaggacagaguuacaaugacggcugaugagcccaaaaauaccguguaccuugacuuuaacucccugcggucugaugacacagccgucuauuacugugcccgcgauagaggcgacacccggcuccuggauuauggcgacuacgaagaugagcgcuauuacuacgggauggacguguggggacagggcacaaccguuaucgugagcuccgcuagcacaaagggg

SEQ ID NO: 42808 - RNA, 414 nt, Artificial Sequence
  derived and/or modified sequence opt5 from anti-HIV_Chain
gugguccagcugguucaaagcggcgccgaggugagaaagcccggguccucucucaaagugagcugcaaguccucuggaggcaccuucagccgguacgucgugaacuggguucgccaggcuccugggcagggacuggaauggaugggcgggaugaucccgauuuuuggaaucgccaaauaugcgcagaaguuccaagacagagugacaaugacggcugaugaguccaaaaauaccgucuaccuugacuuuucuagccugcgguccgaugacacagccguguauuacugugcccgcgauagaggcgacacccggcuccuggauuauggcgacuacgaagaugagcgcuauuacuacgggauggacguuuggggacagggcacaaccgugauugucagcucugcuuccacaaagggg

SEQ ID NO: 42809 - RNA, 414 nt, Artificial Sequence
  derived and/or modified sequence opt5 from anti-HIV_Chain
uucaucugcuuuagcguggucguuagacugcucgaguucggcgggcggcuggugcagcccggaggcucccuucgccugucuuguagcgccuccggguuuaccuucucuaacagcgcuauguccugggugagacaagccccuggaaagggccucgaaugggucucuagcauucuguccagcggggugggaacauuuuacgcggacucuguuaaaggccgguucacggugucccgcgauaauagcagaaacacccuuuaucugcagaugaagucucuccgggcugaggacacagcccuguacuauugcgccaaaguccagauccagcaacugaauuuuggcgugauuaccgaugcugggcucgacguuuggggaaagggcacaacccugaucguguccagcgccucuacaaaaggg

SEQ ID NO: 42810 - RNA, 414 nt, Artificial Sequence
  derived and/or modified sequence opt5 from anti-HIV_Chain
caggugcaacugguccagagcggcgccgagguuagaaagcccggguccucucucaaagugagcugcaaguccucuggaggcaccuucagccgguacguggucaacugggugcgccaggcuccugggcagggacuggaauggaugggcgggaucauuccgaucuuuggaauugccaaauaugcgcaaaaguuccaggacagaguuacaaugacggcugaugaguccaaaaauaccguguaccuugacuuuucuagccugcgguccggcgauacagccgucuauuacugugcccgcgacagaggcgauacccggcuccuggacuauggggauuacgaagacgagcgcuauuacuacggaauggauguguggggccaggggacaaccguuacagugagcucugcuuccaccaaggga

SEQ ID NO: 42811 - RNA, 417 nt, Artificial Sequence
  derived and/or modified sequence opt5 from anti-HIV_Chain
caggugcaacuggucgagagcggcgccgaaguuaagaaacccggguccucugugaaggugagcugcaaggcuuccggaggcaccuucaacaucuuugccuucucuugggucagacaggcgccugggcagggacucgaguggaugggcgggauuaucccgauuuuugcuagccccaauuacgcccagcgguuccaaggacgcgugacaaucacggccgacgaauccaccucuacaguucacauggagcugagcucccuuagaagcgaagauaccgcuauuuauuacugugccaaagacgcucauaugcacaucgaggagccucgggauuaugacuacaucuggggcacaucucccuauuacuuugauuauuggggccaggggacccuggugacagucuccagcgccucuaccaaagga

SEQ ID NO: 42812 - RNA, 417 nt, Artificial Sequence
  derived and/or modified sequence opt5 from anti-HIV_Chain
caggugcaacuggucgagagcggcgccgaaguuaagaaacccggggcuuccgugaaggugucuugcaaagccagcggauacaccuucacaucccacgacaucaacugggucagacaggcgacgggccaggggcucgaguggaugggauggaugaauccuaacucuggcgauaccggguaugcucauaaguuucagggacgggugacaaugacccgcaauacaccgauuagcaccgccuacauggaacuguccucucuuagaagcgaggacacagccguuuauuacugugcucggggccgcgccaccuccagaaacacgcccugggcucacuauuacgauagcucuggcuauuacggggccggagacuacuggggccaagggacccuggugacagucuccagcgcgucuaccaaagga

SEQ ID NO: 42813 - RNA, 417 nt, Artificial Sequence
  derived and/or modified sequence opt5 from anti-HIV_Chain
caggugcaaaucagacagagcggccccgggcuggucaagccucucgagacccugucccuuucuugcauuguuuucggaggcagcuuuaucgccuaccacuggacauggauucggcaggcuccgcugaaagggcucgaauggaucggagacauugaucagggcggggacaucacguauucccccucucuuaagagccgcgugaccauguccguggauagaucuaaaagccaauucucccugaagcugagcucugucacagccgcggacgcugccguguacuauuguguucggggaccucccaaccgcuacgccgugaccuccuuuacaagcggcacccauagagagcggucuuccuauuacuucgauuauuggggcccugggacacucgucaccgugagcucugcuuccacgaaagga

SEQ ID NO: 42814 - RNA, 423 nt, Artificial Sequence
  derived and/or modified sequence opt5 from anti-HIV_Chain
aacggcgggagccugagacucuccugccgggugucuggauucggcuuucaccuguacgagaugaauuggguccgccaggcccccgggaagggacuugaauggaucagcuccauuucuggcagcggggaguccacccauuauucugacagcaucacaggaagauucuccaugagccgggaugaagcuaaagacucucuguaccuccaaaugaacaaucugcgcguugaggauacggccguguauuacuguaccagaggcuuuuccaugggcgacgggacaggauucagcuuugauaccuggggccgggggacaauggugaccgucucuuccggacuugacacagugagccuggcgucuaccaagggcccuuccguuuucccgcucgcucccugcagccgcuccacgucugaugccagacugagc

SEQ ID NO: 42815 - RNA, 423 nt, Artificial Sequence
  derived and/or modified sequence opt5 from anti-HIV_Chain
caggugcaacugguccagagcggcgccgagguuaagaaacccggguccucugugaaggugagcugcaaggcuuccggaggcaccuucucuacauacgccaucagcugggucagacaggcgccugggcagggacucgaauggaugggcgggauuaucccguccuuuucuaugagcaacuaugcucaagacuuccagggacggcugacgauuaccgccgaugaguccacaagcucuguguacauggaacuuaauucccugcgcagcgaggacaccgccguuuauuacugugcuagagauuuuccccgguuccaccgccucgugggcaacuaugacuuuuggagaggcacacuggaucgguucucuuacauggaccuuugggggcgcggaaccgccgucacaguguccagcgcuucuaccaaaggc

SEQ ID NO: 42816 - RNA, 423 nt, Artificial Sequence
  derived and/or modified sequence opt5 from anti-HIV_Chain
cuggugcagcucgucgagagcggcgggggaguugugcaacccggcagaucccugcggcuuucuugcgccgcuagcggguucaccuuuuccacauacgccaugcacugggugcgccaggcgccuggaaagggccuggaaugggucgcugugaucucuuaugacgggagcaacaaauucuacgccgauuccguuaagggaagauuuacgauuucucgggacaauagcaaaaacacccucuaucugcagaugaacucccuucgcgccgaggauacagcuguguacuauugugccagaccgaaguuccugcccggcgcugacaucgucgugguuguggccgcgaccccuuuugauuacuggggccaggggaaucccggacaucggcuccugagcuuccaccaaggcccuauugggcugcccccugga

SEQ ID NO: 42817 - RNA, 423 nt, Artificial Sequence
  derived and/or modified sequence opt5 from anti-HIV_HeavyChain
auggaguggagcggcguguucaucuuucugcucuccgucaccgccgggguucacucugaagugcagcugguggagagcggaggcgggcuugucaagcccggaggcucccugagacucucuugcgcugccagcggguacacauucuccaacuauuggauuggaugggugcggcaagcgccuggcaaaggccuggaauggaucggggacauuuacccgggaggcaauuauauccgcaacaaugagaaguuuaaagauaagacgacccuuucugcugacacaagcaaaaacaccgccuaccugcagaugaacucccucaagacagaagauaccgccguuuauuacugugggagcucuuucggauccaauuauguguuugcuugguucacauacuggggccaggggacccuggucacggugagcucu

SEQ ID NO: 42818 - RNA, 423 nt, Artificial Sequence
  derived and/or modified sequence opt5 from anti-HIV_HeavyChain
auggaguggagcggcguguucaucuuucugcucuccgucaccgccgggguucacucucaggugcaacuggugcagagcggacccgacgucaagaaaccuggcacauccaugaagaugucuugcaaaacgagcggguacaccuucuccaacuauuggauuggaugggugagacaggcuccgggccaggggcuugaauggaucggagauauuuaccccggcggcaauuauauccggaacaaugagaaguuuaaagacaagacaacccugacagccgauaccucuacaagcaccgcguacaugcaacucgggucccugcgcagcgaagacacggcuguuuauuacuguggaucuuccuucggcagcaacuauguguuugccugguucaccuacugggggcagggaacacuugucaccgugucuucc

SEQ ID NO: 42819 - RNA, 429 nt, Artificial Sequence
  derived and/or modified sequence opt5 from anti-HIV_Chain
cagguguucguccaacugguucagagcggcgggggacucgugcagcccggcggguccgugagacugucuugcaccgccagcggauuucuuuucuccacauacucuaugaacuggguccggcaggcuccuggcaaggggcuggagugggugagcuccaucucuacgaccagcaauuauauuuacuaugccgacuccguuaaaggacgcuuuacaaucagcagaucuaacggccaaggcucccucuaccugcagcuuaauagccugcggguggaagauaccgcggucuauuacugugcucgcgacacaaaggugggggccccgagacaggauugcuaugccauggaccucuggggacagcgggaucacggccaucgccugcugucuuuccaccaagggcccauuggacucccucccggcgcucugcuucag

SEQ ID NO: 42820 - RNA, 432 nt, Artificial Sequence
  derived and/or modified sequence opt5 from anti-HIV_Chain
aucauucuguuccucguggccaccgcuacaggcguccacagcgacauccagaugacgcaaucccccucuagccuguccgccucuguuggggauagagugaccauuacaugccgggcgagccaguccaucgaccgcuaccuuaacugguaucagcauaagccuggaaaagcuccgaagcugcucauuuacgccgccucuaaucugcacaccgaugugcccagcagauuuuccggcagcggggcuggaacauauuucacccuuacaaucaccucucugcagccugaggacuuugccacguacuauugucaacagucccauagccccucuuucggccaggaauccuacagcaucgcuuuugggcagggaacccggcucgagauuaaacgcacagucgccgcgccuucuguguucaucuuucccccuuccgaugaa

SEQ ID NO: 42821 - RNA, 432 nt, Artificial Sequence
  derived and/or modified sequence opt5 from anti-HIV_Chain
cugcagcaacuccaggugcccagacugagcauguggcgggucuucaagguugccgcugccaccggcgcgcagacacuuacgguggaggaaccuggguccucugugaaagucagcugcaaggcuuccggaggcucuagcaccgccuacggguauuccugggugcgccaggccccgggacaaggcuuugaguggauggggagaaucauucccuucuacggaaucauuacauaugcuccuaaauuucagggccggguuaccaucacagccgaccgcucuaccagcacaguguacauggaacugaccucccucacguucgcugauaccgcccuguuuuucugugcgagagacuuuggcgauccccggaacggguauuacuucgacagcugggaucagggacuuuggcugacagucucuuccgccagcaccaagggc

SEQ ID NO: 42822 - RNA, 432 nt, Artificial Sequence
  derived and/or modified sequence opt5 from anti-HIV_Chain
caggugagacuggagcaaagcggcgucgccaugcggaagcccggggcuuccguuacccucucuugccaggccagcggauacaacuucgugaaauauaucauucacugggugcgccagaagccuggccugggguuugaaugggucggaaugaucgacccguacagaggccggcccugguccgcgcauaaauuccaggggcgccuuucucugagcagagauacauccauggagauucucuauaugacgcugaccucucuuaagagcgacgauacagcuaccuacuuuugugcccgggccgaagcugccuccgacauccacagccgcccuauuauccugacaggacccggcgaguauggccucgaucuggaacauauggacuggaccuggagaauccugugccuccuggcuguggccccugggugucacucucaa

SEQ ID NO: 42823 - RNA, 435 nt, Artificial Sequence
  derived and/or modified sequence opt5 from anti-HIV_Chain
auguuccuguuucucguggccggcgcuaccgggguccagagccaaguuuaccuggugcccuucggaccugaggugaagaaaccgggcuccucugucaaggugagcugcaaagccuccggggacucuuuuacaagcuccguuaucacgugggugagacaggcgcccggacagggcccugaauggauggggcgggucauucccgugcuuggaguugcugccuaugcccagaaguucuacggccgcgugaccaucacagcugauaccucuagcaacacagccuauauggaggucaauucccugagauuugaagacaccgcuguguacuauugugcccgggagacaggccgcgggggaaaccucgcgcugagacaauacuucuuugauagcuggggccaggggacccuugugacggucucuuccccuagcaccaaagga

SEQ ID NO: 42824 - RNA, 438 nt, Artificial Sequence
  derived and/or modified sequence opt5 from anti-HIV_Chain
caggugcaacugcaggagagcggccccgggcucgucaagccuuccggaacccugucucuuacaugcgccguuagcggcgcuuccaucucuagcagaaacugguggacgugggugcggcagccgcccgggaaaggacuggaauggauuggcgagaucuacgaauccggggccaccaauuauaacccuucucucaagagccgcgugacaauuuccgucgacaaaagcaagaaucaguucucucugagacuuaccuccgugacagcggcugauaccgccguuuacuuuugugcccggcugaugacauucggaggccucaucggcacccuggacuauugggggcaaggaacgcuggugaccguccuccagcccccuccccgcgcucacagauaccauccucggaaccugcuucaggagcaccugugcgcccgcgugaugccg

SEQ ID NO: 42825 - RNA, 444 nt, Artificial Sequence
  derived and/or modified sequence opt5 from anti-HIV_HeavyChain
auggaguggagcggcguguucaucuuucugcucuccgucaccgccgggguucacucugaagugcagcugguggagagcggaggcgggcuugucaagcccggaggcucccugagacucucuugcgcugccagcggguacacauucuccaacuauuggauuggaugggugcggcaagcgccuggcaaaggccuggaauggaucggggacauuuacccgggaggcaauuauauccgcaacaaugagaaguuuaaagauaagacgacccuuucugcugacacaagcaaaaacaccgccuaccugcagaugaacucccucaagacagaagauaccgccguuuauuacugugggagcucuuucggauccaauuauguguuugcuugguucacauacuggggccaggggacccuggucacggugagcucuggagagucccugaagccccuc

SEQ ID NO: 42826 - RNA, 444 nt, Artificial Sequence
  derived and/or modified sequence opt5 from anti-HIV_HeavyChain
auggaguggagcggcguguucaucuuucugcucuccgucaccgccgggguucacucucaggugcaacuggugcagagcggacccgacgucaagaaaccuggcacauccaugaagaugucuugcaaaacgagcggguacaccuucuccaacuauuggauuggaugggugagacaggcuccgggccaggggcuugaauggaucggagauauuuaccccggcggcaauuauauccggaacaaugagaaguuuaaagacaagacaacccugacagccgauaccucuacaagcaccgcguacaugcaacucgggucccugcgcagcgaagacacggcuguuuauuacuguggaucuuccuucggcagcaacuauguguuugccugguucaccuacugggggcagggaacacuugucaccgugucuuccggcgagagccugaagccucuc

SEQ ID NO: 42827 - RNA, 447 nt, Artificial Sequence
  derived and/or modified sequence opt5 from anti-HIV_Chain
caggccagacuggaccaauggggcaccgggcuccugaagcccagcgagacacuuucccugaaaugcgcuguguucggaguccucuuuacggauuacaacuggaccuggguucggcagucuccuggcaaggggcuggaauggaucggacaccuugaccaucgcggcgggggaaauuauaacccgagccuggaguccagagugacaauuucucucgauuacagcaaagcccaguucucccugcaccugaagucugugaccgucgcggacacagcucucuauuacugugccggcgccgugaaaggcuuuugguucgaugaaguuuauaauugguuugggcccggagugcgggagccuuggcugcccagcccucagcccccuccgcgcgcucauagauccagccccuggcacccucccccucgggcuccccuugucaccgccacagugccg

SEQ ID NO: 42828 - RNA, 447 nt, Artificial Sequence
  derived and/or modified sequence opt5 from anti-HIV_Chain
caggccagacuggaccaauggggcaccgggcuccugaagcccagcgagacacuuucccugaaaugcgcuguguucggaguccucuuuacggauuacaacuggaccuggguucggcagucuccuggcaaggggcuggaauggaucggacaccuugaccaucgcggcgggggaaauuauaacccgagccuggaguccagagugacaauuucucucgauuacagcaaagcccaguucucccugcaccugaagucugugaccgucgcggacacagcucucuauuacugugccggcgccgugaaaggccugugguuugaugaaaccuauacaugguucgggcccuggagccagggaacccggguuacgguggcuuccgccagcaccaagggcccuucugucuuuccccuugcuccuuccagcaagucuacauccgggacccgcgaccugagc

SEQ ID NO: 42829 - RNA, 447 nt, Artificial Sequence
  derived and/or modified sequence opt5 from anti-HIV_Chain
gccgcuagacuggaccaguggggcaccgggcucgugaagcccagcgagacacugucccuuaaaugcgccgucuucggaguugauuuuccugacuacacguggaccugggcgcggcaagcuccgggcaaggggcuggaauggaucggacaccgcgaucauagaggcgggucuagcuauaaccccucccucucuggacgggccacaauuagccuggacaccuccaaagcccaguucucucuucacaucaagagcgugacaguggcugauaccgccacauacuauugugcuggcgccgucgcgggccugugguuugaggacgccuacaauugguucgggccuuggucccagggaacccucgugacgguugcugccgcuagcaccaaaggccccucuguguuuccucuggcccccuccagcaagucuacauccgggcaugcgagcguccug

SEQ ID NO: 42830 - RNA, 450 nt, Artificial Sequence
  derived and/or modified sequence opt5 from anti-HIV_Chain
cuggcccagcucgagcaaagcggcgggggaguggucaagcccggcgggucccugagacuuccuugcgcugccucuggauucaccuuuaucgacuacuauauggcguggauucggcuggcuccgggcaaagggcucgaauggcugagcuacaucuccaagaacggagauuauacaaaauacucugagagccuuaagggccgcuucacgauuuccagagacaaugccaaaaaccugguuauccuccagcugaaucggcugcgcgccgaugacaccgcuauuuauuuuugugccagagcugauggccucacauacuucggggaacugcuucaguauaucuuugaccuguggggacagggcgcccgggugaucgugucuagcgcguccaccaaggggcccagcgucuucccucucgcccccucuuccaagagcacaucuggacacgcuuccgug

SEQ ID NO: 42831 - RNA, 459 nt, Artificial Sequence
  derived and/or modified sequence opt5 from anti-HIV_Chain
caggugcaacugguccagagcggcgccgagguuaagaaacccggggcuuccgugaaggugucuugcaaagucagcggauacacccucacagaacuguccauccacugggugagacaggccccuggcaaggggcuugaguggaugggaggcuucgacucugaagauggggaggcgauuuauaaacagaacuuucaaggacggguuacgaugaccgaagacacaagcaccgauacagcuuacauggagcugucccgccucagaucugaggacaccgccguguauuacugugccacagcugaucgguucaaggucgcccaggacgaaggccuguuugugaucuucgauuauuggggccaggggaauccgggacaucgccuucugagccuccaccagggccccauugggcugccucccggaacccugccucccaaggcuacguccggccaugccgcgagacgg

SEQ ID NO: 42832 - RNA, 462 nt, Artificial Sequence
  derived and/or modified sequence opt5 from anti-HIV_Chain
cuggugcagcucguccaaagcggcgccgagguuaagaaacccggggcuuccgugaaggugucuugcaaagucagcggauacucccugaccgaacuuucuauccacugggugagacaggccccuggcaaggggcuggaguggaugggaggcuucgacagcgaagauggggaggcgauuuauaaacagaacuuucagggacggguuacaaugacggaagacaccuccacagauaccgcuuacauggagcucucucgccugagaagcgaggacacagccguguauuacugugccaccgcugauccguucaaggucgcccaagacgaaggccuuuuugugaucuucgauuauuggggccaggggacaaccggacaucggcugcucucccugcaccagggcccccaucgccuguacagccucgggacgcugcuuucuagagcuccuauuguucagacccacauggcc

SEQ ID NO: 42833 - RNA, 471 nt, Artificial Sequence
  derived and/or modified sequence opt5 from anti-HIV_Chain
cagauccaccuggugcaaagcggcaccgacgucaagaaacccggguccucuguuacagugagcugcaaggccuacggagugaacacguucggccucuaugcugucaauugggugagacaggccccugggcagucccuggaguacauuggacagaucuggcgguggaaaucuagcgcgucccaucacuuucgcggcagaguucuuauuucugcuguggaucugaccgggagcuccccgcccaucagcucucucgaaauuaagaaccugacauccgacgauaccgccgucuauuucuguacaaccacaagcaccuacgaccaauggucuggacuucaucacgauggcgugauggccuuuuccagccggggccaggggacgcugaucucuguuuccgcugccagcaccaaaggaccuuccguguucccccucgcuccuucuagcaaguccacauauggccuggcccauguccug

SEQ ID NO: 42834 - RNA, 477 nt, Artificial Sequence
  derived and/or modified sequence opt5 from anti-HIV_Chain
cagcaccaacuggugcccugcgucgccgagguuagaaagccuggcgcuagcgugaaaguguccuguaaggucucuggguacacccucacagaaaucagcaugcauugggugcggcaggccccgggaaaaggccuggaguggaugggaggguucgaccgcgaagauggcgagacgauuuaugcgcagaaguuucaggggagaguuaccaugacagaagacaccuccacagauaccgcuuacauggagcuuucuagccugcgguccgaggacacagccguguauuacugcgccaccacguaucucgcugucgugcccgauggauucgacggcuacucuagcuccugguauugguuugauccuuggggccaagggacccugguuacagugagcucugccuccaugcagggacccaugcuucugagcccuaccggcacacuccugccccgcgcuccucugguccagaccagaccggggccc

SEQ ID NO: 42835 - RNA, 642 nt, Artificial Sequence
  derived and/or modified sequence opt5 from anti-HIV_LightChain
gacaucgugauuacccagagcacaaaguucauguccacgucugucggcgauagaguuagcauuaccugcaaagccucccaagacgugucuacagcuguggccugguaccagcagaagcccgggcagagcccuaaacugcucaucuauugggcguccacccggcacacaggagucccggaucgcuuuaccggcucugggagcggaacagacuacacccugacgaucuccagagugcaagcugaggaucuugcccuguauuacugucagcagcauuauaccacacccuggaccuucggcgggggaacaaagcucgaaauuaaacggaccguugccgcuccuagcuuugugaucuuucccccuucugacgagcagcugaaguccggcacggccagcgucgugugccuucugaacaauuucuacccccgcgaagcuaagguucaauggaaaguggauaacgcccuccagucuggcaauucccaggagagcgucacagaacaggacucuaaggauuccaccuauagccuguccucuacacugacccucagcaaagcggacuacgagaagcacaaaguguacgccugugaggugacccaucaagggcuguccagcccugucacaaagucuuucaacagaggagaaugc

SEQ ID NO: 42836 - RNA, 651 nt, Artificial Sequence
  derived and/or modified sequence opt5 from anti-HIV_Chain
cagagcgugcugacccaacccccuuccgucucugccgcuccgggccagaagguuacaaucagcugcuccgggucuagcuccaacauuggaaauaacuacgugcucugguaucagcaguuccccggcacggccccuaaacugcuuaucuacgggaauaacaagagacccucuggcauuccugaccgguuuagcggauccaaaagcgggaccucugcgacacugggaaucaccggccuccaaacaggcgaugaggcugacuauuucugugccaccugggauuccgggcugagcgccgacuggguguuuggaggcgggacaaagcucaccguccugucucagcccaaagcugccccuuccgugacgcuuuucccgcccagcucugaggaacugcaggcuaauaaggccacccugguuugccucauuuccgauuuuuacccuggagcggugacagucgccuggaaggcugacagcucccccgugaaagccggcguugaaaccacaaccccuucuaagcagagcaacaauaaauaugcugccuccagcuaccugucucuuacgcccgagcaauggaagucccaccgcagcuauucuugucaggugacacaugaagggagcaccgucgagaaaacaguggcgccgaccgagugcucc

SEQ ID NO: 42837 - RNA, 657 nt, Artificial Sequence
  derived and/or modified sequence opt5 from anti-HIV_Chain
gacaucgugaugacccagagccccgauucccuggccgucucucucggcgagagaguuacaaugaacugcaagagcucccaaucucugcuuuacagcacgaaucagaaaaacuaucuggcuugguaccagcagaagccugggcaauccccgaaacuccugauuuauugggccaauucuaccgaaagcggagugcccgaccgguucuccggcagcgggucuggaacagauuuuacccuuacaaucuccagcgugcaggcggaggacgucgcuguguacuauugucagcaguacuauucuuaccgcaccuucggcgggggaacaaagcuggaaauuaaaagaaccguugccgccccuuccguguuuaucuuucccccuagcgaugagcaacucaagucuggcacggcuuccgucgugugccugcugaacaauuucuacccccgggaagccaagguucaguggaaaguggacaacgcucuccagagcggcaauucccaggagucugucaccgagcaagauagcaaggacuccacauauagccugucuuccacccuuacacugagcaaagccgauuacgaaaagcacaaaguguaugcgugugaggugacccaucaggggcucucuagcccugucacgaaguccuucaaccgcggagaaugc

SEQ ID NO: 42838 - RNA, 753 nt, Artificial Sequence
  derived and/or modified sequence opt5 from anti-HIV_SingleChain
augcaagugcagcuggagcagagcggcgccgaagucaagaaacccggggcuuccguuaaggugucuugccaggccagcggauacagauucuccaacuuuaccgugcacuggguccggcaggcgccuggccaacgcuucgaguggaugggguggaucaauccguauaacggaaauaaagaauuuucugcuaaguuccaggacagagugacauuuacggccgauaccagcgccaacacagcuuacauggagcuccggucccugcgcucugccgacaccgcuguuuauuacugugccagagugggcgaaugggggugggaugacagcccccaggauaauuauuacauggacgucuggggaaaaggcacaaccgugauuguuuccagcggcgggggaggcucugggggaggcggguccggaggcggcgggagcgauaucgagcuuacacagucuccuggaacccugucccucagccccggcgagcgggcgacguucucuugccgcuccagccauuccauuagaucucggcgcguggccugguaucaacacaagccugggcaggcucccagacuggucauccauggagugagcaaccgggccuccggcauuagcgaccgcuuuucuggguccggaagcggcaccgauuucacacuuaccaucacaagaguggaaccugaggacuuugcucuguacuacugucaggucuauggcgccucuagcuacaccuucgggcagggaacgaagcucgaacggaaa

SEQ ID NO: 42839 - RNA, 1338 nt, Artificial Sequence
  derived and/or modified sequence opt5 from anti-HIV_LightChain
gaggugaagcuggaagagagcggcgggggacucguccagcccggcggguccagaaaacugucuugcgccgcuagcggauucaccuuuuccucuuucggcaugcacuggguucggcaagccccugaaaaggggcuugaguggguggcguacaucagcuccggaucuagcacacugcauuaugcugacacggugaaaggccgcuuuaccauuuccagagauaacccgaagaauacacucuuccugcagaugaaacuucccagccuguguuacggccuccuggggucucggaaccugucccaccgccuccugagccagaaugacaccccuaucugccuuacagucucuuccgccagcaccaagggacccucuguguuuccucuggcccccuccagcaaguccacaucuggcgggaccgcugcccucggaugucugguuaaagauuauuucccugaaccggugacggucagcuggaacuccggcgcucuuaccagcggggugcauacauuucccgccguucugcagucuuccggacucuacagccugucuagcguggucaccgugccuuccucuagccugggcacacaaaccuauauuugcaaugugaaccacaagcccuccaauacgaaagucgacaagaaaguugagccuaagagcugugauaagacacauaccugucccccgugcccugcgcccgagcuccugggcgggccuucuguguuccuuuuuccucccaaacccaaggacacacugaugaucuccagaaccccggaagugaccugcgucgugguugaugugagccacgaggaccccgaagucaaauucaacugguacguggauggaguugaggugcacaaugccaagacaaaaccucgggaggaacaguauaacucuacguaccgcgucguguccguccucaccgugcugcaucaggacuggcuuaauggcaaggaguacaaauguaagguuagcaacaaggcucugcccgccccuauugaaaagacaaucuccaaggcuaaagggcagcccagagagccgcaaguguauacccucccucccucucgggaagagaugacaaagaaucaggucagccugaccugccuggugaaaggauuuuacccuuccgauaucgccguugagugggaaucuaacggccagcccgagaauaacuauaagacgacaccucccgugcucgacagcgauggguccuucuuucuguacagcaaacuuaccgucgacaaaucucgcuggcagcaaggaaacguguucuccuguagcgugaugcacgaagcgcugcauaaucacuauacccagaagucucucucccugagcccgggcaaa

SEQ ID NO: 42840 - RNA, 1380 nt, Artificial Sequence
  derived and/or modified sequence opt5 from anti-HIV_Chain
gaggugcaacuggucgaaagcggcgggggacucguuaagcccggcgggucccugagacuuaccugcguggccucuggauucacauuuagcgacguguggcugaacuggguccggcaagcuccuggcaaagggcucgagugggugggacgcaucaaguccagaacggauggcggcaccacagacuacgccgcgucuguuaaagggcgguucaccauuagccgcgaugacuccaagaauacacuguaucuucagaugaacucucugaaaaccgaagauacagcuguguacagcuguaccacggacggauuuaucaugauuagaggcgucuccgaggauuauuacuauuacuauauggacgugugggggaagggaaccacaguuaccgugagcucugccuccacaaagggcccgagcgucuucccccucgccccuucuuccaaaagcaccucugggggaacggcugcccugggcugccuggugaaggauuacuuucccgaaccugugacagucuccuggaauagcggcgcucucaccuccgggguucacacauuccccgccgugcugcagucuagcggacuuuacucccugagcucuguggucaccgugccuuccagcucucucggcacccagacauauaucuguaacguuaaucauaaaccgagcaacacgaagguggacaaaaaggucgagcccaaguccugcgauaaaacccacacauguccucccugcccugcgcccgagcugcuugggggaccgucuguguuucuguucccucccaagccuaaagacacccucaugauuagccggacacccgaaguuaccuguguggucguggaugucucccaugaggaccccgaagugaaguuuaauugguacguugacggcguggagguccacaacgccaaaacgaagccucgcgaggaacaauauaauagcacauacagagugguuucugugcugaccguccugcaucaggauuggcucaacgggaaagaguauaagugcaagguguccaauaaagcucugccggcccccaucgaaaagaccaucagcaaagcuaagggacagccucgggagccccagguguacacacuuccucccucucgcgacgaacugaccaaaaaccaaguuucccucacaugucuggucaagggcuucuauccgagcgauauugccguggagugggaguccaauggccagccugaaaacaauuacaagacgacacccccugugcuugacucugaugggagcuuuuuccuguacuccaaacucaccgucgacaagucuagauggcagcagggaaacguguuuagcugcuccguuaugcacgaggcgcugcacaaccauuauacccagaaaagccugucucucucccccggc

SEQ ID NO: 42841 - RNA, 1413 nt, Artificial Sequence
  derived and/or modified sequence opt5 from anti-HIV_Chain
auggaguggagcggcguguucauguuucugcucuccgucaccgccgggguucacucucaggugcaacugcagcagagcggacccgaaguggucaagccuggcgcuuccgugaaaaugucuugcaaggccagcggguacacauucacguccuauguuauccauugggugagacagaaaccgggacaaggccuugacuggauuggguacaucaaccccuauaaugauggaaccgacuacgaugagaaguuuaaaggcaaggcgacacugaccucugacacaagcaccuccacagcuuauauggaacucagcucucugcgguccgaggauaccgccgucuacuauugugcccgcgaaaaggacaacuacgcuacgggcgccugguucgcuuacugggggcagggaacccuugugacaguuagcucugccuccaccaaaggcccuagcguguuuccccuggcgccuucuuccaagagcacauccgggggaaccgccgcucucggcugccuggucaaagauuauuuccccgagccugugacggugucuuggaauagcggggcccugacauccggaguccacaccuuuccggcuguucuccagagcucuggccuguacucccuuagcucuguggugacaguccccagcuccucucugggcacccagaccuauauuuguaacgugaaucauaagccuagcaacacaaaaguugacaagaagguggagcccaaauccugcgauaagacgcacaccuguccucccugcccggccccugaguucgaagggggacccagcgucuuucucuucccucccaaacccaaggacacacugaugaucucuagaaccccugaagugacauguguuguggucgaugugucccaugaggacccggaggucaaauuuaauugguacguggauggcguugaagugcacaacgcgaagaccaaaccccgggaggaacaauauaauagcacguaccgcgucgugucuguucuuacagugcugcaccaggacuggcucaacgggaaggaguauaagugcaaagucuccaauaaggcccugccugcuagcauugagaaaaccaucuccaaggccaaaggacagcccagagaaccucagguguacacccugcccccgucucgggacgagcucacaaagaaccaagugagccugaccugucuuguuaagggcuucuacccuuccgauaucgcugucgaaugggagucuaaugggcagcccgaaaacaauuauaaaacaacgccucccgugcuggacagcgauggauccuuuuuccucuacagcaagcugaccguggacaaaucucgcuggcagcaaggcaacgucuucuccugcagcgugaugcaugaggcccuucacaaccauuauacacagaagucucugucccucagcccuggcaaa

SEQ ID NO: 42842 - RNA, 645 nt, Artificial Sequence
  derived and/or modified sequence opt5 from anti-influenza_Fab
aucgugcugacccagagccccgccacacucuccgucucuccuggcgagagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaacccgaagauuuugccguguauuacugucagcauuauucuaauuggccuccccgccugacauucgggggaggcaccaaaguggagauuaagagaacggucgcugccccuuccguguuuaucuucccgcccagcgacgaacagcucaaaucuggcaccgcguccguugugugccugcugaacaauuuuuacccucgggaggccaagguccaguggaaaguggauaacgcucuccaaagcgggaauagccaggaauccguuacagagcaggacagcaaggauuccaccuauucucugagcuccacacuuacccugagcaaggccgacuacgagaaacacaagguguacgcuugugaagucacgcaucagggacucucuucccccgugacaaaaucuuucaaccgcggcgagugc

SEQ ID NO: 42843 - RNA, 681 nt, Artificial Sequence
  derived and/or modified sequence opt5 from anti-influenza_Fab
gugcagcuggucgagagcggcgggggaguugugcaacccggcaaguccccuagacucucuugcgccgcuagcgggccgaccuucuccucuuacgccgugcacuggguccggcaggcgcccggaaaaggccuggaaugggugacacuuaucagcuaugacggggcuaaccaguacuaugccgauuccguuaagggacgcuuuacgauuucuagagacaauagcaaaaacaccguguaccugcagaugaacucccuccggccugaggauacagccgucuauuacugugcugugcccggcccuguuuucggcaucuuucccccuuggagcuauuucgacaauugggggcaaggcauucuggugaccgucucuuccgccagcacaaagggaccgucuguguuuccccuugcuccuuccagcaaaucuaccuccgggggaacagccgcgcugggcugccucgugaaggauuacuuccccgaaccugucaccguuagcuggaacuccggggcccugacgucuggagugcauaccuuucccgcugugcugcagagcuccggccucuacagccugucuuccgucgugacaguuccgagcucuagccuuggcacccagacauauaucuguaaugugaaucacaagccuuccaacaccaaagucgacaagaaaguggagcccaagucuugc

SEQ ID NO: 42844 - RNA, 1515 nt, Artificial Sequence
  derived and/or modified sequence opt5 from anti-influenza_Fab
gccggcagcaccgcuacacugugccucgggcaccaugccgugcccaacggaacgaucgucaagaccauuacaaaugaccagaucgagguuaccaacgcgacagaacuggugcaauccucuagcaccggcgagauuugugauuccccucaccagauccuugacgggaaaaauugcacacugauugaugcucuccugggagacccgcagugugauggcuuccagaacaagaaaugggaccuuuuuguggaaagaucuaaggccuacagcaauugcuaucccuacgaugucccugacuaugccucccugcggucucucguggcuagcuccgggacccuggaguucaacaaugaauccuuuaacuggacgggaguuacccaaaauggcacaucuuccgccuguauccgcagaagcaaaaacucuuucuuuucccggcugaauuggcucacccaucugaacuucaaguaccccgcucuuaaugugacaaugccuaacaaugagcaguuugauaagcuguauaucuggggcguccaccaucccgggaccgacaaagaucagauuuuccucuacgcccaggcgagcggacgcaucacggugucuacaaagagaucccaacagaccguuagcccuaacauuggcucccggccgcgcgugagaaacauccccucucggauuagcaucuauuggacaauugucaaaccuggggacauccugcuuaucaauuccaccggaaaccugauugcuccccgcggcuacuuuaagaucagaagcgggaaaucuuccauuaugcggagcgaugccccuaucggaaagugcaauucugaguguauuacccccaacggcagcaucccgaaugacaagccuuuccagaacgugaaucgcaucacauacggcgccugccccagauaugugaaacagaacacgcucaagcuggcuaccgggaugcggaaugucccugaaaaacaaacacgcggaauuuuuggcgccaucgcgggguucauugagaacggaugggaaggcaugguugacgggugguacggauuuagacaccagaauagcgagggccggggccaggccgcugaucugaagucuacccaagccgcuaucgaccagauuaacgggaaacucaauagacugaucggaaagacaaacgagaaauuccaccagaucgaaaaggaguucagcgaaguggagggccgcauucaggaucuugaaaaguauguggaggacaccaaaaucgaucugugguccuacaaugccgagcuccuggucgcccuugaaaaccaacauacgauugaccugacagauagcgagaugaacaagcucuuugagaaaaccaagaaacagcugcgggaaaaugcugaagacauggggaacggauguuucaagaucuaucacaagugcgauaaugcguguauuggcucuaucagaaacgggaccuacgaccaugauguguaucgcgacgaggcccugaauaaccgguuucagauuaaaggcuccggaagacucguuccccgc

SEQ ID NO: 42845 - RNA, 657 nt, Artificial Sequence
  derived and/or modified sequence opt5 from anti-influenza_Fab
caggugcaacugguccagagcggcgggggaguugugcagcccggcagaucccuccggcugucuugcgccgcuagcgaguucaccuuucgcauguacgccacacacugggugagacaggcgccugggaagggacuugaaugggucgcucugaucuccuaugacggcucuaacaaauacuaugccgauagcgugaaggggcgguucacgauuucccgcgacaauucuaugaacaccguuuaccuccaaaugaauacacugagaccggaggauaccgccguguauuacugugcucgggaccuuggaggcuauuuuauccgcggcauuauggaugucugggggcagggaacacuggugaccguuagcuccgccagcacaaaaggccccucuguguucccucucgcucccuccagcgggggaaccgccgcgcugggcugccuggucaaggacuacuuuccugaacccgugacggugucuuggaacuccggggcccucaccagcggaguccauacauucccugcuguucugcagucuuccggccuuuacagccuguccucuguggugaccgucccgagcuccagccucggcacacagaccuauaucuguaaugugaaccacaaacccucuaauacgaagguugauaagagaguggagccuaaa

SEQ ID NO: 42846 - RNA, 642 nt, Artificial Sequence
  derived and/or modified sequence opt5 from anti-influenza_Fab
gagcugcagaugacccaaagccccagcucugugagcgccuccgucggcgacagaguuacaaucacgugccgggcuucucaggggauuagcuccuggcucgccugguaccagcagaagccuggaaaagcgccgaagcugcuuaucuaugcugccucuagccugcaauccggcgugcccagccgcuucucuggguccggaagcggcaccgauuuuacacucaccauuucuucccugcagccugaagacuucgccacauacuauugucagcaggcuaacagcuuuccccuuaccuucgggggaggcacaaaaguggagaucaagagaaccgucgccgcuccuucuguguuuauuuuucccccuuccgaugaacaacugaaaagcggcacggccuccguugugugccuccugaauaacuucuacccgcgggaggcgaagguccaguggaagguggacaaugcccugcagucugggaacagccaggaauccguuaccgagcaagauagcaaagacucuacauauucccucagcucuacccugacacuuagcaaggcugauuacgagaaacacaagguguaugccugugaagucacccaucagggacuguccucucccgugacgaaauccuucaaucgcggcgagugc

SEQ ID NO: 42847 - RNA, 993 nt, Artificial Sequence
  derived and/or modified sequence opt5 from anti-influenza_Fab
gccgaccccggcgauaccaucugcauuggguaccacgcuaacaauagcacagacacgguggauaccguccuggagaagaacguuacagugacccauuccgugaaucuccuggaagacucucacaacggaaaacuuuguaagcugaaaggcaucgccccucuccagcuggggaagugcaauauugcgggauggcuucugggcaacccggagugugaucuccugcugacagcuagcuccuggucuuauaucgucgaaaccagcaauuccgagaacgggacaugcuaccccggagacuucauugauuaugaggaacucagagagcaacugucuagcguguccagcuuugaaaaauucgagaucuuuccuaagaccucuuccuggcccaaucaugaaacgaccaagggcguuacagccgccuguagcuacgcuggcgccucuuccuucuaucggaaccuucuguggcucaccaaaaaggggagcucuuacccuaaacuguccaagagcuaugugaauaacaaaggaaaggagguccuugugcuguggggcguucaccaucccccuacagggaccgaccagcagucccucuaccagaaugcugaugccuacgugucugucggaagcuccaaguauaaccgcagauuuacgccggagaucgcggcccggcccaaagugcgcgaccaagcuggcagaaugaauuacuauuggacacugcuggaaccuggggauaccauuacauucgaggccaccggaaaccucaucgcucccugguacgccuuugcgcugaaccggggcagcggcucugggauuaucaccuccgacgccccugugcacgauugcaauacaaagugucagacgccccacggagcuauuaacagcucucuuccguuccagaauauccauccugucaccauuggcgaaugccccaaauauguucgcagcacaaagcugagaauggccaccgggcuccggaacaucccuuccauccagucucgc

SEQ ID NO: 42848 - RNA, 537 nt, Artificial Sequence
  derived and/or modified sequence opt5 from anti-influenza_Fab
ggccuguucggggccaucgcuggauuuauugagggcggguggaccggaaugaucgacggcugguacggguaucaccaucagaacgaacaaggaagcggcuacgccgcggaucagaaguccacacagaaugcuauugacggcaucacgaacaaagucaauucugugauugagaagaugaacacccaguucacagccguugggaaagaauuuaauaaccucgagagacggaucgaaaaucugaacaagaaaguggaugacggauuccuugauaucuggaccuauaaugccgagcugcucgugcugcuugagaacgaacgcacacuggacuuucacgauagcaaugucagaaaccucuacgagaaggugaagucccaacugaaaaauaacgcuaaggaaauuggcaaugggugcuucgaguuuuaucauaaaugugacgaugccugcauggagucuguucggaacggaaccuacgacuaucccaaguacagcgaagaguccaaacugaaccgcgaagagaucgauggcgugucugggaga

SEQ ID NO: 42849 - RNA, 642 nt, Artificial Sequence
  derived and/or modified sequence opt5 from anti-influenza_Apo
cagagcgugcugacccaacccccuuccgucucuguugccccgggccagacagcuagaaucacgugcgggggaaacgacauuggccgcaagagcgugcacuggaaucagcagaaacccgggcaagccccugugcucgucguguguuacgauuccgaccggcccucuggaaucccugagagauucagcggcuccaacucugggaauaccgcgacacugaccauuagccggguugaagcuggagaugaggccgacuauuacugccaggugugggauuccagcucugaccaugucaucuuuggcggcgggacaaaacuuaccgugcugggacagcccaaagccgcuccuuccguuacacucuucccgcccagcucugaggaacugcaggccaacaaggcuacccuugugugucugauuuccgauuuuuauccuggcgccgucacgguggcguggaaagccgacagcucucccgugaaggcuggggucgaaaccacaaccccuuccaagcaaagcaauaacaaauacgccgcuuccucuuaucucagccugacacccgagcaguggaagucccaccgcagcuacucuugccagguuacccaugagggauccacgguggaaaagacaguggccccgaccgaguguagc

SEQ ID NO: 42850 - RNA, 687 nt, Artificial Sequence
  derived and/or modified sequence opt5 from anti-influenza_Apo
gaggugcagcugguccaaagcggcgccgaaguuaagaaacccggggcuuccgugaaggugucuugcaaagccagcggauacaccuucacagacuaucacaucaacugggucagacaggcgccuggccaggggcucgaguggaugggauggauucaucccaauuccggcgauacgaacuacgcucagaaguuucaagggugggugaccaugacacgggacaccgccaucucuacagccuauauggaaguuaauggacugaaaagcgaugacaccgcuguguacuauugugcccgcggcggccuugagccgagauccgucgauuacuauuacuacgggauggacguguggggacagggcacaaccguuacggugucuagcgcuuccaccaaggggccuagcgucuucccccuggccccuucuuccaagagcacaucuggaggcaccgcggcccucgggugccuggugaaagauuauuuucccgaaccugugacagucuccuggaacagcggagcucuuaccucuggcguucacacguucccggccgugcugcaguccagcggccucuacucccugucuagcguggucacagugcccuccagcucucuggggacccagacauauauuuguaauguuaaccauaagccuuccaauaccaaaguggacaagcgggucgagcccaaaagcugc

SEQ ID NO: 42851 - RNA, 333 nt, Artificial Sequence
  derived and/or modified sequence opt5 from anti-influenza-A_kappa_LightChain_V-Region
gacaucgugaugacccagagccccgauucccuggccgucucucucggcgcuagagccacaauuaacugcaagagcucccaaucuguuacguucaauuacaaaaacuaucuggcgugguaccagcagaagccugggcagccgcccaaagugcuuaucuauugggcuagcgcccgggaguccggagugccugaccgcuuuucuggcagcggguccggaaccgauuucacacugaccauuagcucucuccaagccgaagacgucgcuguguacuauugucagcagcacuacagaacacccccuaccuuuggccaggggacaaagguugagaucaaa

SEQ ID NO: 42852 - RNA, 333 nt, Artificial Sequence
  derived and/or modified sequence opt5 from anti-influenza-A_kappa_LightChain_V-Region
gacaucgugaugacccagagccccgauucccuggccgucucucucggcgagagagcuacaauuaacugcaagagcucccaaucuguuagcuccaauaacaaaaauuaccuggccugguaucagcagaagccugggcagccgcccaaagugcuuaucuacugggcgucugcucgggaaagcggagugccugaccgcuucuccggcagcgggucuggaacggauuuuacccugacaauuuccagccuccaagccgaggacgucgccguguauuacugucagcagcacuauagaacacccccuaccuucggccaggggaccaagguugaaaucaaa

SEQ ID NO: 42853 - RNA, 333 nt, Artificial Sequence
  derived and/or modified sequence opt5 from anti-influenza-A_kappa_LightChain_V-Region
gacaucgugaugacccagagccccgauucccuggccgucucucucggcgagagagcuacaauuaacugccggagcucccaaucuguuagcuccaauaacaagaauuuccuggccugguaccaggaaaaaccugggcagccgcccaaggugcuuaucuauugggcgucugcucgcgagagcggagugccugacagauuuuccggcagcgggucuggaacggauuucacccugacaauuuccggccuccaggccgaagacgucgccguguacuauugucaacagcacuaccggacacccccuaccuuugggcagggaaccaaaguugagaucaag

SEQ ID NO: 42854 - RNA, 333 nt, Artificial Sequence
  derived and/or modified sequence opt5 from anti-influenza-A_kappa_LightChain_V-Region
gacaucgugaugacccagagccccgauucccuggccgucucucucggcgagagagcuacaauuaacugcaagagcucccaaucuguuacguucaauuacaaaaacuaucuggccugguaccagcagaagccugggcagccgcccaaacuucugaucuauugggcgagcacccgggaauccggagugccugaccgcuuuucuggcagcggguccggaacagauuucacccucacaauuagcucucugcaagcugaggacguggccgucuacuauugucagcagcacuacagaacacccccuaccuuuggccaggggaccaagguggaaaucaaa

SEQ ID NO: 42855 - RNA, 339 nt, Artificial Sequence
  derived and/or modified sequence opt5 from anti-influenza-A_kappa_LightChain_V-Region
gacaucgugaugacccagagccccgauucccuggccgucucucucggcgagagagcuacaauuaacugcaagagcucccaaucuguucuguacagcuccaauaacaaaaauuaucuugccugguaccagcagaagccugggcagccgcccaaacugcucaucuauugggcgucuacgcgggaaagcggagugccugaccgcuucuccggcagcgggucuggaaccgauuuuacacugaccauuuccagccuucaagcugaggacguggccgucuacuauugucagcaguacuauucuacacccccuaccuucggccaggggacaaagguggaaaucaaa

SEQ ID NO: 42856 - RNA, 333 nt, Artificial Sequence
  derived and/or modified sequence opt5 from anti-influenza-A_kappa_LightChain_V-Region
gacauccagaugacccaaagccccgauucccuggccgugucucucggcgcuagagccacaauuaacugcaagagcucccagucugucacguucaauuacaaaaacuaucuggcgugguaccagcagaagccugggcaaccgcccaaaguucuuaucuauugggcuagcgcccgggaguccggagugccugaccgcuuuucuggcagcggguccggaaccgauuucacacugaccauuagcucucuccaggccgaagacguggcugucuacuauugucagcagcacuacagaacacccccuaccuuuggccaagggacaaagguggagaucaaa

SEQ ID NO: 42857 - RNA, 387 nt, Artificial Sequence
  derived and/or modified sequence opt5 from anti-influenza-A_HeavyChain_V-Region
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucagcuaugacggauccaacaaauacuaugcugauucuguuaagggcagauucacaauuagccgggacaauuccaaaaacacgcuguaccuccagaugaauagccugcgcgccgaggauaccgccguguauuacugugcuaaggacucucaacuuagaucccugcucuauuuugauuggcugagccagggcuacuucgacuacugggggcagggaacacuggucaccgugucuucc

SEQ ID NO: 42858 - RNA, 387 nt, Artificial Sequence
  derived and/or modified sequence opt5 from anti-influenza-A_HeavyChain_V-Region
caggugcaacugguccagagcggcgggggaguugugcagcccggcagaucccuccggcugucuugcguggccagcggguucaccuuuuccacauacgcuaugcacuggguccgccaggccccuggaagaggccuugaguggguggcgguuaucucuuaugacgggaacuacaaguauuacgcugauagcgugaaaggacgguucuccauuucucgcgacaauagcaacaauacgcugcaucucgaaaugaacacccugagaacagaggauaccgcccuuuauuacugugccaaggacucccaacugcggagccuccuguauuuugaauggcugucucagggcuacuucgauccguggggccaggggacacucgucaccguguccagc

SEQ ID NO: 42859 - RNA, 387 nt, Artificial Sequence
  derived and/or modified sequence opt5 from anti-influenza-A_HeavyChain_V-Region
caggugcaacugguccagagcggcgggggaguugugcagcccggcagaucccuccggcugucuugcgccgcuagcggguucaccuuuuccacauacggaaugcacugggugcgccaggccccuggcaaggggcuugagugggucgcggugaucucuuaugacggaaacuacaaauauuacgcugauagcguuaagggcagauucacgauuucccgggacaauucuaaaaacacccuguaucucgaaaugaauagccugcgcacagaggauaccgcccuuuacuauugugccaaggacucccaacugagaagccuccuguacuuugauuggcugucucagggcuacuucgaccauugggggcagggaacacucgugaccgucuccagc

SEQ ID NO: 42860 - RNA, 387 nt, Artificial Sequence
  derived and/or modified sequence opt5 from anti-influenza-A_HeavyChain_V-Region
caggugcaacugguccagagcggcgggggaguugugcccccuggcagaucccuccggcugucuugcgccgcuagcggguucaccuuuuccacauacggaaugcacugggugcgccaggccccgggcaaggggcuugagugggucgcggugaucucuuaugacggaaacuacaaauauuacgcugauagcguuagaggccgguucacgauuucccgcgacaauucuaagaacacccugaaucucgauaugaacagccugagaacagaagacaccgcccuuuauuacugugccaaagauucccagcugcggagccuccuguauuuugacuggcugucucaaggcuacuucgaucauugggggcagggaacacucgugaccgucuccagc

SEQ ID NO: 42861 - RNA, 387 nt, Artificial Sequence
  derived and/or modified sequence opt5 from anti-influenza-A_HeavyChain_V-Region
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcugugaucucuuaugacgccaacuacaaauauuacgccgauagcguuaaggggagauucacgauuucccgggacaauucuaaaaacacccuguaucuccagaugaauagccugcgcgcugaggauacagccguguacuauugugcuaaggacucccaacuuagaagccugcucuacuuugaauggcugucucagggauacuucgauuauuggggccagggcacccuggucacaguguccagc

SEQ ID NO: 42862 - RNA, 387 nt, Artificial Sequence
  derived and/or modified sequence opt5 from anti-influenza-A_HeavyChain_V-Region
caggugcaacuggucgagagcggcgggggaguugugcagcccggcagaucccuccggcugucuugcgccgcuagcggguucaccuuuuccacauacgccaugcacugggugcgccaggcgccuggaaagggccuugaaugggucgcugugaucucuuaugacgggaacuacaaauauuacgccgauagcguuaagggaagauucacgauuucccgggacaauucuaaaaacacccuguaucuccagaugaauagccugcgcgccgaggauacagcuguguacuauugugccaaggacucccaacuuagaagccugcucuacuuugaauggcugucucagggcuacuucgauccguggggccaggggacccuggucacaguguccagc

SEQ ID NO: 42863 - RNA, 387 nt, Artificial Sequence
  derived and/or modified sequence opt5 from anti-influenza-A_HeavyChain_V-Region
caggugcaacugguccagagcggcgggggaguugugcagcccggcagaucccuccggcugucuugcguggccagcggguucaccuuuuccacauacgcuaugcacuggguccgccaggccccuggaagaggccuugaguggguggcgguuaucucuuaugacgggaacuacaaguauuacgcugauagcgugaaaggacgguucuccauuucucgcgacaauagcaacaauacgcugcaucucgaaaugaacacccugagaacagaggauaccgcccuuuauuacugugccaaggacucccaacugcggagccuccuguauuuugaauggcugucucagggcuacuucgauccguggggccaggggacacucgucaccgugacaucc

SEQ ID NO: 42864 - RNA, 330 nt, Artificial Sequence
  derived and/or modified sequence opt5 from anti-influenza-A_LightChain_V-Region
aacuucaugcugacccagcccccuagcgccuccggcacaccggggcaaagagugacgaucucuugcagcggauccucuagcaauauuggcgggaacaccguccacugguuucagcagcuccccggaacagcuccuaagcugcuuaucuacaccaauucccugcggcccucuggcguuccugaccgcuucagcggguccaaaagcggaacaucugccucccucgcgauuagcggccugcagucugaggaugaagcugacuauuacugugccgccugggaugacucccuuaacggccaaguguuugggggaggcaccaagcugacagugcuc

SEQ ID NO: 42865 - RNA, 390 nt, Artificial Sequence
  derived and/or modified sequence opt5 from anti-influenza-A_HeavyChain_V-Region
caggugcaacugcucgagagcggagggggagucguucagcccggcagaucccugcggcuuucuugcgccgcuagcggguucaccuuuuccaacuacggaaugcacugggugcgccaggccccuggcaaggggcuggaauggguggcgaucauuucuuucgacggaagcaaaaaguauuacgcuaauuccgucaaaggcagaucuacaaucagccgggauaacuccaagaauacgcucagccugcagaugaacucucuuggcccggaggacaccgcccuguauuacugugccaaacuccccuccccuuauuacuuugauagccgcuucguguggguugcugccucugcuuuucauuucugggggcaaggcauucuggugacagucuccagc

SEQ ID NO: 42866 - RNA, 132 nt, Artificial Sequence
  derived and/or modified sequence opt5 from anti-influenza_Chain
aacgugcccgaguggagcuacaucgucgaaaaggccaauccugcuaacgaccugugcuauccgggcaauuucaacgauuacgaggaacucaaacaucugcuuuccagaauuaaucacuuugagaagauccag

SEQ ID NO: 42867 - RNA, 162 nt, Artificial Sequence
  derived and/or modified sequence opt5 from anti-influenza_Chain
agcggcagacuggugccccggggguccccuggaucuggcuacaucccggaggcuccccgcgacgggcaggccuaugucagaaaggauggagaauggguucuccugagcaccuuccuuggcaaaccuauucccaacccucugcucgggcuggacuccacagga

SEQ ID NO: 42868 - RNA, 291 nt, Artificial Sequence
  derived and/or modified sequence opt5 from anti-influenza_Chain
augagccugcucaccgagguggaaacacccaucagaaacgaguggggcugccgguguaauggguccucugacccucuggccauugcugccaacaucauuggaauccuucaccugauucucuggauccuggaucgccuuuucuuuaagugcaucuacagacgguucaaauauggccugaaagggggaccgagcacggaaggcguccccaaguccaugcgcgaggaauacagaaaggagcagcaaucugcgguugacgcugaugacgggcauuuugugagcauugagcucgaa

SEQ ID NO: 42869 - RNA, 300 nt, Artificial Sequence
  derived and/or modified sequence opt5 from anti-influenza_Chain
augaacaaugccaccuucaacugcacaaauaucaaccccauuacgcacaucagaggcagcauuaucauuaccaucugugugucccugaucgucauucucaucguuuuugggugcauugcuaagaucuucauuaauaaaaacaauuguacaaacaaugugauccgggugcauaagcgcauuaaaugcccugacugugagccguuuugcaacaagagagaugacaucucuacaccccgggccggagucgauaucccuagcuucauucugcccggccuuaaucuguccgaagggaccccuaac

SEQ ID NO: 42870 - RNA, 300 nt, Artificial Sequence
  derived and/or modified sequence opt5 from anti-influenza_Chain
gagcugacccagagccccuccucucucagcgccuccgugggcgacucugucacaaucacgugcagaaccagcgaacggauuuccacauaccugaacugguaucaacagaagccugggaaagcuccgcgccuucugguuucuggagccagcacccuccagggcggggugcccuccagauucagcggaucuggcuccgggacagcguuuacccugacaaucaauagccuucagccugaggauuucgcuaccuacuauugucaacagucuuacuccacgccccugaccuuuggaggcggcaca

SEQ ID NO: 42871 - RNA, 300 nt, Artificial Sequence
  derived and/or modified sequence opt5 from anti-influenza_Chain
augacccagagccccuccucuaugagcgugucccugggcgacacagucucuaucacgugccacgccagccaagauauuuccgggcauaucggauggcuccagcagaagccuggcaaaucuuucaaggggcugauuuaccacggaaccaaccuugaggacggcguuccgagcagauuuuccgggagcggaucuggcgcugauuucucccugacaaucagcucucucgaauccgaggacuuugccgauuauuacugugugcaguaugugcaauuccccuggaccuuuggcgggggaacaaaa

SEQ ID NO: 42872 - RNA, 306 nt, Artificial Sequence
  derived and/or modified sequence opt5 from anti-influenza_Chain
gacauccaggugacccaaagccccuccucucugagcgccuccgucggcgauagaguuacaauuucuugccgggcucagagccucuccucuuaccugcacugguaucagcagaagccugggcaaccgcccaaacuucugaucuacgccgcgacgacccuccagagcggagugccuucccgcuucagcggcucuggguccggaacagacuuuacccugacaauuagcaccuuccaggcugaggauguggccacauauuacugucagcaaucuagaaccuuuggccaggggacgaaggucgaaaucaaa

SEQ ID NO: 42873 - RNA, 306 nt, Artificial Sequence
  derived and/or modified sequence opt5 from anti-influenza_Chain
gacauccagaugacccaaagccccuccucucugagcgccuccgugggcgauagagucacaauuucuugccgggcucagagccucuccucuuaccugcacugguaucagcagaagccugggcaaccgcccaaacuucugaucuacgccgcgacgacccuccagagcggaguuccuucccgcuucagcggcucuggguccggaacagacuuuacccugacaauuagcaccuuccaggcugaggauguggccacauauuacugucagcaaucuagaaccuuuggccaggggacgaagguggaaaucaaa

SEQ ID NO: 42874 - RNA, 309 nt, Artificial Sequence
  derived and/or modified sequence opt5 from anti-influenza_Chain
gacauccagauuacccaaagccccuccucucugagcgccuccgugggcgauagagucacaaucacgugccggaccucucagagccucuccucuuaccugcacugguaucagcagaagccugggaaagcuccgaaacuucugauuuacgccgcgagcucccuccaaagcggaguucccucucgcuucuccggcagcgggucuggaacagacuuuacccugacaaucuccagccuucagccugaggauuucgcuaccuauuacugucagcagucuagaacauuuggccaagggaccaagguggaaauuaag

SEQ ID NO: 42875 - RNA, 309 nt, Artificial Sequence
  derived and/or modified sequence opt5 from anti-influenza_Chain
gacauccagaugacccaaagccccuccucucugagcgccuccgugggcgauagagucacaauuacgugccggaccucucagagccucuccucuuaccugcacugguaucagcagaagccugggaaagcuccgaaacuucugaucuacgccgcgagcucccuccaaagcggaguucccucucgcuucuccggcagcgggucuggaacagacuuuacccugacaauuuccagccuucagccugaggauuucgcuaccuauuacugucagcagucuagaacauuuggccaagggaccaagguggaaaucaag

SEQ ID NO: 42876 - RNA, 309 nt, Artificial Sequence
  derived and/or modified sequence opt5 from anti-influenza_Chain
gacauccaggugacccaaagccccuccucucugagcgccuccgucggcgauagaguuacaauuucuugccgggcuagccagcgccucaacuccuaccugcacugguaucagcagacgccugggcaagccccgaaacuucugaucuacgcgaccucuacacuccagagcggagugucccccagauucagcggcucuggguccggaaccgacuuuacacugaccauuagcucucuucagccugaggauguggcuacauauuacugucagcugucccggaccuucggccaugggacgaaggucgaaaucaag

SEQ ID NO: 42877 - RNA, 309 nt, Artificial Sequence
  derived and/or modified sequence opt5 from anti-influenza_Chain
gacauccagaugacccaaagccccuccucucugagcgccuccgugggcgauagagucacaauuucuugccgggcuagccagcgccucaacuccuaccugcacugguaucagcagacgccugggcaagccccgaaacuucugaucuacgcgaccucuacacuccagagcggaguuucccccagauucagcggcucuggguccggaaccgacuuuacacugaccauuagcucucuucagccugaggauguggcuacauauuacugucagcugucccggaccuucggccaugggacgaagguggaaaucaag

SEQ ID NO: 42878 - RNA, 309 nt, Artificial Sequence
  derived and/or modified sequence opt5 from anti-influenza_Chain
gacauccaggugacccaaagccccuccucucugagcgccuccgucggcgauagaauuacaaucucuugccggacgagccagucccuccgcucuuaccugcacugguaucagcagaagccugggaaagcuccgaaacuucugauuuacgccagcuccacccuccaaagcggaguucccucuagauucuccggcagcgggucuggaacagacuuuacccugacaaucuccaaccuucagccugaggauuucgcgaccuauuacugucagcugagccggacauuuggccaggggaccaagguggaaauuaag

SEQ ID NO: 42879 - RNA, 309 nt, Artificial Sequence
  derived and/or modified sequence opt5 from anti-influenza_Chain
gacauccagaugacccaaagccccuccucucugagcgccuccgugggcgauagaauuacaaucucuugccggacgagccagucccuccgcucuuaccugcacugguaucagcagaagccugggaaagcuccgaaacuucugauuuacgccagcuccacccuccaaagcggaguccccucuagauucuccggcagcgggucuggaacagacuuuacccugacaaucuccaaccuucagccugaggauuucgcgaccuauuacugucagcugagccggacauuuggccaggggaccaagguugaaauuaag

SEQ ID NO: 42880 - RNA, 309 nt, Artificial Sequence
  derived and/or modified sequence opt5 from anti-influenza_Chain
gacauccagaugacccaaagccccuccucucugagcgccuccgugggcgauagagucacaauuacgugccggaccucucagagccucuccucuuacacacacugguaucagcagaagccugggaaagcuccgaagcugcuuaucuacgccgcgagcucccgccugagcggaguucccucuagauucuccggcagcgggucuggaaccgacuuuacacucaccauuuccagccugcaaccugaggauuucgcuacauauuacugucagcagucucggaccuuuggccaggggacgaaaguggaaaucaag

SEQ ID NO: 42881 - RNA, 309 nt, Artificial Sequence
  derived and/or modified sequence opt5 from anti-influenza_Chain
gacauccagaugacccaaagccccuccucucugagcgccuccgugggcgauagagucacaauuacgugccggaccucucagagccucuccucuuacacacacugguaucagcagaagccugggaaagcuccgaagcugcuuaucuacgccgcgagcucccgcggaagcggcguucccucuagauucuccgggagcggaucuggcaccgacuuuacacugaccauuuccagccuccaaccugaggauuucgcuacauauuacugucagcagucucggaccuuugggcagggaacgaaaguggaaaucaag

SEQ ID NO: 42882 - RNA, 309 nt, Artificial Sequence
  derived and/or modified sequence opt5 from anti-influenza_Chain
gacauccagaugacccaaagccccuccucucugagcgccuccgugggcgauagagucacaauuacgugccggaccucucagagccucuccucuuacgaccacugguaucagcagaagccugggaaagcuccgaagcugcuuaucuacgccgcgagcucccgccugagcggaguucccucuagauucuccggcagcgggucuggaacagauuuuacccucacaauuuccagccugcaaccugaggacuucgcuaccuauuacugucagcagucucggacauuuggccaggggaccaaaguggaaaucaag

SEQ ID NO: 42883 - RNA, 318 nt, Artificial Sequence
  derived and/or modified sequence opt5 from anti-influenza_Chain
gagaucgugaugacccagagccccgacacacuguccgucucuccuggcgaaagagccacgcucagcugccgggcuucccaaucuguuaaccgcagacuggccugguaccagcagaagccggggcaggcgccccggcuucugauucacgaugcuagcacccgcgccacaggaaucccugccagauucuccggcucugggagcggaaccgaguuuacacucaccauuuccagccugcaaucugaagacuucgcuguguauuacugucagcaguaugauaauuggcuuuccuuuggccaggggacacggcuggagaucaaa

SEQ ID NO: 42884 - RNA, 318 nt, Artificial Sequence
  derived and/or modified sequence opt5 from anti-influenza_Chain
gacauccagcugacccaaagccccuccucucucagcgccuccgugggcgauagagucacaauuacgugccgggcuucucaggggauccugaacugucuugccugguaccagcagaagccuggaaaaguuccgaaucugcucauguaugcggcuagcacccugcaauccggcgugcccucucgcuucagcggguccggauuuggcacagacuucacccuuacaauuagcucucugcagccugaggauguggccaccuacuauugccagacauacgggggagucuccaccuuuggcggcgggacgaagguggaaaucaga

SEQ ID NO: 42885 - RNA, 318 nt, Artificial Sequence
  derived and/or modified sequence opt5 from anti-influenza_Chain
agcuacgugcugacccagcccccuuccgucucuguugccccgggccaaacagcuagaaucagcugcgggggauccaacauuggcgggaagucugugcacugguaucagcagaaacccggacaggccccugugcucgucguguacgacgauagcggccggcccuccgggaucccugagcgcuucucuggaagcaauuccggcgacacggcgacccugacaauuagcagaguugaagcuggcgaugaggccgacuauuuuugucaagugugggauaacuucgggggagucuuuggcaccgggacaaaggugaccguucuu

SEQ ID NO: 42886 - RNA, 318 nt, Artificial Sequence
  derived and/or modified sequence opt5 from anti-influenza_Chain
gacauccagaugacccaaagccccuccucucugagcgccuccgugggcgauagagucacaauuacgugccggaccucucagagcaucuccucuuaccucaacugguaucagcagaagccugggaaagcuccgaagcugcuuauuuacgccgcgagcucccugcaaagcggaguucccucucgcuucuccggcagcgggucuggaacagacuuuacccucacaaucuccggccugcagccugaggauuucgcuaccuauuacugucagcagagcuauucuaugcccgccuuugggcaaggaacaaaacuugaaauuaag

SEQ ID NO: 42887 - RNA, 318 nt, Artificial Sequence
  derived and/or modified sequence opt5 from anti-influenza_Chain
gacauccagaugacccaaagcccccuguccgugucugucagcguuggcgauagagugacaauugccugccgggcuucccagucuaucgacaaguuccucaacugguaccagcagaaaccugggaaggccccgaaacugcuuauuuauggagcgagcaaucugcacuccggcgcucccucucgcuuuagcgccuccgggagcggaacggauuucacccucacaaucaccaacauucaaacagaggacuuugccaccuaccugugucagcagucuuucuccgugccugcuuuuggcgggggaacaaaggucgaaaucaaa

SEQ ID NO: 42888 - RNA, 318 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaccuaccucaacugguaucagaagcgcccugggaaagccccgaagcugcuuguuuacggagcgucuacacugcagagcggcgugcccuccagauucagcgggucuggauccggcaccgacuuuacacucaccauugcuagccugcaaccugaggauucugccacauauuacugucagcagaccuauuccaucccccuuuucgggcagggaacgcggcuggaaauuaaa

SEQ ID NO: 42889 - RNA, 318 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaccuaccucaacugguaucagaagcgcccugggaaagccccgaagcugcuuguuuacggagcgucuagccugcaguccggcgugcccagcagauucucuggguccggaagcggcacagacuuuacccucacaauugcuucucugcaaccugaggauuccgccguguauuacugucagcagaccuauagcaucccccuuuucgggcagggaacacggcuggaaauuaaa

SEQ ID NO: 42890 - RNA, 318 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucucccgcuaccucaacugguaucagcagaagccugggaaagccccgaagcugcuuauuuacggagcgucuacccugcaaaauggcgcucccagcagauucuccgggagcggaucuggcacagacuuuacccucacaaucuccagccugcagccugaggauucugccaccuaucuuugucagcaguccuacagcguucccgccuucgggggaggcacaaaaguggaagugaag

SEQ ID NO: 42891 - RNA, 318 nt, Artificial Sequence
  derived and/or modified sequence opt5 from anti-influenza_Chain
ggcauccagaugacccaaagccccuccucucugagcgccuccgugggggacagagucacaauuacgugccgggcuucucagagcaucucccgcuaccucaacugguaucugcagaagccuggaaaagccccgaaacuucugauuucuggcgcgagcucccuccagagcgggguucccucuagauucuccggaaccggcagcgggacagaguuuacccugacaaucucuucccuucaaccugaagauuucgcuaccuacuauugucagcagacauuuagcauuccccuguucggacagggcaccaagguggagaucaag

SEQ ID NO: 42892 - RNA, 321 nt, Artificial Sequence
  derived and/or modified sequence opt5 from anti-influenza_Chain
gacauccagaugacccaaagccccuccucucugagcgccuccgugggcgauagagucucuauuacaugccaggcuagccaggacaucucccgguaccucaacugguaucagcaaaagccuggggaggccccgaaacugcuuauuuacgaugcgucuaaucuggaaacgggaguucccagccgcuucuccggcagcgggucuggaaccgacuuuacauucaccaucuccagccuccagccugaggauauugcuacauauuuuugucagcaguacggcuaucugccccuuaccuucgggccuggaacaaagguggacucuaaa

SEQ ID NO: 42893 - RNA, 321 nt, Artificial Sequence
  derived and/or modified sequence opt5 from anti-influenza_Chain
gacauccagaugacccaaagccccuccucuuucagcgugucccugggcgauagagucacaauuacgugcaaggccucugaggacaucuacaaccggcucgcuugguaucagcagaaaccugggaaugccccgcgccugcuuauuagcgauaccacaaaccuguggaucggaguucccuccagauuuucuggcagcggguccggaaaggacuacacccucagcauuacaucucugcaguccgaagauguggcgaccuauuacugucaacaguauuggagcucucggacauucggcgggggaaccaaacuugagaucaagcgc

SEQ ID NO: 42894 - RNA, 321 nt, Artificial Sequence
  derived and/or modified sequence opt5 from anti-influenza_Chain
gacauccagaugacccaaagccccuccucuuucagcgugucccugggcgauagagucacaauuacgugcaaggccucugaggacaucuacaaccggguugcuugguaucagcagaaaccugggaaugccccgcgccuccugaugagcgaugcgaccucccuuggagcuggcgugcccucuagauuuagcggguccggaagcggcaaggaccacacacugucuauuaccucccuccagacagaagauguggccaccuacuauugucaacaguacuggaacacacggaccuucgggggaggcacgaaacuggagaucaagcgc

SEQ ID NO: 42895 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaccuaccucaacugguaucagcagaagccugggauuccgcccaaacugcuuaucaauguugccucuagccugcaauccggagugccuagccgcuucucuggcuccgggagcggaacagacuuuacccucacaauuucuucccugcagcccgaggauuucgcgagcuacuauugucagcagaccuacucuuccccucccacauuuggccaagggaccaagguggaaaucaaa

SEQ ID NO: 42896 - RNA, 321 nt, Artificial Sequence
  derived and/or modified sequence opt5 from anti-influenza_Chain
gacauccagaugacccaaagccccuccacacugucuggcagcgugggggauagagucacgauuaccugccgggccucccagaacaucggaccuuggcucgcuugguaccagcaggagucuggcaaggccccgaaacugcuuauuagccgcgcguccauccuggaaucugggguucccagcagauucuccggaacaggcaccgggacagaguuuacccucacaauuagcucucugcaaccugacgauuucgcuaccuauuacugucagcacuauaaugccuacuggggaacguuuggccagggcaccaagguggaaaucaac

SEQ ID NO: 42897 - RNA, 321 nt, Artificial Sequence
  derived and/or modified sequence opt5 from anti-influenza_Chain
gugaucuggaugacccagagccccucccugcucucugccagcacaggcgacagagucacgauuuccugccggaugucucaagggaucagcuccuaccuggcuugguaucagcagaagccuggaaaagccccggagcuucugauucacaccgcguacacacucaagucuggcguucccagccgcuucuccgggagcggaucuggcaaagauuuuacccugacaaucuccgggcuucagagcgaagacuucgcuaccuauuacugucaacaguauuacucuuuuccuuauacauucggacagggcaccaagguggagauuaaa

SEQ ID NO: 42898 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacgugagcaccuggcuggccugguaccagcucaagccugggaaagcgccgaagcugcuuaucuaugcugccuccucucugcagagcggagugcccucccgcuucagcggcucuggguccggaacagauuuuacccucacagucagcucucugcaaccugaggacuucgccaccuacuauugucagcaggcuaacuccuuucccuucacauuuggcccugggaccaaaguggauauuaag

SEQ ID NO: 42899 - RNA, 321 nt, Artificial Sequence
  derived and/or modified sequence opt5 from anti-influenza_Chain
gacauccagcugacccaaagccccuccuuccucucugccagcgugggcgauggggucacaauuacgugcagagcuucccaggacaucuacauuuaucuggccugguaccagcagaagccuggaaaagcgccgaaacuucugaucuaugcugccucuacccuccaaggcgggguucccagccgguuuuccggaucuggcagcgggacagaguucacccugacaauuaacaaucuucagccugaagauuuugccaccuacuucugucagcagcugaacggauauccccucacauuuggcggcgggaccaagguggagaucaag

SEQ ID NO: 42900 - RNA, 321 nt, Artificial Sequence
  derived and/or modified sequence opt5 from anti-influenza_Chain
gacauccagcugacccaaagccccuccucucucagcgccuccgugggcgauagagucacacugacgugccaggcuucucaggacauucggaaguuccuuaacugguaccagcaaaaaccugggaagggaccgaaacugcucaucuaugaugccagcaaucugcagcgcggcguucccuccagauuuucugggggaggcagcgggaccgacuucacacuuauuaucuccagccugcagccugaggaugugggaaccuacuauugucagcaauacgacggccuccccuuuacauucggcgggggaaccaagcuggaaauuaaa

SEQ ID NO: 42901 - RNA, 321 nt, Artificial Sequence
  derived and/or modified sequence opt5 from anti-influenza_Chain
gacauccagcugacccaaagccccuccucucucagcgccuccauuggcgauagagugacaaucacgugccaggcuucucaggacauucggaacagccugaauugguacgagcacaagccugggaaagccccgaaacuucugauccaugaugcguccaaccucgaaaccggaguccccucucgcuucagcggcgggggauccggcacagacuuuacccugacaauuagcucucuucagccugaggauuucgcuaccuauuacugucaacaggccaauuccuuuccccugacauucgggggaggcaccaagguugaaaucaag

SEQ ID NO: 42902 - RNA, 321 nt, Artificial Sequence
  derived and/or modified sequence opt5 from anti-influenza_Chain
gacauccagcugacccaaagccccuccucucucagcgccuccgugggcgauagagucacaauuacgugccgggcuucucaggggauccgcaacgaccugggaugguaccagcagaagccuggcaaugccccgaaaagacuuauuuucggggcgagcucccugcaaucuggaguucccagccgguuuuccggcagcgggucuggaaccgaguucacacucaccaucuccagccugcagccugaagauuuugcuacauauuacugucuucagcacaacucuuaucccuacaccuucggccagggcacaaagcuggagauuaaa

SEQ ID NO: 42903 - RNA, 321 nt, Artificial Sequence
  derived and/or modified sequence opt5 from anti-influenza_Chain
gacauccagcugacccaaagccccuccucucucagcgccuccgugggcgauagagucacaauuacgugccgggcuucucagagcaucucccgcuaccugaacugguaucagcagaagccugggaaagccccgaagcugcuucucuucgcggcuucuacccugcuugacggaguucccagcagauuuuccggcagcgggucuggaacagauuucacccugacaauuuccagccuccaaccugaggacuuugccaccuacuauugucagcggaaucacucucccuccuggacauucggccaggggacccgcguggaaaucaaa

SEQ ID NO: 42904 - RNA, 321 nt, Artificial Sequence
  derived and/or modified sequence opt5 from anti-influenza_Chain
gacauccagaugacccaaagccccuccucucugagcgccuccgugggcgauagagucacaaugacgugccgggcuucucagaacauucgcagcuaccucaauugguaucagcagagaccugggaccgccccgaagcugcuuaucuacgcggcuuccacacugcacucuggaguucccagccgguucuccggcgggggaagcggcaccgacuuuacacucaccauuaacaaucugcaaccugaggauuucgccucuuauuacugucagcaguccuaugacaacccccagacauuugggcaaggaaccaaaguggaaaucaag

SEQ ID NO: 42905 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuaaccaggacaucgggauuuaccucaauugguaucagcagaacccuggaaagguuccgaaacugcuucugcacggcgccucuagccuccaagggggagugcccucccgcuucucugcgagcggcuccgggaccgauuuuacacugaccauccauagccuucagccugaggaccuggcuacauacuauugucagcagucuagacggcuccccuacaccuucggacaaggcacacgcguggaacugaag

SEQ ID NO: 42906 - RNA, 321 nt, Artificial Sequence
  derived and/or modified sequence opt5 from anti-influenza_Chain
gacauccagaugacccaaagccccuccacacugucugccagcauuggcgauagagugacgauuaccugccgggcuucccagucuaucgccagcuggcucgcgugguaccagcagaagccugggaaagcuccgaagcugcuuaucuaugaggccgucaaccuggaauccggaguucccucucgcuucagcggcuccgggagcggaacagacuuuacccucacaauuucuucccugcaaccugaugacuucgccaccuacuuuugucagcacuauggcacaaucagccagaccuucgggggaggcacgaaaguggagaucaag

SEQ ID NO: 42907 - RNA, 321 nt, Artificial Sequence
  derived and/or modified sequence opt5 from anti-influenza_Chain
gacauccagaugacccaaucccccuccucucugagcgccuccgugggcgauagagucacaauuacgugccgggcuucucagagcaucuccucuuaccucaacugguaucagcacaagccugggaaagccccgaagguucugauguacgcggugagcauucuucaguccggagugcccagccgcuucucuggcuccgggagcggagcugacuuuacccugacaaucucuucccuccaaccugaggauuucgccaccuauuacugucagcagagcuauucuagcccccugacauuuggcgggggaaccaaagucgaaauuaag

SEQ ID NO: 42908 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagaacaucaagcgcuacuucaauugguaucagcagaaaccugggaaggccccgaaacuccugauuuacgcggcuagcaaccuugagaauggaguucccuccagauuuucuggcagcggguccggaaccgacuucacacugaccaucagcucucuccaaccugaagauuuugccacauauuacugucagcaguccuucagcaagucuuggaccuuuggccaggggacaaacguggacauuaaa

SEQ ID NO: 42909 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagaacaucuacaaguaucucaauugguaccagcagcgcccugggaaagccccgaagggacugauuagcgcggcuuccggccuucaaucugggguucccagcagauucuccggaagcggcucugggaccgacuuuacacugaccaucacaucccuccagccugaggauuucgccaccuauuacugucagcagagcuauucucccccucugacauuuggaggcggcacccggguggaaauuaaa

SEQ ID NO: 42910 - RNA, 321 nt, Artificial Sequence
  derived and/or modified sequence opt5 from anti-influenza_Chain
gacauccagaugacccaaagccccuccucucugagcuccucugugggcgauagagucacaauuacgugccgggccagccaguccaucggggcuuacguuaacugguaucagcagaaggccggaaaagcgccucaagugcucauuuucggcgcuucuaaucugcagagcggggugccgucccgcuuuagcggaucuggcuccgggaccgacuucacacuuaccaucagcucucugcagcccgaggauuuugccacauacuucugucagcaaaccuauuccacaccuauuaccuuuggacagggcacgagacucgaaaucaag

SEQ ID NO: 42911 - RNA, 321 nt, Artificial Sequence
  derived and/or modified sequence opt5 from anti-influenza_Chain
gacauccagaugacccaaagccccuccucucugagcgccuccgugggcgauagagucacaauuucuugccgggcuagccaguccaucucuacguaccucaacugguaucagcagcaaccugggaaggccccgaaaguucugauuuucggagcgaccaaucuucagagcggcgugcccucccgcuuuagcgggucuggauccggcacagacuucacccugacaaucagcucucuccagccugaggauuuugcuaccuacuauugucagcaauccuacaacacaccccugauuuucgggcagggaaccaaacuugaaaucaag

SEQ ID NO: 42912 - RNA, 321 nt, Artificial Sequence
  derived and/or modified sequence opt5 from anti-influenza_Chain
gacauccagaugacccaaagccccuccucucugagcgccuccgugggcgauagagucacaauuucuugccgggcuagccaguccaucucuacguaccucaacugguaucagcagcaaccugggaaggccccgaaaguucugauuagcggagcgaccaaucuucaguccggcgugcccagccgcuucucuggguccggaagcggcacagacuuuacccugacaaucucuucccuccagccugaggauuucgcuaccuacuauugucagcaaagcuacaacacaccccugauuuuugggcagggaaccaaacuugaaaucaag

SEQ ID NO: 42913 - RNA, 321 nt, Artificial Sequence
  derived and/or modified sequence opt5 from anti-influenza_Chain
gacauccagaugacccaaagccccuccucucugagcgccuccgugggcgauagacucacaauuacgugccgggcuucucagagcaucuccaccuaccugcacugguaucagcagaagccugggaaagccccgaaacuucugauuuacgcggcuucuagccuccaauccggaguccccagccgcuucucuggcuccagaagcgggacagacuuuacccugacaaucucuucccuucagccugaugacuucgccaccuauuacugucagcagagcuauucucccccucugacauuuggacccggcaccaagguugauaugaag

SEQ ID NO: 42914 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaacuaccucaauugguaucagcacaagccuggggaggccccgaaacugcuuaacuacgcggcuucuagccugcaguccggaguucccagccgcuucucugccuccggcagcgggaccgacuuuacacucaccauuucuucccugcaaccugaagauuucgccacauauuacugucagcagagcuauaauacccccaucacauuuggacagggcaccagacuugagauuaag

SEQ ID NO: 42915 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaacuaccucaauugguaucagcacaagccuggggaggccccgaaacugcuuaacuacgcggcuucuagccugcaguccggaguucccagccgcuucucugccuccggcagcgggaccgacuuuacacucucuauuuccggacugcaaccugaagauuucgccaccuauuacugucagcagagcuauaauacacccaucaccuuuggcccugggacaagacuugagauuaag

SEQ ID NO: 42916 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagagcaucuccaccuaccucaacugguaucagcagaagccugggaaagccccgaagcugcuuauuuacgcggcuucuagccugcacuccggaguucccagccgcuucucuggcuccgggagcggaacagacuuugcccucaccaucucuucccugcaaccugaggauuucgccacauauuacugucagcagagcuauucucccccuauuaccuuuggccaggggacaagacuugaaaucaaa

SEQ ID NO: 42917 - RNA, 321 nt, Artificial Sequence
  derived and/or modified sequence opt5 from anti-influenza_Chain
gacauccagaugacccaaagccccuccucucugagcgccuccgugggcgauagagucacaauuacgugccgggcuucucagaccaucagcacauaccucaacugguaucagcagaaguccgggaaagccccuaagcugcuuauuuacgcggcuucuggacugcaaagcggcguuccgucccgcuucagcgggucuggauccggcaccgacuuuacacucaccaucagcucucugcagcccgaggauuucgccacauauuuuugucagcaguccuacaauaccccucuuacguucgggcaaggaaccaaaguggaaauuaag

SEQ ID NO: 42918 - RNA, 321 nt, Artificial Sequence
  derived and/or modified sequence opt5 from anti-influenza_Chain
gacauccagaugacccaaagccccuccucucugagcgccuccgugggcgauagagucacaauuucuugccgggcuagccaguccaucucuacguaccucaacugguaucagcagcaaccugggaaggccccgaaaguucugauuagcggagcgaccgaccuucaguccggcgugcccagccgcuucucuggguccggaagcggcacagauuuuacccugacaaucucuucccuccagccugaggacuucgcuaccuacuauugucagcaaagcuacaauacaccccugauuuuugggcagggaaccaaacuugaaaucaag

SEQ ID NO: 42919 - RNA, 321 nt, Artificial Sequence
  derived and/or modified sequence opt5 from anti-influenza_Chain
gacauccaggugacccaaagccccuccucucugagcgccuccgucggcgauagaguuacaauuacgugccgggcuucucagaacaucuacaaguaucucaauugguaccagcagcgcccugggaaagccccgaagggacugauuagcgcggcuuccggccuucaaucuggggugcccagcagauucuccggaagcggcucugggaccgacuuuacacugaccaucacaucccuccagccugaggauuucgccaccuauuacugucagcagagcuauucucccccucugacauuuggaggcggcacccggguggacauuaaa

SEQ ID NO: 42920 - RNA, 321 nt, Artificial Sequence
  derived and/or modified sequence opt5 from anti-influenza_Chain
cagagcgugcugacccaacccccuuccgagucugucagcccgggccagacagccuccguuacgugcucugggcacaagcucggagacaaauacgugagcugguaucagcagaagcccggccaauccccugugcugcuuaucuaccaggauaacagacggcccucugggauuccugaacgcuucaucggaagcaauuccggcaacaccgcuacacugaccauuagcgggacacaggcccucgacgaggcggauuauuacugucaggcuugggacucuuccaccgccgucuuuggaggcggcacaaaacugaccgugcuuggg

SEQ ID NO: 42921 - RNA, 321 nt, Artificial Sequence
  derived and/or modified sequence opt5 from anti-influenza_Chain
gacauccagcugacccaaagccccuccucucucagcgccuccgugggcgauagagucacaauuacgugccgggcuucucaggggaucagcaccuaccuggccugguaucagcagaagccuggaaaaguuccgaaacuucugauuuacgcggcuuccacacuccaaucuggcgugcccagccgcuucuccgggagcggaucuggcaccgacuuuacacugaccaucuccagccuucagccugaggauguggccacauauuacugucagaaguauaacucugcccccuccuucgggccuggaaccaaggucgacauuaaaaga

SEQ ID NO: 42922 - RNA, 321 nt, Artificial Sequence
  derived and/or modified sequence opt5 from anti-influenza_Chain
agcgugcugacccagcccccuuccgccucuggcagcagagggcaauccaucacaauuucuugcacgggaagcaccuccgacaucggcucuuacaacuaugucagcugguaccagcagcacccggggacagcucccaagguuauucucuaugaggugucccagcggccuagcggagugcccgaucgcuucucuggcuccaaaagcgggaauaccgccuuucugacagucucuggacuucaagcggaagacgaggcugauuacuauugugccuccuacgccggcaacaauaucuauguguucggcagcgggaccaagguuaca

SEQ ID NO: 42923 - RNA, 321 nt, Artificial Sequence
  derived and/or modified sequence opt5 from anti-influenza_Chain
agcgcccugacccagcccccuuccgcuucuggcagcagagggcaauccaucacaauuucuugcacgggaagcaccuccgacaucggcucuuacaacuaugugagcugguaccagcagcacccggggacagcccccaaggucauucucuaugagguuucccagcggccuagcggagugcccgaucgcuucucuggcuccaaaagcgggaauaccgcguuucugacagugucuggacuucaagcugaagacgaggccgauuacuauugugccuccuacgcuggcaacaauaucuaugucuucggcagcgggaccaaggugaca

SEQ ID NO: 42924 - RNA, 321 nt, Artificial Sequence
  derived and/or modified sequence opt5 from anti-influenza_Chain
gagaucgugcugacccagagccccgccacacucucccugucuccuggcgaaagagcuacgcuuagcugccgggccucccaaucugucagcaccuuccuggcgugguaccagcagaagccggggcaggcuccccgccuccugauguaugacgccuccaacagagccacaggcauuccugcucgguuuucuggaagcggguccggaaccgauuucacacuuaccaucagcucucuggagcccgaagacuuugccauuuacuauugucaacagcgcucccacuggccucccaucuucggccaggggacaagacucgagauuaaa

SEQ ID NO: 42925 - RNA, 321 nt, Artificial Sequence
  derived and/or modified sequence opt5 from anti-influenza_Chain
gacauccagaugacccaaagccccgccucccugucugugagcgucggcgagacaguuacgauuaccugcagagcuuccgaaaagaucuacucuaaccucgccugguaucagcagaaagagggaaagagcccucagcugcuuguguacgcggcuauucggcuggccgauggggugccgucccgcuucucuggcagcggguccggaacacaauuuagccucaaaaucaauucucugcaguccgaagacuucggcaccuauuacugucagcacuuuugggggacaccccuuaccuucggagccggcacaaagcuggagcucaaa

SEQ ID NO: 42926 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaagcgccgaagcuccugauuuaugcugccuccucucuucaaagcggagugcccucccgcuucagcggcucuggguccggaacagauuuuacccugacaaucagcucucuccagccugaggacuucgccaccuacuuuugucagcaggcuaacuccuuucccccuacauucggccaagggaccaaacuggaaauuaag

SEQ ID NO: 42927 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaagcgccgaagcuccugauuuaugcugccuccucucuucaaagcggagugcccucccgcuucagcggcucuggguccggaacagauuuuacccugacaaucagcucucuccagccugaggacuucgccaccuacuuuugucagcaggcuaacuccuuucccccuacauucggcugcgggaccaaacuggaaauuaag

SEQ ID NO: 42928 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaauguccgaagcuccugauuuaugcggcuuccucucuucaaagcggagugcccucccgcuucagcggcucuggguccggaacagauuuuacccugacaaucagcucucuccagccugaggacuucgccaccuacuuuugccagcaggccaacuccuuucccccuacauucggccaagggaccaaacuggaaauuaag

SEQ ID NO: 42929 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaagcgccgaagcuccugauuuaugcugccuccucucuucaaagcggagugcccucccgcuucagcggcucuggguccggaacagauuuuacccugacaaucagcucucuccagccugaggacuucgccaccuacuauugucagcaggcuaacuccuuucccccuacauucggccaagggaccaaacuggaaauuaag

SEQ ID NO: 42930 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaagcgccgaagcuccugauuuaugcugccuccucucuucaaagcggagugcccucccgcuucagcggcucuggguccggaacagauuuuacccugacaaucagcucucuccagccugaggacuucgccaccuacuauugucagcaggcuaacuccuuucccccuacauucggcugcgggaccaaacuggaaauuaag

SEQ ID NO: 42931 - RNA, 321 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaauguccgaagcuccugauuuaugcggcuuccucucuucaaagcggagugcccucccgcuucagcggcucuggguccggaacagauuuuacccugacaaucagcucucuccagccugaggacuucgccaccuacuauugccagcaggccaacuccuuucccccuacauucggccaagggaccaaacuggaaauuaag

SEQ ID NO: 42932 - RNA, 321 nt, Artificial Sequence
  derived and/or modified sequence opt5 from anti-influenza_Chain
gagaucgugcugacccagagccccgccacacucucccugucuccuggcgaaagagcuacgcuuagcugccgggccucccgcucuauuaccacauuccuggcgugguaccaacagaagccggggcaggcucccagacuccugaucuaugacgccagcaaccgggccaccggagucccugcucgcuuuuccggcucugggagcggaacagauuucacccuuacaauuaauucccuggagcccgacgauuuugccaucuacuauugucagcaaagagaccacuggccucccauuuucggccaggggacccggcucgaaaucaaa

SEQ ID NO: 42933 - RNA, 321 nt, Artificial Sequence
  derived and/or modified sequence opt5 from anti-influenza_Chain
gagaucgugcugacccagagccccgccacacucucccugucuccuggcgaaagagcuacgcuuagcugccgggccucccgcucuauuaccacauuccuggcgugguaccaacagaagccggggcaggcucccagacuccugaucuaugacgccagcaaccgggccaccggagucccugcucgcuuuuccggcucugggagcggaacagauuucacccuuacaauuaauucccuggagcccgacgauuuugccaucuacuauugucagcaaagagaccacuggccucccauuuucggcugcgggacccggcucgaaaucaaa

SEQ ID NO: 42934 - RNA, 324 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaaccgucucuagcuccuaccuggccugguaucagcagaagccgggacaggcgccccgccuccugauuuacggcgcuucuagcagagccacagggaucccugaccgguucuccggaagcggcucugggaccgauuuuacacuuaccauuucccgccuggagcccgaagacuucgccguuuauuacugucaacaguauggaaacagcccuuacacauuuggccagggcaccaaacucgagaucaag

SEQ ID NO: 42935 - RNA, 324 nt, Artificial Sequence
  derived and/or modified sequence opt5 from anti-influenza_Chain
gagaucgugcugacccagagccccggcacacucuccgucucuccuggggaaagagccacgcugagcugccgggcuucccaaucuauuagcuccggauaccuugccugguaucagcagaagccgggccaggcgccccgccugcucaucuacggggcuucuagcagagccaccggcauuccugaccgguucuccggaagcgggucuggaacagauuuuacccugacaaucucccgccuugagcccgaagacuucgccguuuauuacugucaacaguauggcaccagcccucagacauuuggccaggggaccaaaguggagauuaag

SEQ ID NO: 42936 - RNA, 324 nt, Artificial Sequence
  derived and/or modified sequence opt5 from anti-influenza_Chain
gaggugguccugacccagagccccggcacacucucccugucuccugggcaaagagccacgcuuagcugccgggcuucccagucuguuagcuccucuuaccuggccugguaucagcagaagccgggacaagcgccccgccuccugaucuacgacgcuagcaacagagccaccggcauuccugaucgguucuccgggagcggaucuggcacagacuuuacccuuacaaucucccgccuggaacccgaggauuucgccguguauuacugucagcaguaugggagcucuccuuacaccuuuggacagggcacaaaacucgaaauuaag

SEQ ID NO: 42937 - RNA, 324 nt, Artificial Sequence
  derived and/or modified sequence opt5 from anti-influenza_Chain
gacauccagcugacccaaagccccuccucucucagcgccuccgugggcgauagagucacaauuacgugccgggcuucucaggggaucauuaccuaccugaacugguaucagcagaagccuggaaaagccccgaaacuucugaucuacgcgacauauagccuccaaaauggcguucccucccgcuucucugggagcggauccggcaccgacuuuacacugaccauuagcucucuucagccugaggauuucgcuacauacuauugucagcaguccuacagcucucugauguuuaccuucgggcaaggaacgaagcucgacaucaag

SEQ ID NO: 42938 - RNA, 324 nt, Artificial Sequence
  derived and/or modified sequence opt5 from anti-influenza_Chain
gagaccgugcugacacagagccccggcacgcucucccugaccccuggggaaagagccacacuuucuugccgggucggacaaagcguuuccggcucucaccuggcuugguaccagcagaagccggggcaggcgccccgccuccugaucuauggagccagcuccagagcuaccggcauuccugaccgguucgggggaucugugagcggcacagauuuuacccuuacaaucucccgccuggagcccgaagacagcgccguguacuauugucaacaguacggcgauucuagauauaccuucgggcagggaacgaaacucgagauuaag

SEQ ID NO: 42939 - RNA, 324 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucucagcuggccugguaccagcagaagccgggacaagcgccccgccucauuaucuauggcgcuagcaccagagccacagggauuccugaccgguucuccggaagcggcucugggaccgauuuuacacugaccaucggacgccuugagcccgaagacuucgccguguuuuucugucagcaguacuccacaagcccucccaccuuuggccagggcacgaaaguugauuucaag

SEQ ID NO: 42940 - RNA, 324 nt, Artificial Sequence
  derived and/or modified sequence opt5 from anti-influenza_Chain
gacaucgugcugacccagagccccggcacacucucccugucuccuggggagagagccacgcuuagcugccgggcuucccaaucugucagcuccucuuaccuggccugguaucagcagaagccgggacaggcgccccgccucguuauguacggcgcugccaccagagccacagggauuccugaucgguucagcggauccggcagcgggcccgacuuuacccugacaaucucucgccuugaaccugaggauuucgcuauguauuacugucaacaguauggaaacucccccauuaccuuuggccagggcacaagacuggaaaucaaa

SEQ ID NO: 42941 - RNA, 324 nt, Artificial Sequence
  derived and/or modified sequence opt5 from anti-influenza_Chain
gagaucgugcugacccagagccccgccacacucucccugucuccuggcgaaagagcuacgcuuagcugccgggccucccaaucugucagcuccuaccuggcgugguaucagcagaagccggggcaggcuccccgccuccugauuuacgacgccucuaacagagccaccggaaucccugcucgguucagcggcuccgggagcggaacagauuuuacccuuacaauuucuucccuggagcccgaagacuucgccguuuauuacugucaacagcgcagccacuggccucccaucaccuuuggccaggggacaagacucgagauuaaa

SEQ ID NO: 42942 - RNA, 324 nt, Artificial Sequence
  derived and/or modified sequence opt5 from anti-influenza_Chain
agcuacgagcugacccagcccccuuccgugucugucagcccgggccaaacagccagaaucacgugcuccggggacgcucuccccaagcagaacgccuauugguaccagcagaaaccuggacaagcgcccguucugcuuauuuauaaggauucugaacggccuagcggcauccccgagcgcuucuccgggucuagcuccggaaccacagugacccugacaauuagcggcgugcaggcugaagacgaggccgauuacuauugucagucugccgacuccagcgggaccucuugggucuuuggaggcggcacaaaacucaccgugcug

SEQ ID NO: 42943 - RNA, 324 nt, Artificial Sequence
  derived and/or modified sequence opt5 from anti-influenza_Chain
agcuacgugcugacccaggcccccuccgucucuguugcuccuggccaaacagccagaaucacgugcgggggaaacgcgauuggcagcaagaaagugcacugguaucagcauaaggcugggcaggccccggugcucgucguguacgacgauaccgaccggcccuccggaaucccugagcgcuucucuggcagcaauuccuggucuacagccacccugacaauuaacagaguugaagcuggggaugaggccgacuauuacugucaggugugggauuuuaccaucgaccacgucguguucggaggcggcacaaaacuuaccguucug

SEQ ID NO: 42944 - RNA, 324 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucuuaccuggccugguaucagaagaaaccgggacaggcgccccgccuccugauuuacggcgcuagcaccagagccacagggaucccugaccgguucaccggauccggcagcgggacagauuuuacccuuucuauuucccgccuggagcccgaagacuucgccguuuauuacugucagcacuuuggaacaagcguguucaccuuuggcggcgggacgaagguggagaucaaa

SEQ ID NO: 42945 - RNA, 324 nt, Artificial Sequence
  derived and/or modified sequence opt5 from anti-influenza_Chain
gagaucgugaugacccagagccccgccacacuguccgucucuccuggcgaaagagcuacgcucagcugccgggccucccaaucuguugggaacagccuggcgugguaccagcagcgcccgggacaggcucccagacuucugauuuauggcgccuccacccgggccacagggaucccuccccgcuucucuggaagcggcuccgggaccgaguuuacacucaccauuagcucucugcaaacagaagacuucgcuguguacuauugucagcaguacaucaauuggagaccucuuuccuuuggaggcggcaccaagguggagauuaaa

SEQ ID NO: 42946 - RNA, 324 nt, Artificial Sequence
  derived and/or modified sequence opt5 from anti-influenza_Chain
caggagagcggcgccgaacuggugagacccggggcuuccgucaagcucucuugcaaagacagcggauacaccuucacaacguauuggaugaacuggguuaagcaacggccugagcagggccuggaauggaucgggcgcauugauccguacgacuccgagacccacuauaaucagaaauuuaaggauaaagccauccuuacaguggacaagucuagcaacaccgcguacaugcagcuguccucucucacaagcgaagauuccgcuguguauuacugugucagaggaggcagcaccguggccuauuucgggguuuggggacaaggc

SEQ ID NO: 42947 - RNA, 324 nt, Artificial Sequence
  derived and/or modified sequence opt5 from anti-influenza_Chain
gagaucgugcugacccagagccccggcacacucucccugucuccuggggaaagagccacgcuuagcugccgggcuucccaacgcgucucuagcuaccuggccugguaucagcagaagccgggacaggcgcccagacuccugauuuacggcgcuuccacccgggccgccgggaucccugaccgcuucucuggaagcggcuccgggacagauuuuacccuuacaauuagcagacuggagcccgaagacucugcuguuuauuacugucaacaguauggacggaccccucucacauucggcggcgggaccaaaguggagaucaagcgc

SEQ ID NO: 42948 - RNA, 324 nt, Artificial Sequence
  derived and/or modified sequence opt5 from anti-influenza_Chain
gagaucgugaugacccagagccccggcacacugucccucucuccuggggaaagagccacgcugagcugccgggcuucccaaucugucagcuccucuuaccuugccugguaucagcagaagccgggacaggcgccccgccugcucauuuucggcgcuagcuccagagccaccgggaucccugaccgguuuagcggaucuggcuccgggacagauuucacccugacaauuagccgccuugagcccgaagacuuugccguuuacuauugucaacaguacggaucuucccugaccuucggcggcgggacaaaacucgagaucaagaga

SEQ ID NO: 42949 - RNA, 324 nt, Artificial Sequence
  derived and/or modified sequence opt5 from anti-influenza_Chain
gagaucgugcuguaccagagccccggcacccucucccugucuccuggggaaagagccacacuuagcugccgggcuucccaacgcgucucuagcuaucuggccugguaccagcagaagccgggacaggcgcccagacuccugauuuauggcgcuuccacgcgggccgccgggaucccugaccgcuucucuggaagcggcuccgggaccgauuuuacacuuaccauuagcagacuggagcccgaagacucugcuguuuacuauugucaacaguacggacggacaccucucaccuucggcggcgggacaaaaguggagaucaagcgc

SEQ ID NO: 42950 - RNA, 324 nt, Artificial Sequence
  derived and/or modified sequence opt5 from anti-influenza_Chain
gacaucgugcugacccaggcccccagcgucuccguuucuccuggccaaacagcuagcauuacgugcuccggggauagacucggagagaaguucgccucuugguaccagcagaaaccgggccagagccccgugcuggugaucuaugaagacuccaagcggccuucugggauucccgaucgcuuuagcggauccaacagcggcaauaccgcgacacuuaccaucucugggacacaaauuauggacgagggagauuucuuuugucaggcuugggacuccagcaccgucguguucggcggcgggacaaaacugaccguucucggacag

SEQ ID NO: 42951 - RNA, 324 nt, Artificial Sequence
  derived and/or modified sequence opt5 from anti-influenza_Chain
gacaucgagcugacccagagccccuccgugucugucagcccuggccaaacagccuccauuacgugcucuggggauaagcucggagacaaguucguuuguugguaccagcagaaggcuggccagagcccgaucguggugauuuaucaagaugacaaaagacccuccgggaucccugaacgguuuucuggaagcaacuccggcaauaccgccacacugaccauuagcgggacacaggcgauggaugaggcugacuacuucugccaggccugggauucuaccacagucguguuuggaggcggcaccaaacuuacgguucuggggcag

SEQ ID NO: 42952 - RNA, 324 nt, Artificial Sequence
  derived and/or modified sequence opt5 from anti-influenza_Chain
cagagcgugcugacccaacccccuuccgccucuggcagcagagggcaguccaucacaauuucuugcacgggaagcaccuccgacaucggcucuuacaacuaugucagcugguaccagcagcacccggggacagcucccaagguuauucucuaugaggugucccaacggccuagcggagugcccgaucgcuucucuggcuccaaaagcgggaauaccgccuuucugacagucucuggacuucagaccgacgaugaagcggacuacuauugugcuuccuacgccggcaacaauaucuauguguucggcagcgggacaaagguuacc

SEQ ID NO: 42953 - RNA, 327 nt, Artificial Sequence
  derived and/or modified sequence opt5 from anti-influenza_Chain
aacuucaugcugacccagccccacagcguguccgagucuccuggcaagacagucacgaucagcugcaccggguccggaggcaauauugccagaaacuacguucaaugguaucagcagcggccggggucugcucccgugacagugauccucgaagacgauaaacgcccuagcggcauucccgacagauuuuccggaucuaucgaucggagcuccaauagcgccucucugaccauuuccgggcuucgcacagaggacgaagcgcuguacuauugucagagcuacgaugacucugaucucgucguguucggaggcggcaccaagcugaca

SEQ ID NO: 42954 - RNA, 327 nt, Artificial Sequence
  derived and/or modified sequence opt5 from anti-influenza_Chain
augcuggagccccuccagauccugagcauuugcuccuucauccuuucugcccugcacuuuauggcuuggaccauuggccaucucaaccaaaucaagagaggggugaaucugaaaauucagauccggaacccuaauaaggaagccaucaaccgcgaggucagcauucuuagacacaauuaccagaaagaaauccaggcgaaggagacaaugaaaaagauucuguccgacaacauggaaguucucggagaucauaucgugguggagggccugucuacggacgagauuaucaagaugggggaaaccguccuggagguggaggaacuccaa

SEQ ID NO: 42955 - RNA, 327 nt, Artificial Sequence
  derived and/or modified sequence opt5 from anti-influenza_Chain
gacaucagacugacccagagccccgccacacucuccgugucuccuggcgagcgggcuacgcugagcugccgcgccucccacucugucagcagaaaccuugcgugguaccaacagaagccggggcgggcuccccgccugcucguuuaugauaccuccucuagagccacaggcauuccugcccgguucagcggauccgggagcggaaccgaauuuacacugaccaucucuucccuucagagcgaggacuucgcuguguacuauugucagcaauacaauaacuggccccgcacauuuggccaggggaccaaaguggauauuaagagaacg

SEQ ID NO: 42956 - RNA, 327 nt, Artificial Sequence
  derived and/or modified sequence opt5 from anti-influenza_Chain
gagaucgugaugacccagagccccggcacacugucccucucuccuggggaaagagccacgcugagcugccgggcuucccaaucugucagcuccucuuaccuugccugguaucagcagaagccgggacaggcgccccgccugcucauuuacggcgcuagcaccagagccacagggguuccugaccgguuccacggaggcggguccggaaccgauuuuacacugaccaucagccgccuugagcccgaagacuucgccguguauuacugucaacaguaugauacaucuuccggccugaccuuuggcgggggaacgaaaguggagauuaag

SEQ ID NO: 42957 - RNA, 327 nt, Artificial Sequence
  derived and/or modified sequence opt5 from anti-influenza_Chain
gagaucgugaugacccaguuccccgccacacugagcgucuccccuggcgaaagaguuacgcucucuugccgggcuagccaauccgugucuaacaaucuggccugguaccagcagaagccggggcagcccccucgccuucugauuuaugacgcgagcaccagagcuacaggagugcccgccaaauuuuccggcaccgggucuggaacagaguucacccucagcaucuccagccugcaaucugaagauuuugccgucuacuauugucagcaguaccacaacuggccucccuccuauagcuucggccuugggacaaagcuggagauuaaa

SEQ ID NO: 42958 - RNA, 327 nt, Artificial Sequence
  derived and/or modified sequence opt5 from anti-influenza_Chain
gagaucauucuggcccagagccccggcacccucucccugucuccuggggaaagagcuacacuuagcugccgggccucccaauucgugucuacgcgcagccuggcgugguaccagcagagaccgggacaggcuccccggcuccugaucuauggcgccuccucucgcgccaccgggauuccugacagauuuagcggauccggcagcgggacagauuucacccuuacaaucucucggcuggagcccgaagacuuugcugucuacuauugucaacacuacggauauuccccucgcuacgccuucggccagggcagcaagguugagauuaaa

SEQ ID NO: 42959 - RNA, 327 nt, Artificial Sequence
  derived and/or modified sequence opt5 from anti-influenza_Chain
gagaucgugcugacccagagccccggcacacucucccugucuccuggggaaagagccacgcuuagcugccgggcuucccacuucgucaacuaccgcucucuggccugguaucaacagaccccgggacagguucccagacuccugauuuacggcgcgagcacacgggcuaccgggaucccugaccgcuuuuccggaucuggcagcgggacagauuucacccuuacaauuuccagacuggagcccgaagacuuugccguguauuucugucagcaauacggaggcagcccucgguauaccuuuggccaggggacgcgccucgagaucaag

SEQ ID NO: 42960 - RNA, 327 nt, Artificial Sequence
  derived and/or modified sequence opt5 from anti-influenza_Chain
gagaucgugcugacccagagccccggcacacucucccugucuccuggggaaagagccacgcuuagcugccgggcuucccacuucgucauuggacgcgccguugcgugguaccaacagaagccgggccaggcucccagacugcucaucuauggggccucuagccgggccaccggcauuccugaccgcuuuuccggaucugggagcggaacagauuucacccugacaaucuccagacuugagaccgaagacuuugcuguguucuacugucagcauuauggcagcucuccccgguacgccuuuggccaagggacaaaacuggagauuaag

SEQ ID NO: 42961 - RNA, 327 nt, Artificial Sequence
  derived and/or modified sequence opt5 from anti-influenza_Chain
gagaucgugcugacccagagccccgccacacucucccugucuccuggcgaaagagcuacgcuuagcugccgggccucccaaucugucgggaacuaccuggcgugguaucagcagaagccgggacaggcuccccgccuccugauuuacgacagcuccaauagagccccuggcauccccgcccgguucucugggagcggauccggcaccgauuuuacacuuaccauuagcucucuggcuccugaggacuucgccguuuauuacugucaacagcgcuccaaauggcccccuauguauagcuuugggcacggaacaaagcucgaaaucaaa

SEQ ID NO: 42962 - RNA, 327 nt, Artificial Sequence
  derived and/or modified sequence opt5 from anti-influenza_Chain
caggccguggucacccaagagcccagccugacaguuuccccuggcgggacggugacccucacaugcggaucuagcaccggcccggugacauccgggcacuaccccuauugguuccagcagaagccuggacaggcucccagaacccugaucucugccacaagcaacacccauuccuggacgccugcgcgguuuucuggcagccuucucgggggacgcgcugcccugacccuguccggcgcccaacccgaagacgaggcugauuacuauuguuuccuuagcuacucuggcgccugggucuuugggggaggcacaacccugacagugcuc

SEQ ID NO: 42963 - RNA, 327 nt, Artificial Sequence
  derived and/or modified sequence opt5 from anti-influenza_Chain
gccauccagaugacccaaagccccuccucucugagcgcuuccgugggcgacagagucacaauuacgugccgggccucucagaacauccgcagcuaccucaauugguaucagcagaagccugggaaagcgccgaaccugcuuauuuacggaaccacaucccuggagucuggcguucccagcagauucuccgggagcggaucuggcaccgauuuuacacucaccaucuccagccugcaaccugaagacuucgcuacauauuacugucagcagucuuaucacacgccccagaccuuugggcaaggaaccaagguggagauuaaacggaca

SEQ ID NO: 42964 - RNA, 327 nt, Artificial Sequence
  derived and/or modified sequence opt5 from anti-influenza_Chain
gacauccagaugacccaaagccccuccucucugagcgccuccgugggcgauagaauuacaaucacgugccgggccucucaggggauugacaacuaccucgccugguuccagcagaagccuggaaaagucccggagcugcuuaucuaugcggcuagcacccugcaauccggcguucccucucgcuuuagcggguccggaagcggcacaggguucacccucacaauuucuucccugcagccugaagauguggccaccuacuauugucagaaguacgacagcgcuccccuuacauuuggaggcggcaccaaaguggauaucaagagaacg

SEQ ID NO: 42965 - RNA, 327 nt, Artificial Sequence
  derived and/or modified sequence opt5 from anti-influenza_Chain
gacauccagcugacccaaagccccuccucucucagcgccuccgugggcgauagagucacaauuacgugccgggccucucaggggaucaccgacuaccuggccugguaucagcagaagccuggaacaauuccgaaacuucugaucuacgcggcuagcacccuccaauccggcguucccucucgcuucagcgggggaggcuaugggacagauuuuacccugacaauuuccagccuucagccugaggacguggccaccuacuauugucagaaguacaacucugcuccccugacguucggaggcggcaccaaaguggaaaucaagagaaca

SEQ ID NO: 42966 - RNA, 327 nt, Artificial Sequence
  derived and/or modified sequence opt5 from anti-influenza_Chain
gacaucgugaugacccagagccccuucucccugucucucagcccuggcgagagagccacacuguccugccgggcuucucaaagcauuuccaacuaccuugccugguaucagcagaagccggggcaggcgccccgccugcucaucuacgauucuagcaauagagcuacgggagucccugcccgguuuuccggcagcgggucuggaaccgacuucacacugaccauuuccagccuugaacccgaggauuuugccguuuauuacugucaacagcgcucuaacuggauguauacauucggccaggggaccaaaguggaaaucaagagaaca

SEQ ID NO: 42967 - RNA, 327 nt, Artificial Sequence
  derived and/or modified sequence opt5 from anti-influenza_Chain
gacauccagaugacccaaagccccuccucucugagcgccuccgugggcgauagagucacaauuacgugccgggccucucaggggaucagcuccuaccucgccugguaucagcagaagccuggaaaaguuccgacccugcuuauuuacgacgcgucuacacugcgcagcggcgugcccuccagauucagcgggucuggauccgcuaccgauuuuacacucaccaucagcucucugcaaccugaggacguggccacauauuacugucagcgguauaacuccgcucccccuauuaccuucggccaggggacgcgccuugaaaucaagaga

SEQ ID NO: 42968 - RNA, 327 nt, Artificial Sequence
  derived and/or modified sequence opt5 from anti-influenza_Chain
gagaucgugaugacccagagccccggcacacugucccucucuccuggggaaagagccacgcugagcugccgggcuucccaaucugucagcuccucuuaccuugccugguaucagcagaagccgggacaggcgccccgccugcucauuuacgacgcuagcuccagagccaccgauaucccugaccgguucagcggcucuggguccggaacagauuuuacccugacaauuagccgccuugagcccgaagacuucgccguuuauuacugucaacaguaugggucuucccuguggaccuuuggccagggaacaaaaguggagaucaagaga

SEQ ID NO: 42969 - RNA, 327 nt, Artificial Sequence
  derived and/or modified sequence opt5 from anti-influenza_Chain
agcuacgugcugacccagcccccuuccgucucuguugccccgggccaaacagcuagaaucacgugcgggggaaacaauauuggcagcaaguccgugcacugguaucagcagaaacccgggcaggccccugugcucgucguguacgacgauucugaccggcccagcggaaucccugagcgcuucuccggcucuaacagcgggaauaccgcgacacugaccauuuccagaguugaagcuggagaugaggccgacuauuacugucaagugugggauucuagcuccgaccaugccgucuuuggcggcgggacacagcuuaccgugcuggga

SEQ ID NO: 42970 - RNA, 327 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccuagaaccuuuggcggcgggacaaaaguggagaucaagcgg

SEQ ID NO: 42971 - RNA, 327 nt, Artificial Sequence
  derived and/or modified sequence opt5 from anti-influenza_Chain
agcuacgugcugacccagcccccuuccgucucuguugccccgggccaaacagcuagaaucacgugcgggggaaacaauauuggcagcaagggggugcacugguaucagcagaagcccggacaggccccugugcucgucguguacgacgauuccgaccggcccucuggcaucccugagcgcuucagcggguccaacucuggaaauaccgcgacacugaccauuagcagaguugaagcuggcgaugaggccgacuauuacugucaagugugggauuccagcucugaccaugucguguuuggcgggggaacaaaacuuaccguucugggc

SEQ ID NO: 42972 - RNA, 327 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccaacuaccugggauggacccagcagaagccgggccaggcgccccgccuccugauuuauggggccucuagcagagcuuccggaaucccugaccgguucagcggcgggggaucuggcacagauuuuacccuuacaauuucccgccuggagcccgaagacuucgccguuuacuauugucaacaguacggcagcucuccucucaccuuugggggaggcacaaaaguggagaucaagaga

SEQ ID NO: 42973 - RNA, 327 nt, Artificial Sequence
  derived and/or modified sequence opt5 from anti-influenza_Chain
cagagcguggucacccaacccccuuccguuucuguggccccgggccagacagcuagaaucacgugcgggggaaacaauauuggcagcaaguccgugcacugguaccagcagaaacccgggcaagccccuguccuggugguuuaugacgauucugaccggcccagcggaaucccugagcgcuucuccggcucuaacagcgggaauaccgcgacacucaccauuuccagaguggaagcuggagaugaggccgacuacuauugucaggucugggauucuagcuccgaccauuacguguuuggcacaggcaccaagguuacagugcugggg

SEQ ID NO: 42974 - RNA, 327 nt, Artificial Sequence
  derived and/or modified sequence opt5 from anti-influenza_Chain
agcuacgugcugacccagcccccuuccgagucugucgccccgggccaaacagcuagaaucacgugcgggggaaacaauauuggccggaacagcguucacugguaucagcagaagcccgggcaggccccugugcucguggucuacgacgauuccgaccgccccucuggaaucccugaaagauucagcggcuccaaaucugggaauaccgcgacacugauuaucagccggguggagguuggagaugaagcugacuauuacugucaaguguggcauuccagcucugaucacuaugucuuuggcaccggcacaaaggugaccguucuuggg

SEQ ID NO: 42975 - RNA, 327 nt, Artificial Sequence
  derived and/or modified sequence opt5 from anti-influenza_Chain
gagaucgugaugacccagagccccggcacacugucccucucuccugggcaaagagccacgcugagcugccgggcuucccagucugucagcuccucuuaccuugccugguaucagcagaagccgggacaagcgccccgccugcucauguacggcgcuagcuccagagccaccgggauuccugaccgguucagcggaucuggcuccgggacagauuuuacccugacaaucagccgccuugaacccgaggacuucgccguuuauuacugucagcaguauggaucuuccagccugaccuuuggcggcgggacaaaacucgaaauuaagaga

SEQ ID NO: 42976 - RNA, 327 nt, Artificial Sequence
  derived and/or modified sequence opt5 from anti-influenza_Chain
caggccggccugacccaacccccuagcguguccgucgcuccggggcagacagccagaaucacgugcggaggcaacaauauugggucuaagagcguucacugguaccagcagaagcccggacaagcgccugugcucguggucuaugacgauuccgaccggcccucuggcaucccugagcgcuucagcggguccaacucuggaaauaccgcuacacugaccauuagcagaguggaagccggcgaugaggccgacuacuauugucagguuugggauuccagcucugaccauguggucuuuggcgggggaacaaaacuuaccgugcugggc

SEQ ID NO: 42977 - RNA, 327 nt, Artificial Sequence
  derived and/or modified sequence opt5 from anti-influenza_Chain
cagagcguggucacccaacccccuuccgagucuguugccccgggccagacagcuagaaucacgugcgggggacacaacauuggcagcaauuccgugcauugguaccagcagaagcccgggcaagccccugugcuggucguguaugacaacucugaucggcccagcggaaucccugaacgcuucuccggcucuaauagcgggaacaccgcgacacucaccauuuccagaguugaggcuggagacgaagccgauuacuauugucagguguggggcucuagcuccgaccacuacgucuuuggcacagggaccaaagugacaguucuggga

SEQ ID NO: 42978 - RNA, 327 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccaacuaccugggaugguaucagcagaagccgggccaggcgccccgccuccugauuuacggggccucuagcagagcuuccggaaucccugaccgguucagcggcgggggaucuggcaccgauuuuacacuuaccauuucccgccuggagcccgaagacuucgccguuuauuacugucaacaguauggcagcucuccucucacauuugggggaggcaccaaaguggagaucaagaga

SEQ ID NO: 42979 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuggcccccucgccugacauuuggcgggggaucuaaagucgagauuaag

SEQ ID NO: 42980 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuaucccccucgccugacauuuggcgggggaucuaaagucgagauuaag

SEQ ID NO: 42981 - RNA, 327 nt, Artificial Sequence
  derived and/or modified sequence opt5 from anti-influenza_Chain
gagaucgugaugacccagagccccgccacacuguccgucucuccuggcgaaagagcuacgcucagcugccgggccucccaaucuguugacagcaaccuggcgugguaccagcagaagccggggcaggcuccccgccuucugguguauuccgccucuaccagagccacaggcauuccugcucgguucagcggauccgggagcggaaccgaguuuacacucgccaucucuucccugcaaagcgaagauuucgcuguguacuauugucagcacuacaccaauuggcccccucgccuuacauuuggcgggggaucuaaagucgagauuaag

SEQ ID NO: 42982 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagcuccaaccuugcgugguaccagcagaagccggggcaggcuccccgccugcucguguauucugccagcaccagagccacaggcauuccugcucgguucuccggaagcgggucuggaaccgaguuuacacuggccaucuccagccuucaaucugaagacuucgcuguguacuauugucagcacuacaccaauuggcccccucgccugacauuuggcgggggauccaaagucgagauuaag

SEQ ID NO: 42983 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugaccacaaccuugcgugguaccagcagaagccggggcaggcuccccgccugcucguguauagcgccuccaccagagccacaggcauuccugcucgguucucuggaagcggguccggaaccgaguuuacacuggccaucagcucucuucaauccgaagauuucgcuguguacuauugucagcauuacaccaauuggcccccucgccugacauuuggcgggggaagcaaagucgagauuaag

SEQ ID NO: 42984 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuggcccccucgccugacauuuggcgggggaucuaaagucgagauuaag

SEQ ID NO: 42985 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuuucccccucgccugacauucggcgggggaucuaaagucgagauuaag

SEQ ID NO: 42986 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuuucccccucgccugacauucggcgggggaucuaaagucgagauuaag

SEQ ID NO: 42987 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuaucccccucgccugacauuuggcgggggaucuaaagucgagauuaag

SEQ ID NO: 42988 - RNA, 327 nt, Artificial Sequence
  derived and/or modified sequence opt5 from anti-influenza_Chain
gagaccacacugacgcagagccccgccacccucuccgugucuccuggcgaaagagcuacacugagcugccgggccucccaagucaucucucacaaccuugcgugguaccagcagaagccggggcaggcuccccgccugcucauuuauggagccagcaccagagccuccggcaucccugcucgguucucugggagcggauccggcacagacuacacccugacaauuaccagccuucaaucugaggauuuugccguuuauuacugucagcauuauuccaauuggcccccucgccugacguucgggggaggcaccaaaguggaaaucaag

SEQ ID NO: 42989 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaaucugaggauuuugccguguauuacugucagcauuauuccaauuggcccccucgccugacauucgggggaggcaccaaaguggaaauuaag

SEQ ID NO: 42990 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaacccgaggauuuugccguguauuacugucagcauuauucuaauuggccuccccgccugacauucgggggaggcaccaaaguggaaauuaag

SEQ ID NO: 42991 - RNA, 327 nt, Artificial Sequence
  derived and/or modified sequence opt5 from anti-influenza_Chain
gagaucgugaugacccagagccccgccacacuguccgucucuccuggcgaaagagcuacgcucagcugccgggccucccaaguuauuucucacaaccuggcgugguaccagcagaagccggggcaggcuccccgccuucugaucuauggagccagcaccagagccuccggcauuccugcucgguucucugggagcggauccggcacagacuacacccucacaaucaccagccugcaaucugaggauuuugccguguauuacugucagcauuauuccaauuggcccccucgccuuacauucgggggaggcaccaaaguggaaauuaag

SEQ ID NO: 42992 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaaucugaggauuuugccguguauuacugucagcauuauuccaauuuucccccucgccugacauucgggggaggcaccaaaguggaaauuaag

SEQ ID NO: 42993 - RNA, 327 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuacggagccagcaccagagccuccggcauuccugcucgguucucugggagcggauccggcacagacuacacccugacaaucaccagccuucaaucugaggauuuugccguguauuacugucagcauuauuccaauuaucccccucgccugacauucgggggaggcaccaaaguggaaauuaag

SEQ ID NO: 42994 - RNA, 327 nt, Artificial Sequence
  derived and/or modified sequence opt5 from anti-influenza_Chain
gagaucgugcugacccagagccccgccacacucuccgucucuccuggcgaaagaguuacgcugagcugccgggcuucccaaucuguggccaacaaucuugcgugguaccagcagaagccggggcagagcccccgccugcucauuuauggagcuuccaccagagacacaggcaucccugcccgguucucugggagcggauccggcaccgaguuuacacugaccauuagcucucuucaauccgaagauuucgccguguacuauugucagcaguacaacaauuggcccccuauguauacauuugggcagggaaccaaacuggagaucaag

SEQ ID NO: 42995 - RNA, 327 nt, Artificial Sequence
  derived and/or modified sequence opt5 from anti-influenza_Chain
gacaucgugaugacccagagccccuccacacugucugccagcgucggcgauagaguuacgauuaccugccgggcuucccaaucuaucgggaacuggcucgccugguaccagcagaagccuggaaaagcgccgaagcugcuuauuuauaaagugagcacacuggaguccggcgugcccucucgcuucagcggguccggaagcggcaccgaauuuacacucaccaucaauucucugcagccugacgauuucgcuacauacuauugucaaagauacaccuccaacagccagggguuuacguucggacagggcaccaaacuugagauuaag

SEQ ID NO: 42996 - RNA, 327 nt, Artificial Sequence
  derived and/or modified sequence opt5 from anti-influenza_Chain
gacaucgugaugacccagagccccgccacacuguccgucucuccuggcgagagagcuacgcucagcugccgggccucccaaguuguggggaccaaccuggcgugguaccagcagaagccgggacaggcuccccgccuucugauuuaugccgccucuacaagagcuaccggcaucccugcccgguucagcggguccggauuuggcacagauuucacccucacaauuucuagccugcaauccgaagacuuugcuguguacuauugucagcaguacaauaacuggccccuuagcuucgggggaggcaccaaagucgagauccgcagaacg

SEQ ID NO: 42997 - RNA, 327 nt, Artificial Sequence
  derived and/or modified sequence opt5 from anti-influenza_Chain
gacauccagaugacccaaagccccuccucucugagcgccuccgugggcgauagagucacaauuguuugccgggcuucucaggggaucaacacgcaccuccauugguaccagcagaagccuggaaaagccccgaagcugcuuauuuauagcgcguccacccugcacacaggcgugcccucucgccucagcggguccggaagcggcaccgacuucacacugucuaucuccagccuucaaccugaggauuuugcuaccuacuauugucagcagucuuacaauuaucccagaacauucgggcagggaaccaacguggacauuaaacggacg

SEQ ID NO: 42998 - RNA, 327 nt, Artificial Sequence
  derived and/or modified sequence opt5 from anti-influenza_Chain
gacauccugaugacccagagccccuccucucucagcgccuccgugggcgauagagucacaauuacgugccgggcuucucaagacauccgcaacagacuggccugguaccagcagaagccugggaaagcgccgaagcggcuuauuuaugcugccagcucccugcagucuggaguucccagccgcuucuccggcagcgggucuggaaccgaguuuacacucaccaucaauucccugcaaccugaagauuucgccacauacuauugucuucagcacaacagcuaccccuggaccuuuggcccugggacaaaaguggagauuaagagaacc

SEQ ID NO: 42999 - RNA, 327 nt, Artificial Sequence
  derived and/or modified sequence opt5 from anti-influenza_Chain
gacaucgugaugacccagagccccgccacacuguccgucucuccuggcgagggggcuacgcucagcugcagagccucccaaggaauuggcucuaaccuggcgugguaccagcacaagccggggcaggcuccccggcuucugaucuaugccgccagcacccgcgcuacaggaguuccugccagauucuccggcucugggagcggaaccgaauuuacacucaccauuuccagccugcagucugaggaucuugcuguguacuucugucaacaguauaauacauggccccugaccuuuggcggcgggacgaaaguggaaaucauucggacc

SEQ ID NO: 43000 - RNA, 327 nt, Artificial Sequence
  derived and/or modified sequence opt5 from anti-influenza_Chain
gacaucgugaugacccagagccccuccacacugucugccagcgucggcgauagaguuacgauuaccugccgggcuucccaaacaaucuaccgcuggcucgccugguaucagcagaagccugggaaagcgccgaaggugcugauuuacaaggcuucuacccuugagagcggagugcccuccagauucucuggcagcggguccggaacagaauuuacccuggccaucagcucucuccagccugacgauuucgccacauauuacugucaacaguauaacuccuuucccuaccgguucggccaggggaccaaagucgagauuaaacgcacg

SEQ ID NO: 43001 - RNA, 327 nt, Artificial Sequence
  derived and/or modified sequence opt5 from anti-influenza_Chain
gacaucgugaugacccagagccccuccucucugagcgccuccgucggcgauagaguuucuauuacaugccgggcuagccaaacgaucacccgcuuccucaacugguaccagcagaagccugggaaaggaccgaagcugcuuauuuaugccgcguccacagugcacagaggcgugcccucucgguuuagcggguccggaagcggcaccgacuucacacugaccaucucuucccuccagccugaggauuuugcuacauacuauugucaacagagcuacucugcccccuucaccuuugggccuggaacgaccgucgacauucgcagaaca

SEQ ID NO: 43002 - RNA, 327 nt, Artificial Sequence
  derived and/or modified sequence opt5 from anti-influenza_Chain
gacaucgugaugacccagcccccugccacacugagcgucuccccgggcgagagagcuacgcucucuugcggggccagccaaggacugggcuccaaccuugcgugguaccagcagaagcccgggcaggcuccucggcugcucauuuaugccgccucuacccgcgcuacaggaaucaccgccagauucagcggcuccgggucuggaacagaauuuacccugacaauuaauagccuucaauccgaggauuucgcucuguacuauugucagcaguacaccuauuggccccucacguuuggcggcgggaccaaaguugaaaucaagcggaca

SEQ ID NO: 43003 - RNA, 327 nt, Artificial Sequence
  derived and/or modified sequence opt5 from anti-influenza_Chain
gacaucgugcugacccagagccccgccacacucuccgucucuccuggcgagagagcuacgcugagcugccgggccucccaaucuguuaaccgcaaucuugcgugguuccagcagauuccggggcaggcucccagacugcucaucuuugaugccagcacccgggccgcugacauuccugcccgcuucuccggaggcgggucuggagcugaauuuacacugaccgugagcucccuucaacccgaggauuucgccguguacuauugucagcaguacgacaaguggccucccggcuuugggcagggaacaaaagucgaaaucaagagaacc

SEQ ID NO: 43004 - RNA, 330 nt, Artificial Sequence
  derived and/or modified sequence opt5 from anti-influenza_Chain
cagagcgugcugacccaacccccuuccgccucuggcgcuccggggcagagagucacacucagcugcuccggaucuggcagcaacaucggguccaauacgguuucuugguaccagcagcugcccggaaccgccccuaaacuucugguguucacaaacaaucaacggcccagcggcgugccugaccgcuuuuccgggagcaagucuggaaccuccgcgagccucgcuauuucuggccugcaguccgaggaugaagccgacuauuacugugccgcuugggaugacagccuuaacggccagcuguucgggggaggcacaaagcucaccguccug

SEQ ID NO: 43005 - RNA, 330 nt, Artificial Sequence
  derived and/or modified sequence opt5 from anti-influenza_Chain
cagagcgugcugacccaacccccuuccgucucugccgcuccgggccagagaguuacaaucagcugcuccgggacgucuagcaacauuggaaagaauuacguguccugguaucagcagcuccccggcgccgcgccuaaacugcuuaucuacgacaacgauaagcggcccucugggauuccugaccgcuucagcggauccaaaagcggcaccucugcuacacuggggaucaccggacuccaaacaggcgaugaggccgacuauuacuguggcaccugggauuccagccugucuguggggauguuuggaggcgggacaagacuuaccguccug

SEQ ID NO: 43006 - RNA, 330 nt, Artificial Sequence
  derived and/or modified sequence opt5 from anti-influenza_Chain
gagaccacacugacgcagagccccgccacccucuccgugucuccuggcgaaagagcuacacugagcugccgggccucccaaucugucagccgcaaccuugcgugguaccagcagaagccggggcaggcucccagacugcucaucuauggagccuccucucgggccaccggcauuccugaccgcuucagcggguccggaagcggcacagauuuuacccugacaaucucuagacuugagcccgaagacuucgcuguuuacuauugucaacaguacggguccagcucuauuaccuuuggacagggcacgcggcuggagaucaaacgcaccgug

SEQ ID NO: 43007 - RNA, 330 nt, Artificial Sequence
  derived and/or modified sequence opt5 from anti-influenza_Chain
cagagcgugcugacccaacccccuuccgccucuggcacaccggggcagagagucacgaucagcugcuccggaucuagcuccaacauuggcucuaauaccguuaacugguacaagcagcuccccgggacagcuccucggcugcuuaucuauagcaaugaccagcgccccuccggagugccugauagauucagcggcucuaaguccgggaccagcgccucucuggcgauuuccggacuccaaagcgaggacgaagcuaacuacuauugugccgccugggaugacucucuguccggcuggguguuuggcgggggaacaaaacuuaccguccug

SEQ ID NO: 43008 - RNA, 330 nt, Artificial Sequence
  derived and/or modified sequence opt5 from anti-influenza_Chain
cagagcgcccugacccaacccagauccgugucuggcagcccugggcaguccgucacaaucucuugcacgggaagcuccucugacguuggcgcuagcaacuccgugagcugguaccagcagcacccggggaaggcccccaaacucgugauuuaugaugucaccgagcggccuucuggagugccccaucgcuucuccggcagcaagucugggaauacagcgucccugaccguuagcggacuucaaccugaagacgaggcugauuacuuuuguugcgccuauggcggcaaauaccugguggucuucgggggaggcacaaaggugaccguucuc

SEQ ID NO: 43009 - RNA, 330 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcggguacaacuauguuucuugguaccagcagcacccgggaaaggcccccaaacuccugaucuaugaggugacaaauuggccuagcggcguguccaacagauucagcgggucuaaguccggaaauaccgcgagccuuacaauuucuggccugcaagcugaagaugaggccgacuacuauuguuccagcuacgccgggucuuccaccugggucuuuggcggaggcacacgggugaccguucuc

SEQ ID NO: 43010 - RNA, 330 nt, Artificial Sequence
  derived and/or modified sequence opt5 from anti-influenza_Chain
cagaccguggucacacaagagcccagccugacgguuuccccuggcgggaccgugacacugaccugcgccucuagcacaggagcugugaccuccucuuacuucccgaacugguuucagcagaagcccggccaggccccuagaccccucaucuauagcacaaccauucggcacuccuggacgccugcgcgcuucucugggagccuucugggaggcaaagcugcccucacccuguccgggguccaacccgaagacgaggccgauuacuauugucuucuguacagcggaggcgacccuguggcuuuuggcgggggaacaaagcucaccguucug

SEQ ID NO: 43011 - RNA, 330 nt, Artificial Sequence
  derived and/or modified sequence opt5 from anti-influenza_Chain
cagagcgugcugacccaaucccccucugucagcgccgcuccuggccagaagguuacaaucuccugcucugggagcgacuccaacauuggagauuacuucguguguugguaucagcaccucccgggcaaacccccucagcugcuuaucuacgagaauaacaagagacccucugggauuccugaccgguuuagcggauccaaaagcggcacgucugccacccuggggaucacaggcauucaaaccggagaugaagcggacuauuacugcgcuacaugggauggcucccucagcgccuggguguucgggggaggcaccaagcugacaguccuu

SEQ ID NO: 43012 - RNA, 330 nt, Artificial Sequence
  derived and/or modified sequence opt5 from anti-influenza_Chain
cagagcgcccugacccaacccagauccgugucuggcagcccugggcaguccaucacaauuucuugcacgggaggcagcuccgacaucggggcuucuaacagcgucuccugguaccagcagcacccgggaaaggcccccaaacucguuauuuucgaugugaccgagcggccuagcggcgugccccaucgcuuuucuggguccaagagcggaaauacagcgucucugaccgucuccggccuucaaccugacgaugaagcugacuauuucuguugcgccuacggcgggaaauaucuggugguuuuuggaggcgggacaaaggugaccguccuc

SEQ ID NO: 43013 - RNA, 330 nt, Artificial Sequence
  derived and/or modified sequence opt5 from anti-influenza_Chain
caggccguggucacccaagagcccagccuggcuguuuccccuggcgggacagugacgcugaccugcggaucuagcacaggcgccgugaccagagggcacuacccguauugguuccagcagaagcccggacaggcgccucgggcucucaucuacgacuccgccggcaaccgccauucuuggacacccgccagauuuagcgggucccuucugggaggcaaagcugcccucacccugucuggcgcucaaccugaagaugaggccgaauauuacugucuucugagcuauuccggggucuggguguucggaggcgggacaaagcucaccguucug

SEQ ID NO: 43014 - RNA, 330 nt, Artificial Sequence
  derived and/or modified sequence opt5 from anti-influenza_Chain
gagaucgugaugacccagagccccgccacacuguccgucucuccuggcgaaagaguuacgcucagcugccgggcuucccaaucuauuaccgacgggcuggccugguaccagcaaaagagcggacaggcgccgcgccuucugaucuauggcgcuuccacaagagccaccgggauucccgcccgguucucuggaagcggcuccgggacagaguuuacccucacaaucagcucucugcaguccgaagauuucgcuguguacuauugucagcaguacaacaauuggccucccgugaccuuuggacagggcacgaaagucgagauuaagcgcacc

SEQ ID NO: 43015 - RNA, 330 nt, Artificial Sequence
  derived and/or modified sequence opt5 from anti-influenza_Chain
agcuccgagcugacccagcccccuucugccagcggcacaccggggcaaagagugacgaucuccugcucuggaagcaccuccaacauuggcuacaaucccgucucuugguaucagcagguuccugggacagcucccaagcuccugaucuacagcaacaccgaacggccuuccggagugcccgaccgcuucagcggcucuaaauccgggacaagcgccucucuugcgauuuccggacugcagagcgaggaugaagcugacuauuacugugccgccugggaugacacccucaauggcccuguguuuggcgggggaacaaaggucaccgugcug

SEQ ID NO: 43016 - RNA, 330 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcggguacaacuauguuucuugguaccagcagcacccgggagaggcccccaagcucaugaucagcgauguguccaauagaccuagcggcgugucuaaccgguucuccgggagcaaaucuggaaauacagcgucccugaccauuagcggccuucaagcugaagacgaggccgauuauuacuguacaucuuauaccuccagcaacacacuggucuuuggcgggggaaccaagcucacggugcug

SEQ ID NO: 43017 - RNA, 330 nt, Artificial Sequence
  derived and/or modified sequence opt5 from anti-influenza_Chain
cagagcgugcugacccaacccccuuccgucucugccgcuccgggccagaagguuacaaucagcugcuccgggucuagcuccaacauuggacacaauuucgugucuugguaccagcagcuccccgccacggcgccuaagcugcuuaucuaugacaccgauaagagacccagcggcauuccugaccgguuuuccgggagcaaaucuggaacauccgcuacccugggcaucacagggcuccaaaccggagaugaggccgacuacuauuguggcacaugggauagcucucuguccagcgugauuuucggcgggggaaccaaacuuacgguccug

SEQ ID NO: 43018 - RNA, 330 nt, Artificial Sequence
  derived and/or modified sequence opt5 from anti-influenza_Chain
gacauccagaugacccaaagccccuccacacugucugccagcgugggcgauagagucacgauuaccugccgggcuucccagacaaucaacaauuaccucgccugguaucagcagaagccugggaaagcgccgaagcugcuuauuuacaaggcuucuagccuggaguccggaguucccucucgcuucagcggcuccgggagcggaaccgaauuuacacucaccaucucuucccugcaaccugacgauuucgccacauauuacugucaggaguauaacaaugacagcccccuuaccuuuggcgggggaacgaaaguggaaauuaaaagaacc

SEQ ID NO: 43019 - RNA, 330 nt, Artificial Sequence
  derived and/or modified sequence opt5 from anti-influenza_Chain
gacaucgagcugacccaggaucccagcguguccgucgccccuggccaaacagcucggauuccgugcguuagauucaacauggggcccacgucugugcacugguaccagcagaagccuggacaggcccccgugcucgucguguaugacgauagcgaccgcccuuccggcauccccgaaagauuuucugggagcaauuccggagauucugcgacccugacaauuagccggguugaggcuggcgacgaagccgauuacuauugucaagugugggacauguccagcgaucgcagagucuucgggggaggcaccacacuuaccgugcugggccag

SEQ ID NO: 43020 - RNA, 330 nt, Artificial Sequence
  derived and/or modified sequence opt5 from anti-influenza_Chain
gacaucgugaugacccagagccccggcacacugucccucucuccuggggagagagccacgcuguacugccgggcuagccaauccguccgcucuggauaucuugccugguaccagcacaagccgggccaggcgccccugcuccuguucuaugaugcuagcgggagagccaccggcauuccugaccgguuuuccggaucugggagcggaacagauuucacccuuacaaucucccgccuggaacccgaggacuuugccguuuacuauugucuccaguacggcagcucuccuagaaccuucggccaagggacaaaaguggaaauuaagcggacc

SEQ ID NO: 43021 - RNA, 330 nt, Artificial Sequence
  derived and/or modified sequence opt5 from anti-influenza_Chain
gacaucgugcugacccagagccccuccuuccucucugccagcgucggcgauagaguuacaauuacgugccgggcuucccaacugaucucuagcuacuuugccugguaucagcagaagccugggaaaccgcccaaacuucugauuuacgcggcuuccacccuccagucuggagugccuagccgcuucuccggcagcgggucuggaacacaauuuucccugaccaucagcucucuucagcccgaggacuucgccacauauuacugucagcagcugaacuccuauccucccauuaccuuuggccaagggacaagacucgaaaucaagcggacc

SEQ ID NO: 43022 - RNA, 330 nt, Artificial Sequence
  derived and/or modified sequence opt5 from anti-influenza_Chain
gacaucacccugacacagagccccgccacgcucuccgugucuccuggcgagagagcuacccugagcugccgggccucccaaucugucagcuccaaccuugcgugguaccagcagaagccggggcaggcuccccgccugcucauuuauggagccucuaauagagccacagauaucccugcucgguucagcggcuccgggagcggaaccgaauuuacacugaccauuucuucccuucaaagcgaggacuucgccguuuacuauugucagcaguuuaacgauuggcccuuccugacauuuggcgggggaaccaaaguggaaaucaagcgcacg

SEQ ID NO: 43023 - RNA, 330 nt, Artificial Sequence
  derived and/or modified sequence opt5 from anti-influenza_Chain
gacaucgugaugacccagagccccuccuuccugucugccagcgucggcgauagaguuacaauuacgugccggaccucccaagugaucucuagcuaccucgcuugguaccagcagcgcccugggaaggccccgaaacugcuuauuuacgcggcuuccacacugcagucuggagugcccagcagauuuuccggcagcgggucuggaacccgguucucccucacaaucagcaaccugcaaccugaggacuuugccaccuauuucugucagcagcuuacaaccuaucccccuauuacguuuggccaggggacccgccuggaaaucaagagaaca

SEQ ID NO: 43024 - RNA, 330 nt, Artificial Sequence
  derived and/or modified sequence opt5 from anti-influenza_Chain
gacaucgugcugacccagagccccuccgucucuguugccccuggccaaacagcuagaauuacgugcgggggaaacgauaucggcagcaaguccgugcacugguaccagcagaaaccggggcaggcccccgugcucgucguguucgacgaucgggaccgcccuucuggcauucccgagagauuuagcggauccaauucugggaacaccgcgacacugaccaucagccggguugaagcuggagaugaggccgacuauuacugucaagugugggauauuacauccgaccuugucguguucggcggcgggaccaagcugacaguugugggacag

SEQ ID NO: 43025 - RNA, 330 nt, Artificial Sequence
  derived and/or modified sequence opt5 from anti-influenza_Chain
gacaucgugaugacccagcccccuggcacacugagcgucuccccgggggagagagccacgcucucuugccgggcuagccaauccguuucuaccaaccuggccugguaccagcagaagcccggacaggcgccucgccuucugauucacggcgcuagcacaagagccaccgggauccccgcccgguucuccggaucuggcagcggggcugaauuuacacucaccauuuccagccugcaaucugaggauguggccguguauuacugucagcaguaugacaauuggcuuccuaucacauucggacccggcaccaaagucgauauucagcgcacg

SEQ ID NO: 43026 - RNA, 330 nt, Artificial Sequence
  derived and/or modified sequence opt5 from anti-influenza_Chain
gaccccaugcugacccagacagccagcccuguguccgcugccgucggcgggacgguuaccaucaacugccaagcgucucagagcguguacaauaagaacaaucucgcuugguaucagcagaaacugggacaaccgcccaaacuucugauuuacgccgccuccacacucaccucuggcgugccuagcagauucaagggguccggaucuggcacacaguuuacccugacaaucagcgaucuugagugugacgaugcugccaccuauuacugcgcuggggacuauuccggaggcauuuacgccuucggcgggggaacgaaggucgaaaucaaa

SEQ ID NO: 43027 - RNA, 330 nt, Artificial Sequence
  derived and/or modified sequence opt5 from anti-influenza_Chain
gagcuggugaugacccagacacccgccagcgucuccgcugccguuggcgggacggugaccaucucuugccaaagcuccgaaucuguguacaagaacaauaaccucgcgugguuccagcagaaacugggacagccuccgaaacuucugauuuaugacgcuagcaagcucgccuccggcguccccucuagauuuagcggguccggaagcggcacacaauucacccugacaaucucugaucuugagugugacgaugccgcuaccuacuauugcgccggggacuacuccggaagcaauuaugcuuuuggcggcgggacaaagcuggaaauuaaa

SEQ ID NO: 43028 - RNA, 330 nt, Artificial Sequence
  derived and/or modified sequence opt5 from anti-influenza_Chain
gagcccaugcugacccagacagccagcuccgugucugcugccgucggcgggagcguuacgaucuccugccaaucuagccaguccguggacucuaacaaucagcucagcugguaccagcaaaagccuggacagccgcccaaacugcuuauuuaugcggcuuccacccugacaagcggcgugccuucuagauucaagggguccggaagcggcacccaguuuacacucaccaucucugaucuggaaugugacgaugccgccacauacuauugcgcuggggacuacuccggaggcauuuaugccuucggcgggggaaccgaggucgugguuaaa

SEQ ID NO: 43029 - RNA, 330 nt, Artificial Sequence
  derived and/or modified sequence opt5 from anti-influenza_Chain
gaccccaugcugacccagacagccgcuagcguguccgccgcggucggcgggacgguuaccaucucuugccaaagcuccgagucuguguacaagaacaauaaccucgcuugguuccagcagaaacugggacagccuccgacacuucugauuugggaugccagcaagcucgccuccggcgugcccucuagauuuagcggguccggaagcggcacccaauucacacugaccaucucugaccuugaaugugaugacgcugccacauauuacugcgcuggggauuauuccggagucaauuacgccuuuggcggcgggaccgaggugguugugaaa

SEQ ID NO: 43030 - RNA, 330 nt, Artificial Sequence
  derived and/or modified sequence opt5 from anti-influenza_Chain
gagcuggugaugacccagacacccgccagcgucuccgcugccguuggcgggacggugaccaucucuugccaaagcuccgaaucuguguacaagaacaauaaccucgcgugguuccagcagaaacugggacagccuccgaaacuucugauuuaugacgcuagcaagcucgccuccggcguccccucuagauuuagcggguccggaagcggcacacaauucacccugacaaucucugaucuugagugugacgaugccgcuaccuacuauugcgccggggacuacuccggaagcaauuaugcuuuuggcggcgggacagaagugguugugaag

SEQ ID NO: 43031 - RNA, 330 nt, Artificial Sequence
  derived and/or modified sequence opt5 from anti-influenza_Chain
gaccccaugcugacccagacagccagcuccgugucugcuacggucggcgggaccguuacaaucagcugccaauccucucagagcguggauaacaauaaggaccucgccugguuccagcagaaaccuggacacuccccgaagcugcuuauuuacuuugcgucuagacuggcuagcggcgugcccucccgguucaaagggagcggaucuggcacccauuuuacacucaccaucuccgaucuggagugugacgaugccgccacauauuacugcgcuggggacuauagcggagccaacuacgcuuucggcggcgggaccaaacuugaaauuaag

SEQ ID NO: 43032 - RNA, 330 nt, Artificial Sequence
  derived and/or modified sequence opt5 from anti-influenza_Chain
gaccccaugcugacccagacagccagcccuguguccgcugccgucggcgggacgguuaccaucaacugccaaucuagccaguccguguacaauaacaauagacucucuugguuccagcagaagccgggacaacccccuaaacugcuuauuuauagcgcguccacacuggcuucuggcgugagcucccgguuuaaggggagcggaucuggcacccaguucacacucaccaucuccgaucuggagugugacgaugccgccacauacuauugcgcuggggacuacagcggaggcauuuaugccuuuggcgggggaaccgaacuugagauccug

SEQ ID NO: 43033 - RNA, 330 nt, Artificial Sequence
  derived and/or modified sequence opt5 from anti-influenza_Chain
gagcuggugcucacccagacacccgccagcgucuccgcugccguuggcgggacggugucuaucagcugccaauccucucagagcguguacaagaacaauaaccuggcgugguuccagcagaaacuuggacaaccuccgacccugcucauuugggacgcuuccaagcuggccucuggcguccccagcagauuuuccgggagcggaucuggcacacaguucacccuuacaaucuccgaucuggaaugugacgaugccgcuaccuauuacugcgccggggacuauagcggagugaauuacgcuuuuggcggcgggacaaaacucgagauuaag

SEQ ID NO: 43034 - RNA, 330 nt, Artificial Sequence
  derived and/or modified sequence opt5 from anti-influenza_Chain
gagcuggaccucacccagacacccgccagcguguccgcugccgucggcgggacgguuaccaucucuugccaaagcuccgaaucuguguacaagaacaauaaccuggcgugguuccagcagaaacuuggacagccuccgacacugcucauuugggaugcuagcaagcuggccuccggcgugcccucuagauuuagcggguccggaagcggcacccaauucacacuuaccaucucugaccuggagugugaugacgccgcuacauauuacugcgccggggauuauuccggagucaauuacgcuuuuggcggcgggaccgaagugguugugaaa

SEQ ID NO: 43035 - RNA, 330 nt, Artificial Sequence
  derived and/or modified sequence opt5 from anti-influenza_Chain
gacauccagaugacccaaagccccuccucucugagcgccuccgugggcgauagagucacaauuacgugccagucuagcgaguccguuuacaagaacaauaaccucgcuugguaucagcagaaaccugggaagccgcccaaacugcuuaucugggacgccucuaagcuggcgagcggagugccuucccgguucagcggcucuggguccggaaccgauuuuacacucaccauuagcucucugcaacccgaagacguggcuacauacuauugugccggcgauuacuccggggucaauuaugccuucggaggcggcaccgaggugguugugaaa

SEQ ID NO: 43036 - RNA, 333 nt, Artificial Sequence
  derived and/or modified sequence opt5 from anti-influenza_Chain
gacaucgugaugacccagagccccgauucccuggccgucucucucggcgagagagcuacaauuaacugcaagagcucccaaucuguuacguucaauaacaaaaauuaccuggccugguaucagcagaagccugggcagccgcccaaacuucugaucuacugggcgagcacccgggaauccggagugccugaccgcuuuucuggcagcggguccggaacagauuucacccucacaauuagcucucugcaagcugaggacguggccgucuauuacugucagcagcacuauagaacacccccuaccuuuggccaggggaccaagguggaaaucaaa

SEQ ID NO: 43037 - RNA, 333 nt, Artificial Sequence
  derived and/or modified sequence opt5 from anti-influenza_Chain
cagagcgcccugacccaacccgcuuccgugucuggcagcccugggcaguccaucacaauuucuugcacgggaaccggcagcgacgucggguccucuaaccucguuagcugguaccagcagcacccggccaaggcgcccaaacugaucauuuaugaggugacaaagagaccuuccggagugagcaaucgguucucuggcuccaaaagcgggaacaccgcuucucuuacaaucuccggacugcaagccgaagaugaggccgacuacuauuguugcagcuacgcugggucuuccagcucccgcgucuuuggcaccggcacaaaggugaccguucuc

SEQ ID NO: 43038 - RNA, 333 nt, Artificial Sequence
  derived and/or modified sequence opt5 from anti-influenza_Chain
cagagcgugcugacccaacccccuuccgccucuggcacaccggggcagagagucacgaucagcugcuccggaucuaccagcaacauuggcuccaaugcuguuaacugguaccagcagcuccccgggacagccccuaagcugcuuaucuauucuaauaaccaacggcccagcggagugccugaccgcuucuccggcagcaagucugggaccuccgcgagccuggcuauuucuggacuccaguccgaggaugaagccgacuacuauugugccgcuugggaugacagccugucuggcuccuggguguuuggcgggggaacaaaacuuaccguccug

SEQ ID NO: 43039 - RNA, 333 nt, Artificial Sequence
  derived and/or modified sequence opt5 from anti-influenza_Chain
gagaccacacugacgcagagccccggcacccucucccugucuccuggggaaagagccacacuuagcugccgggugucccaaucugucagcuccaacuaccuggcuugguaucagcagaagccgggacaggcgccccgccuccugaucuacggcgccucuagcagagcuaccgggauuccugaccgguucuccggaagcggcucugggacagauuuuacccuuacaaucucccgccuggagcccgaagacuucgccguuuauuacugucaacaguauggaaccagcccuagagccuuuggccacggcacgaaaguggagauuaagcggaccgug

SEQ ID NO: 43040 - RNA, 333 nt, Artificial Sequence
  derived and/or modified sequence opt5 from anti-influenza_Chain
cagagcgugcugacccaacccccuuccgucucuggcgccccggggcagagaguuacaaucagcugcggaggcucccggucuaacauuggggcuggauacgacgugcacugguaucagcaguuccccggcacggccccuaagguggucaucuacgggaauaacaaucgccccagcggagugccugauagauuuuccggcucuaaaagcggcaccuccgcgagccucgcuauuacagggcugcaagccgaggacgaagccaacuauuacugucagucuuaugauaccaaucuuggaggcuccaucuucgggggaggcacacagguuaccgugcug

SEQ ID NO: 43041 - RNA, 333 nt, Artificial Sequence
  derived and/or modified sequence opt5 from anti-influenza_Chain
aacuucaugcugacccagccccacagcguguccgagucuccuggcaagacagucacgaucagcugcaccggguccucuggaagcauugccuccaauuacguucaaugguaucagcagagaccgggcucugcucccacaaccgugaucuacgaagacuaucagcggccuagcggggugcccgaucgcuuuuccggaagcauugacucuuccagcaacucugccucccucacaaucagcggccugaaaaccgaggaugaagcggacuacuauugucaaucuuacgaugacuccgaucaucuuauuuucgggggaggcacaaagcugaccguccuc

SEQ ID NO: 43042 - RNA, 333 nt, Artificial Sequence
  derived and/or modified sequence opt5 from anti-influenza_Chain
cagagcaugcugacccaacccccuuccgccucuggcacaccggggcagagagugacgaucagcugcuccggaucuagcuccaacauuggcucuaauaccgucaacugguucaagcaccuccccgggacagcuccuaaacugcuuaucuaccggaaugaccugcgccccagcggaguuccugauagauuuuccggcagcaagucugggaccuccgccagccucgcgauuucuggacugcaguccgaggacgaagcugauuauuacugugccacaugggacgauagccuuaacggcuucuauguguuuggcaccgggacaaaagugaccguccug

SEQ ID NO: 43043 - RNA, 333 nt, Artificial Sequence
  derived and/or modified sequence opt5 from anti-influenza_Chain
gacauccagcugacccaaagccccuccucucucagcgccuccgcuggcgauagagugucuaugacaugccgggccagccagauuaucuccucuagccugaacugguaccagcagaagccugggaaagcgccgaaacuucugauuuaugcugccuccaaucuccaaagcggaguccccucucgcuucuccggcagcgggucuggaacggacuuuacccugacaaucuccagccuucagccugaggauuucgccaccuacuauugucagcagucuuacuccacacccccugaacugaccuuuggcgggggaacaaagguugacauuaagagaacc

SEQ ID NO: 43044 - RNA, 333 nt, Artificial Sequence
  derived and/or modified sequence opt5 from anti-influenza_Chain
agcuacgugcugacccagcccccuuccgccucuggcacaccggggcaaagagucacgaucagcugcuccggaucuaccuucaacauuggcagcaaugcuguugacugguaucggcagcuccccgggacagccccuaagcugcuuaucuacuccaacaaucagcgccccucuggagugccugauagauuuagcggcucccggagcgggaccucugcgucccuggcuauuagcggacuccagucugaggacgaagccgauuauuacugugccgcuugggacgauauccugaacgugcccgucuucggcggcgggacaaaacuuaccgugcuggga

SEQ ID NO: 43045 - RNA, 333 nt, Artificial Sequence
  derived and/or modified sequence opt5 from anti-influenza_Chain
cagagcgcccugacccaacccgcugccguguccggcucuccugggcagagcaucacaauuuccugcacgggaaccucuagcgacgucggcggguacaacuauguuuccugguaccagcagcacccgggaaaggcgcccaaacucaugaucuaugaggugucuaauagaccuagcggcguguccaaccgguucagcgggucuaaguccggaaauacagcuagccugaccauuucuggccuucaagccgaagaugaggccgacuacuauuguuccagcuacacaucuuccagcaccuaugucuuuggcacagggaccaaagugacgguucuggga

SEQ ID NO: 43046 - RNA, 333 nt, Artificial Sequence
  derived and/or modified sequence opt5 from anti-influenza_Chain
agcuacgugcugacccagcccccuuccgucucuggcacaccggggcaaagaguuacgaucagcugcuccggaucucggagcaacgugggcgacaauuccguguauugguaccagcacguccccgagauggccccuaagcuccugguguauaaaaacacccagcgccccucugggguuccugcuagauucagcggauccaagagcggcacaucugccucccuugcgauuaucgggcugcagagcggagaugaagcugacuacuauuguguggccugggaugacucugucgauggcuacguguuuggcuccgggaccaaaguuacagugcucgga

SEQ ID NO: 43047 - RNA, 333 nt, Artificial Sequence
  derived and/or modified sequence opt5 from anti-influenza_Chain
agcgugcugacccagcccccuuccgucucugccgcuccgggccaaaagguuacaaucagcugcuccgggucuagcuccaacauuggaaaugacuacgugucuugguaucagcagcuccccggcacggccccuaaacugcuuaucuacgauaacaauaagagacccagcgggauuccugaccgguucuccggaagcaaaucuggcaccuccgcgacacuggggaucaccggacuccagacaggcgaugaggcuaacuauuacugugccaccugggaccgcagacccacagccuauguggucuuuggcgggggaaccaagcugacggugcuuggc

SEQ ID NO: 43048 - RNA, 333 nt, Artificial Sequence
  derived and/or modified sequence opt5 from anti-influenza_Chain
cagagcgcccugacccaacccagauccgugucuggcagcccugggcaguccgucacaaucucuugcacgggaaccagcuccgacguuggcggguacaacuaugugucuugguaccagcagcacccgggaaaggcucccaaacucaugauuuaugaugugagcaagcggccuuccggcguccccgaccgcuucagcgggucuaaauccggaaauacagccagccugaccaucucuggccuucaagcggaggaugaagcugacuacuauuguuccagcuacacaucuuccagcacccauguguuuggcacagggaccaagguuacggugcuggga

SEQ ID NO: 43049 - RNA, 333 nt, Artificial Sequence
  derived and/or modified sequence opt5 from anti-influenza_Chain
agcuacgugcugacccagcccccuuccgccucuggcacaccggggcaaagagucacgaucagcugcuccggaucuagcuccaacauuggcucuaauuauguuuacugguaucagcagcuccccgggaccgcuccuaagcugcuuaucuaccgggacggacagcgccccagcggcgugccugauagauucuccgggagcaagucuggaacauccgccagccuggcgauuucuggccuccgguccgacgaugaggcugacuauuacugugccaccugggaugacaaccugagcggccccguguuugggggaggcacaaaacuuaccguccugggg

SEQ ID NO: 43050 - RNA, 333 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcggguacaacuauguuucuugguaccagcagcacccgggaaaggcccccaaacucaugaucuaugaggugagcaauagaccuuccggcgugagcaaccgguucucuggguccaagagcggaaauacagcgucucugaccauuuccggccuucaagcugaagaugaggccgacuacuauuguagcucuuacacauccagcuccacccuggucuuuggcacagggaccaaagugacgguucucgga

SEQ ID NO: 43051 - RNA, 333 nt, Artificial Sequence
  derived and/or modified sequence opt5 from anti-influenza_Chain
accgugcugacacagcccccuagcgucuccggcgccccggggcaaagaguuacgaucucuugcaccggaagcuccucuaacauuggcgcuggguacgacgugcacugguaucagcagcuccccggaacagccccuaagcugcuuaucuacggcaauagcaaccggcccuccggggugccugaucgcuucucuggaagcaaauccggcaccagcgcgacacugggcauuaccgggcuccagacaggagacgaggcugauuauuacuguggcaccugggacucuucccugagcgccuaugucuuugggacgggaaccaaggugacaguucuuggc

SEQ ID NO: 43052 - RNA, 333 nt, Artificial Sequence
  derived and/or modified sequence opt5 from anti-influenza_Chain
ggcagcgcccugacccagcccagauccgugucugggagcccuggacaauccgucacaaucucuugcacgggcaccagcuccgacguugggggauacaacuaugugucuugguaccagcagcacccgggcaaggcucccaaacucaugauuuaugaugugagcaagcggccuuccgggguccccgaccgcuucagcggaucuaaauccggcaauacagccagccugaccaucucuggccuucaggcggaggaugaagcugacuacuauuguuccagcuacacaucuuccagcacccauguguuugggacaggaaccaagguuacggugcugggc

SEQ ID NO: 43053 - RNA, 333 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuucggcgcuagcaccagagccacagggaucccugaccgguuuuccggaagcggcucugggaccgauuucacacuuaccauuucccgccuggagcccgaagacuuugccguuuucuacugucaacaguauggaagccucccucugacauuuggcggcgggaccaaaguggagaucaagggaacggug

SEQ ID NO: 43054 - RNA, 333 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucuguccgcagcaacaaucuggccugguaccagcacaagccgggacaggcgcccagacuccugauuuucggcgcuuccucucgggccaccgggaucccugaccgcuuuagcggauccggcagcgggacagauuucacccuuacaauuucuagacuggagcccgaagacuuugccguuuauuacugucagcaauauggauccagcccugcucucaccuucggcggcgggacaaaaguggagaucaagcggacc

SEQ ID NO: 43055 - RNA, 333 nt, Artificial Sequence
  derived and/or modified sequence opt5 from anti-influenza_Chain
cagagccuggaggaauccggcgggggacucgugaagcccggcgggucucugacccuuacaugcacggucagcggacugucccucuacucuaacgagaucaauuggguuagacaagccccuggcaacgggcuggaauggauuggagcuaucgccggcagcggcuccgcggacuaugcuucuugggccaaagggcggagcaccauuacacgcaauaccgaucuuaacacagugacccugaagaugacaucccucaccgccgcugacacggccaccuacuucugugcuagcuuuugggaucuguggggaccgggcacacuggugaccgucucuucc

SEQ ID NO: 43056 - RNA, 333 nt, Artificial Sequence
  derived and/or modified sequence opt5 from anti-influenza_Chain
cagagcguggaggaauccggcgggggacuggucaagcccggcgggucucucacccugacaugcacgguuagcggacuuucccuguacucuaacgagaucaauugggugagacaagccccuggcaacgggcucgaauggauuggagcuaucgccggcagcggcuccgcggacuaugcuucuugggccaaaagccgguccaccauuacacgcaauaccaaccugaauacagugacccuuaagaugacaagccugaccgccgcugauacggccaccuacuucugugcuucuuuuugggaccucugggggccgggaacacuggucaccguguccagc

SEQ ID NO: 43057 - RNA, 333 nt, Artificial Sequence
  derived and/or modified sequence opt5 from anti-influenza_Chain
cagagccuggaggaauccggcgggggacucgugaagcccggcgggucucugacccuuacaugcacggucagcggacugucccucuacucuaacgagaucaauuggguuagacaagccccuggcaacgggcuggaauggauuggagcuaucgccggcagcggcuccgcggacuaugcuucuugggccaaaagccgguccaccauuacacgcaauaccaaccuuaauacagugacccugaagaugacaagccucaccgccgcugauacggccaccuacuucugugcuucuuuuugggaccugugggggccgggaacacuggugaccgucuccagc

SEQ ID NO: 43058 - RNA, 333 nt, Artificial Sequence
  derived and/or modified sequence opt5 from anti-influenza_Chain
aacaucgugcugacccagagccccgccucccucgcugucucucugggccaaagagccacaauuagcugccgggcguccgagucuguugacaucuacgggaauagcuucaugcacugguaucagcagaagccuggacagccgcccaaacuucugauuuaccucgcuuccaagcuggaauguggcgugugcgcccgcuuuaacgggucuggauguagaacggauuucacccuugccaucgacccuguggagggcgaugacggggcuacauauuacugccaacagaauuaugaagaucccuggaccuuuggaggcggcacaaaacuggagauuaag

SEQ ID NO: 43059 - RNA, 333 nt, Artificial Sequence
  derived and/or modified sequence opt5 from anti-influenza_Chain
aacaucgugcugacccagagccccgccucccucgcugucucuccuggccaaagagccacaauuagcugccgggcguccgagucuaucgacauuuacgggaauagcuucaugcacugguaucagaagaaaccgggacagcccccuaagcugcuuaucuaccgcgcuuccaaccuggaaucuggcguucccgccagauuuaaugggagcggaucccggacggauuucacccucacaauugacccuguggagggcgaugacggggccaccuauuacugucagcaaaacuaugaagaucccuggacauuuggaggcggcaccaaacuggagaucaag

SEQ ID NO: 43060 - RNA, 333 nt, Artificial Sequence
  derived and/or modified sequence opt5 from anti-influenza_Chain
gagaucgugcugacccagagccccgccacacucucccuguacccuggcgaaagagcuacgcuuucuugccgggccagccaauccgucucucgcuaucuggcgugguaccagcagaagccggggcaggcucccagacuccugauuuaugacgccagcaaccgggccaccggaaucccugcucgcuucuccggcucugggagcggaacagauuuuacccuuacaauuuccagccuggagcccgaagacuucgccguuuacuauugucaacagagaucuaauuggcucaaaaucaccuuuggccaggggacacggcuggagauuaagggaaccgug

SEQ ID NO: 43061 - RNA, 336 nt, Artificial Sequence
  derived and/or modified sequence opt5 from anti-influenza_Chain
gacaucgugaugacccagagccccgauucccuggccgucucucucggcgagagagcuacaauuaacugcaagagcucccaaucuguucuguacagcuccaauaacaaaaauuaucuugccugguaccagcagaagccugggcagccgcccaaacugcucaucgacugggcgucuacgcgggaaagcggagugccugaucgcuucuccggcagcgggucuggaaccgacuuuacacugaccauuuccaaccuucaaguggaggaugucgcuguguauuacugucagcaguauuacagaagccccucuuucggccaggggacaaagcuggaaaucaaa

SEQ ID NO: 43062 - RNA, 336 nt, Artificial Sequence
  derived and/or modified sequence opt5 from anti-influenza_Chain
gacaucgugaugacccagacaccccugagccucuccgucacgccuggccaaccggccucuauuagcugcaaguccucucagagccugcuucacuccgaugggaaaaccuaccuguauugguaccuccagaagcccggacagucuccucaacugcuuaucuaugagguuagcaacagauucuccggcgugcccgaccgguuuagcgggucuggauccggcacagauuucacccugaaaauuagccgcguggaagcugaggacgucgggguguacuauuguaugcagaauauccuccugccucugacauuuggaggcggcaccaagguugaaauuaaa

SEQ ID NO: 43063 - RNA, 336 nt, Artificial Sequence
  derived and/or modified sequence opt5 from anti-influenza_Chain
gagaucgugaugacccagacaccccugagccucuccgucacgccuggccaaccggccucuauuagcugcagauccucucagagccugcuucacuccgacgggaagaccuaccuguauugguaccuccagaaacccggacagccuccccaacugcuuaucucugaaguuuucaaccgguuuagcggcgugccugaucgcuucuccgggagcggaucuggcacagacuuuacccugaagauuuccagaguggaggcugaagaugucgggguguauuacuguaugcagagccuccagcugccccugacauucggaggcggcaccaaaguugagaucaag

SEQ ID NO: 43064 - RNA, 336 nt, Artificial Sequence
  derived and/or modified sequence opt5 from anti-influenza_Chain
gacaucgugaugacccagagcccccugucccucccugucacaccgggcgagcccgccucuauuagcugcagagcuucccaaucucugcuucacagcaacggguacaauuaucuggauugguaccuccagaagccuggacagucuccccagcugcuuauccaacugggcuccacgcgggccagcgggguuccugaccgcuucuccggaagcggcucugggaccgauuuuacacucgaaauuuccagaguggaggcggaagacgugggagucuauuacuguaugcaggcucugcagcugccccucgccuucggccagggcacccggcuggagaucaaa

SEQ ID NO: 43065 - RNA, 336 nt, Artificial Sequence
  derived and/or modified sequence opt5 from anti-influenza_Chain
gacaucgugaugacccagagcccccugucccucccugucucuccgggcgagcccgccagcauuuccugcagaucuagccaaucccugcuucacgggaacggauacaauuaucuggauugguaccuccagaagccuggccagucuccccggcugcuuaucuaucuggggagcaaccgcgcuuccggaguuccugacagauucagcggcucuggguccggaacagauuuuacgcucaaaauuagccggguggaagccgaggacgugggcgucuacuauuguaugcaggcgcugcaaacaccccugaccuucggcgggggaaccaagguggaaaucaaa

SEQ ID NO: 43066 - RNA, 336 nt, Artificial Sequence
  derived and/or modified sequence opt5 from anti-influenza_Chain
cagagcgugcugacccaacccccuuccgucucuggcgccccggggcagagaguuacaaucagcugcacgggauccucuagcaacauuggcgcuggguacgacgugcacugguaucagcagcuccccggaaccgccccuaagcugcuuaucuacgauaauaacaaucggcccuccggcgugccugaccgcuucucugggagcaaauccggagcgagcgcuucucuggccauuacaggccuccaagccgaggaugaagcucauuauuacugucaguccuaugacaacagccugucuggcuccgucuuugggggaggcacccagcuuacagugcugagc

SEQ ID NO: 43067 - RNA, 336 nt, Artificial Sequence
  derived and/or modified sequence opt5 from anti-influenza_Chain
cagagcgugcugacccaacccccuuccgucucuggcgccccggggcagagaguuacaaucagcugcacgggauccucuagcaacauuggcuccgacuacgaugugcacugguauaagcagcuccccgggaccgcuccuaaacugcuuaucuucggaaauucuaaccggcccagcggcgugccugaccgcuuuuccgggagcaagucuggaacauccgccagccuggcgauuaccggccuccaggcugaggaugaagccgacuacuauugucaaucuuacgauuccagccugucuggcuuccaugucuuuggguccggaacaaaagugaccguucuu

SEQ ID NO: 43068 - RNA, 336 nt, Artificial Sequence
  derived and/or modified sequence opt5 from anti-influenza_Chain
cagagcgugcugacccaacccccuuccgucucugccgcuccgggccagaagguuacaaucagcugcuccgggucuagcuccaacauuggaaaugacuacgugucuugguaucagcagcuccccggcacggccccuaaacugcuuaucuacgauaacaauaagagacccagcgggauuccugaccgguucuccggaagcaaaucuggcaccuccgcgacacuggggaucaccggacuccaaacaggcgaugaggcuaacuauuacugugccaccugggaccgcagacccacagccuauguggucuuuggcgggggaaccaagcugacggugcuuggc

SEQ ID NO: 43069 - RNA, 336 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcaccagagccacagggaucccugaccgguucuccggacgcggcagcgggaccgauuuuacacuuaccauuucuucccuggagcccgaagacuucgccguuuauuacugucaaaacuauggaagcccuuuucucuucacauuuggccccggcaccaaaguggauaucaagagaacggug

SEQ ID NO: 43070 - RNA, 336 nt, Artificial Sequence
  derived and/or modified sequence opt5 from anti-influenza_Chain
gacauccagcugacccaaagcccccucuccccuccggugacacugggccagcccgccucuauuagcugcagauccucucagagccuucuguacacggauggguucaccuaucucuccugguaccaccagcggccuggacaaucuccccgcagacugaucuauaagauuagcaaccgggacuccggcgucccugaucgcuuuagcgggucuggauccggcacagacuucacccuuaaaaucagcagaguugaggcugaagauguggggguguacuauuguaugcaggccacacauuggccccugaccuuuggagagggcacaaaggucgaaauuaaa

SEQ ID NO: 43071 - RNA, 336 nt, Artificial Sequence
  derived and/or modified sequence opt5 from anti-influenza_Chain
gacaucgagcugacccaggaacccagcgccuccggcacaccugggcaaagagugacgauuucuugcagcggagauaccuccaacaucggcucuaauacagucagcugguuccagcuccugccggggaccgcucccaaacuucugauuuuuacagacaaccagcggccuuccggaguucccggccgcuucucugggagcaaguccggaaccagcgccucucucgcgaucuccggccugcagagcgaggaugaaacagacuacuauugugcugccugggaugacucucuuaauggcuggguguuugggggaggcaccaagcugacggugcucgggcaa

SEQ ID NO: 43072 - RNA, 336 nt, Artificial Sequence
  derived and/or modified sequence opt5 from anti-influenza_Chain
gacaucgugcugacccagagccccuccgccucuggcagcccugggcaauccgucacaauuucuugcacgggaaccagcuccgauguuggcggguacgacuaugugucuugguaccagcagcacccgggaaaggcucccaaacucaugaucuaugaggugagaaagcggccuagcggcguccccgaucgcuucuccgggagcaaaucuggaaacacagccucccugaccgugagcggccuucaggcggaagacgaggcuuacuauuacugugccucuuaugccggcacauacauucaucuguuugggggaggcaccaagcucacaguucuggggcaa

SEQ ID NO: 43073 - RNA, 336 nt, Artificial Sequence
  derived and/or modified sequence opt5 from anti-influenza_Chain
caggagcaacugauggaaagcggcgggggacucgugaagcccggcgggucccugacccuuacaugcacggucucuggacugagccucuacuccaacgagaucaauuggguuagacaggccccuggcaacgggcuggaauggauuggagcuaucgccggcucuggcagcgcggacuaugcuuccugggccaaaucucggagcaccauuacacgcaauaccaaccuuaauacagugacccugaagaugacaucccucaccgccgcugauacggccaccuacuucugugcuagcuuuugggaccugugggggccgggaacacuggugaccgucucuucc

SEQ ID NO: 43074 - RNA, 336 nt, Artificial Sequence
  derived and/or modified sequence opt5 from anti-influenza_Chain
cagcaacagcugauggagagcggcgggggacucgugaagcccggcgggucccugacccuuacaugcacggucucuggacugagccucuacuccaacgaaaucaauuggguuagacaggccccuggcaacgggcuggaguggauuggagcuaucgccggcucuggcagcgcggacuaugcuuccugggccaaaucucggagcaccauuacacgcaauaccgaucuuaacacagugacccugaagaugacaucccucaccgccgcugacacggccaccuacuucugugcuagcuuuugggaucugugggggccgggaacacuggugaccgucucuucc

SEQ ID NO: 43075 - RNA, 336 nt, Artificial Sequence
  derived and/or modified sequence opt5 from anti-influenza_Chain
cagcaacagcugguggagagcggcgggggacucgucaagcccggcgggucccugacccuuacaugcagaguuucuggacugagccucuucuccaacgaaaucaauugggugcggcaggccccuggcaacgggcuggaguggauuggagcuaucggcggcgggggaucugccgacuacgcgagcugggcuaaaucccgcucuacgauuaccagaaauacaaaccuuaauaccgugacacugcggaugaccagccucacagccgccgauaccgcugccuauuuuugugcuuccuucugggaccuguggggcccggggacgcuggucaccgugagcucu

SEQ ID NO: 43076 - RNA, 336 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggacugucccucuucucuaacgagaucaauugggugcggcaagccccuggcaaagggcuggaauggauuggagcgaucggcggcgggggaagcgcugacuacgccuccugggccaagucucgcuuuaccauuagcagagauaacgcuaaaaauucccuuuaucugcagaugaacagccuccgggccgaggacacagcuguguacuucugugccucuuuuugggaucuguggggcccggggacgcuggucaccguguccagc

SEQ ID NO: 43077 - RNA, 336 nt, Artificial Sequence
  derived and/or modified sequence opt5 from anti-influenza_Chain
gacaucgugaugacccagagcccccugucccucccugucacaccgggcgagcccgccucuauuagcugcagauccucucaaagccugcuucgguccaacggguacaauuaucuggauugguaccuccagaagccuggacagucuccccagcugcuuaucuaucugggcagcaaccgcgcuuccgggguuccugacagauucagcggaucuggcuccgggacggauuuuacccucaaaauuagccggguggaagccgaggacgugggagucuacuauuguaugcaagcgcugcagacacccuacaccuucggccagggcacaaagcuggaaaucaaa

SEQ ID NO: 43078 - RNA, 339 nt, Artificial Sequence
  derived and/or modified sequence opt5 from anti-influenza_Chain
gacaucgugaugacccagagccccgauuuccugccugucucccucggcgagagagccacaauuaacugcaagucuagccaacggguucuguacuccucuaauaacaaaaauuaucuugcuugguaccagcugaagccggggcagcccccuaaacucaucauuuauugggccagcacgcgcgaauccggagugcccgacagauuuucuggcagcggguccggaaccgaguucacacugaccaucagcucucuucaggcggaagauguggcugucuacuauugucaacaguacuauucccggccuuacacauuuggccaggggaccaagcuggagauuaaa

SEQ ID NO: 43079 - RNA, 339 nt, Artificial Sequence
  derived and/or modified sequence opt5 from anti-influenza_Chain
gacaucgugaugacccagagccccgauucccuggccgucucucucggcgagagagcuacaauuaacugcaagagcucccaaucuguucuguacagcuccaauaacaaaaauuaucuugccugguaccagcagaagccugggcagccgcccaaacugcucaucuauugggcgucuacgcgggaaagcggagugccugaccgcauuuccggcagcgggucuggagcugauuucacccugacaaucuccagccuucaagccgaggacguggccgucuacuauugucagcaguacuuugcuacccccagaacauucggccaggggaccaagguggaaauuaaa

SEQ ID NO: 43080 - RNA, 339 nt, Artificial Sequence
  derived and/or modified sequence opt5 from anti-influenza_Chain
gacaucgugaugacccagucccccgauucccuggccgucucucucggcgagagagcuacaauuaacugcaagagcucccaaucuguucuguacagcuccaauaacaaaucucaccuugccugguaucagcagaagccugggcagccgcccaaacugcucaucuacugggcgagcacgcgggaauccggagugccugaccgcuucagcggcucuggguccggaaccgauuuuacacugauuaucagcucucuucaagcugaggacguggccgucuauuacugucagcaguauuacuucagcccccugaccuuuggcgggggaacaaagguggaaauuaaa

SEQ ID NO: 43081 - RNA, 339 nt, Artificial Sequence
  derived and/or modified sequence opt5 from anti-influenza_Chain
gacaucgugaugacccagagccccgauucccuggccgucucucucggcgagagagccacaauuaacugccggagcucccaaucuaucuuccacaauagcaacaaugaaaacuaccuggccugguaucagcagaagccugggcagccgcccaaacuucugauuuacugggcguccacgcgcgagucuggaguuccugacagauuuagcggcuccgggagcggaaccgauuucacacucaccaucucuucccugcaagcugaagacguggccguguauuuuugucagcaguacuauaaugcuccccuuacauucggcgggggaaccaaggucgagauuaaa

SEQ ID NO: 43082 - RNA, 339 nt, Artificial Sequence
  derived and/or modified sequence opt5 from anti-influenza_Chain
gagaucgugcugacccagagcccccucucccugccugucacaccgggcgaacccgccucuauuagcugcagauccucucaaagccuucugcacuccaacggguacaauuaucucgacugguaccugcagaagccuggacagucuccccagcuucugaucuaucucggcagcaaccgggcuuccgggguuccugaucgcuucagcggaucuggcuccgggacggacuuuacccugaaaauuagcagaguggaggccgaagaugugggagucuacuauuguaugcaagcgcugcagacaccccucaccuucggcggcgggacaaagguggagaucaaacgg

SEQ ID NO: 43083 - RNA, 339 nt, Artificial Sequence
  derived and/or modified sequence opt5 from anti-influenza_Chain
gacaucgugcugacccagcccccuagcgucuccguugccccgggccaaacagcuacgauuaccugcgggggaaacuacaucggcucuaagagcgugaauugguaucagcagagacccgggcacgccccugugcucgucguguacgaugacuccgaucggcccucuggcauuccugaccgcuucagcggauccaacucuagaagcacagcgaccacagcuacccugacaaucucccggguugaggccggggaugaagccgacuauuacugucaggugugggagaccagcgaagaucuuugggucuuuggaggcggcacgaaacugaccgugcucgggcaa

SEQ ID NO: 43084 - RNA, 342 nt, Artificial Sequence
  derived and/or modified sequence opt5 from anti-influenza_Chain
gacguggucaugacccagagccccgauucccuggccguuucucucggcgagagagcuacaaucaacugcaagagcucccaaucugugcuguacagcuccaauaacaaaaauuaucuugccugguaccagcagaagccugggcagccgcccaaacugcucauuuauugggcgucuacgcgggaaagcggagugccugaccgcuucuccggcagcgggucuggaaccgauuuuacacugaccaucuccagccuucaagcugaggacgucgccguguacuauugucagcaguacuauucuacaccccugaccuucggcgggggaacaaagguugauauuaaaaga

SEQ ID NO: 43085 - RNA, 342 nt, Artificial Sequence
  derived and/or modified sequence opt5 from anti-influenza_Chain
gacauccagaugacccaaagccccgauucccuggccgugucucucggcgagaaggcuacaauuaacugcaaaagcucccagucuauccugaauagcuccaacaauaagaacuaccuugccugguaucagcagaaaccugggcaaccgcccaagcugcucauuuacugggcgucuacgagagaaagcggagucccugaccgguucuccggcagcgggucuggaaccgauuuuacacugaccaucuccagccuucaggcugaggacguugccguguauuacugucagcaguauuacucuuccccucccacauucggccaagggaccaaaguggaaauuaagcgc

SEQ ID NO: 43086 - RNA, 342 nt, Artificial Sequence
  derived and/or modified sequence opt5 from anti-influenza_Chain
gagaucgugcugacccagagccccgccacacucucccuguacccuggcgaaagagcuacgcuuucuugccgggccagccaauccgucucucgcuaucuggcgugguaccagcagaagccggggcaggcucccagacuccugauuuaugacgccagcaaccgggccaccggaaucccugcucgcuucuccggcucugggagcggaacagauuuuacccuuacaauuuccagccuggagcccgaagacuucgccguuuacuauuguugcgauagacaacagcggucuaauuggcucaaaaucaccuuuggccaggggacacgccuggagauuaagggaaccgug

SEQ ID NO: 43087 - RNA, 342 nt, Artificial Sequence
  derived and/or modified sequence opt5 from anti-influenza_Chain
gacaucgugaugacccagagccaaaaguucgucuccacaucuguuggcgauagagugagcgugacgugcaaagccucccagaacgucgggucuaauguggcuugguaccagcacaagcccggacauagcccuaccgcccugauuuauuccgcgucucaccgguacagcggcguuccggaccgcuuuacaggguccgagagcggaaccgauuucacacucaccaucucuaacgugcaguccgaagaccuggcugaguauuuuugucaacaguacuauagcuaccccuauacauucggcgggggaaccaaacuugaaauuaagagagccgaugccgcuccuacg

SEQ ID NO: 43088 - RNA, 342 nt, Artificial Sequence
  derived and/or modified sequence opt5 from anti-influenza_Chain
gacaucgagaugacccagagcccccugucccucccugugacaccgggcgaaucugccagcauuuccugcagaucuagccaaucccugcuucacucuaacggguacaauuaucuggauugguaccuccagaagcccggacagagcccucagcugcuuaucuaucugggcuccagccgggcuucugggguccccgaccgcuucuccggaagcggcucugggacggauuuuacccucaaaauuuccagaguugaggccgaagacgugggaguguacuauuguaugcaaggccugcagacaccuuacaccuucggccaggggacaaagcuggagaucaaacggacc

SEQ ID NO: 43089 - RNA, 342 nt, Artificial Sequence
  derived and/or modified sequence opt5 from anti-influenza_Chain
gacaucgagaugacccagagcccccugucccucccugugacaccgggcgaacccgccucuauuagcugcagauccucucaaagccugcuucacuccaacggguacaaucaccuggcuugguaucuccagaagccuggacggucuccccaucugcuuaucuaccuggccagcacgcgcgcguccggcgucccugauagauucagcgggucuggauccggcaccgacuuuacacucaaaauuagccggguugaggcugaagauguggggaucuauuacuguaugcagucucugcagaccuccauuacauucggacaaggcacccgccuggagaucaagagaaca

SEQ ID NO: 43090 - RNA, 345 nt, Artificial Sequence
  derived and/or modified sequence opt5 from anti-influenza_Chain
caggugcaacugguccagagcggcgccgagguuaagaaacccggguccucugugagagugagcugcaagaccuccggaggcacauucucuagcuacgcugucacgugggugcggcaggccccugggcagggacucgaauggaugggcgggaucauuggaauguuuggcaccacaaacuaugcgcaaaaauuccagggccgccugaccaucacagcugacgagaugaccuccacagccuacauggaacuuucuagccugagauccgaggauaccgccguuuauuacugugcucgggggagcuauuacuaugaaacgacccucgacuacuggggacgcggcacacug

SEQ ID NO: 43091 - RNA, 345 nt, Artificial Sequence
  derived and/or modified sequence opt5 from anti-influenza_Chain
gaggugcagcugguccaaagcggcgccgaaguuaagaaacccggguccucugugaaggugagcugcaaaaccuccggaggcacauucucuagcuacgcugucacgugggugagacaggccccugggcagggacucgaguggaugggcgcgaucauugggauguuuggaaccacaaacuaugcucagaaguuccaaggccggguuaccaucacagccgacgaacugaccuccacagccuacauggagcuuucuagccugcgcuccgaugacaccgcuguguauuacugugccagaggcagcuauuacuaugaaucuucccucgauuacugggggaaaggaacgcug

SEQ ID NO: 43092 - RNA, 345 nt, Artificial Sequence
  derived and/or modified sequence opt5 from anti-influenza_Chain
caggugcaacugguccagagcggcgccgagguuaagaaacccggguccucugugaaggugagcugcaaaaccuccggaggcacauucucuagcuacgcugucacgugggugagacaggccccugggcagggacucgaauggaugggcgggaucauuggaauguuuggcaccacaaacuaugcgcaaaaguuccagggccggguuaccaucacagcugacgagcugaccuccacagccuacauggaacuuucuagccugcgcuccgaggauaccgccguguauuacugugcuagagggagcuauuacuaugaaucuucccucgacuacuggggacggggcacgcug

SEQ ID NO: 43093 - RNA, 345 nt, Artificial Sequence
  derived and/or modified sequence opt5 from anti-influenza_Chain
gaggugcagcugguccaaagcggcgccgaaguuaagaaacccggggcuuccgugaaggugucuugcaaagccagcggauacaccuucacaggcuauuacgucuauugggugagacaggcgccugggcagggacucgaguggaugggcuggaucuccgcuuacaacgggaauacgaacuaugcccagaaguuucaaggacggguuaccauuacagccgacaaaucuaccagcacagcuuacauggaacuguccucucuucgcagcgaggauaccgccguguauuacugugcuagaucccggagccuggacgucuggggccagggcacaaccgugacgguuucuucc

SEQ ID NO: 43094 - RNA, 345 nt, Artificial Sequence
  derived and/or modified sequence opt5 from anti-influenza_Chain
gacaucgugaugacccagagcccccugucccucccugucacaccgggcgagcccgccucuauuagcugcagauccucucaaagccugcuucacuccaacgggcauaucuacuucgauugguaucugcagaagccuggacagucuccccagcuccugauuuaccuuguuagcaaacgggcuuccggcgugccugaccgcuuuagcgggucuggauccggcacggauuucacccugaagaucagcagaguggaagccgaggacgucgggguguauuacuguaugcaagcgcucgaaacacccuuuaccuucggaccuggcacaaaaguucacauuaagcggaccgug

SEQ ID NO: 43095 - RNA, 345 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcgccuacaacuauguuucuugguaccagcaccauccggggaaggcgcccaaacucaugaucuaugaugugacauacagaccuagcggaguguccacccgguucagcggcucuaaguccgggaauacagcuagccugaccauuucuggacuucaggccgaggacgaagccgauuauuacuguuccagccaaucucgcuccagcacacuggucaucuuuggcggcgggaccaaacucacggugcugggacagcccaag

SEQ ID NO: 43096 - RNA, 345 nt, Artificial Sequence
  derived and/or modified sequence opt5 from anti-influenza_Chain
gacaucgugcugacccagagccccgucucccucgccguuucucugggcgagagcgcuacagugaacugcaaguccucucaaagcgugcuuuccaauucuaaaaaccugaauuaccucgccugguaucagcacaagccugggcagccgcccaaacugcuuauuuacugggcgagcacgagagaauccggagucccugaucgguucagcggcucuggguccggaaccgacuuuacacugaccaucagcucucuccaggcugaggauguggccguuuauuacugucaacagcauuauuccauuccccugacauucggcccugggaccaagguggacaucaaacgcaca

SEQ ID NO: 43097 - RNA, 348 nt, Artificial Sequence
  derived and/or modified sequence opt5 from anti-influenza_Chain
gacaucgugcugacccagagcccccucucccugccugucacaccgggcgagcccgccucuauuagcugcagauccucucaaagccuucuggauuccaacggguacaauuaucucgacugguaccugcagaagccuggacagucuccccagcuucugaucuaucucgcuagcuaccgggccccuggcguucccgaucgcuucuccgggagcggaucuggcacggacuuuacccugaaaauuuccagaguggaagcggaggauguggggcuguauuacuguaugcaagcucuccagacaccuccgauguauaccuucggacagggcacaaagcuggaaaucaaacggacc

SEQ ID NO: 43098 - RNA, 351 nt, Artificial Sequence
  derived and/or modified sequence opt5 from anti-influenza_Chain
cuggagagcggcgggggacucgugcagcccggcgggucccugagacuuucuugcgccgcuagcggaaucaccuucuccucuuacgccaugagcuggguccggcaagcgccuggcaaggggcuggaauggguuuccacagugaacucuggaggcggcagcacguauuacggggacuccgugcgcggaagauuuaccauuagccgggauaauucuaaauccacacucuaucugcagcuuaacagccugcgcgcugaggacaccgccaucuacuauugugccaaggauaaaggcagaccgauuuucgggcucgucacacccucuuacuauauggacguguggggaaauggcacc

SEQ ID NO: 43099 - RNA, 351 nt, Artificial Sequence
  derived and/or modified sequence opt5 from anti-influenza_Chain
caggagcaacuggugcagagcggcgccgaagucaagaaacccggggcuuccguuaaggugucuugcaaagccagccggaaguccuucaucggauacuaugugcacuggguccggcaggcgccuggccaggggcucgaguggaugggauggauuucuccggacagcgaugcuaccaaauacgcccaaaaguuucagggcuccgugaucaugacacgcgacacgucuguuagcaccguguauauggaacuguccagacuuacaagcgaugacaccgcccuguacuauugucuccuguucagagggggaaacucucuuuccuggggccagggcacacuggucaccgugagcucu

SEQ ID NO: 43100 - RNA, 351 nt, Artificial Sequence
  derived and/or modified sequence opt5 from anti-influenza_Chain
caggugcaacugcaggagagcggccccgggcucgucaagccuuccgaaacccugucucuuacaugcacgguuagcggauccucuaucagcaacuacuauugguccuggauuagacagucuccgggcaaagggcuggaguggaucggauucauuuacuauggcgggaauaccaaguacaaccccagccucaaaucccgggugacaaucagccaggacaccucuaagucccaagugagccugacaaugucuuccgucaccgccgcugaaagcgccguguauuuuugugcgcgcgcuucuugcuccggaggcuacuguauucuugauuauuggggccaggggacacugguuacc

SEQ ID NO: 43101 - RNA, 351 nt, Artificial Sequence
  derived and/or modified sequence opt5 from anti-influenza_Chain
gaggugcagcuggucgaaagcggcgggggacucguucaacccggcgggucccugagacuuucuugcgccgcuagcggauucaccuuuuccaucuacgccaugucuugggugcggcaggcgccuggcaaggggcuggagugggugagcgcuauuuccucuagcggagacuccacauauuacgccgauagcgucaaaggccgcuucacgaucucuagagacaacgcccggaauacccucuaucugcagaugaacucccuucgcgcugaagauacagccguguacuauugugcuagagccuacggcuauaccuuugacccgugggggcagggaacacugguuaccgugagcucu

SEQ ID NO: 43102 - RNA, 354 nt, Artificial Sequence
  derived and/or modified sequence opt5 from anti-influenza_Chain
caggugcaacugcaggagagcggccccgggcucgucaagccuuccgaaacccugucucuuacaugcacgguuagcggauacuccuucgacucuggcuauuacuggggguggcugagacagccgcccggaaaaggccucgaguggaucgggagcauuuaucacucccggaacaccuacuauaauccuucucuuaagagccgcgugacaaucuccguggauaccagcaaaaaccaguuuucucugcaacuguccagcgucacagccgcugacaccgccguguacuauugugcgagaggaacaugguacucuuccaaucuccgguacugguucgaucccuggggcaagggcacccug

SEQ ID NO: 43103 - RNA, 354 nt, Artificial Sequence
  derived and/or modified sequence opt5 from anti-influenza_Chain
cagcccgugcugacccaaccuccgagcgccuccgcuucucucggcgccagcgucacacugacgugcacccuuuccucugcguacagcaacuauaagguugacugguaccagcagagacccgggaagggaccucgguucgugaugcgcgugggcacagggggaaucgucggcuccaagggggauggcauucccgacagauuuucugugcugggaagcggccucaaucgguaucugaccaucaaaaacauucaggaggaagaugaguccgacuaccacuguggggcugaucauggaagcggcucuaauuucguuuccccuuauguguuugggggaggcacaaaacuuaccguccug

SEQ ID NO: 43104 - RNA, 354 nt, Artificial Sequence
  derived and/or modified sequence opt5 from anti-influenza_Chain
caggugcaacugguccagagcggcgccgacguuaagaaacccggguccucugugaccgugagcugcaaggcuuccggaggcucuuucagcaacuacgggaucaauugggucagacaggccccuggacagggccucgaguggaugggagggauuaucccgcugauuaacgcgcccaauuaugcuccuaaauuucaaggccgggugacaaucacggccgauauguucuccaacauuguuucucuucagcugaccagccuccgcacagacgauaccgccguguacuauugugcuagacggaagaugacaaccgccaucgacuacuggggccaggggacacuggucaccguguccagc

SEQ ID NO: 43105 - RNA, 354 nt, Artificial Sequence
  derived and/or modified sequence opt5 from anti-influenza_Chain
caggugcaacugguccagagcggcgccgagguuaagaaacccggguccucugugaaggugagcugcagagaauccggaggcaccuucaacggguacacaaucacguggguccggcaggcuccuggacagggccucgaguggaugggagggauuaucccgaugaugggcaccgugaauuaugcccaaaaacugcagggccgcguuacaauuaccacagacuacuuuaccaagacagcguauauggaucuuaacaaucugagaucugaagacaccgcuauguacuauugugugaaaauccgguacacggggcagcagcuccuguggggacaaggcacccuugucacagugagcucc

SEQ ID NO: 43106 - RNA, 354 nt, Artificial Sequence
  derived and/or modified sequence opt5 from anti-influenza_Chain
caggugcaacugguccagagcggcgccgagguuaagaaacccggggcuuccgugaaggugucuugcaaagccagcggacacaccuucacaggcuacuauauccauugggucagacaggcgccugggcagggacucgaauggaugggcuggauuaacccggacuccggggcuacgucuagcgcccaaaauuuucagggacgggugaccaugacaggcgauaccuccucuagcacagccuacauggagcugucccgccuuagcuucgacgauaccgcuguuuauuacugugccagagugcuguuuacaucucccuucgacuuuuggggcgaagggacccucgucacgguguccagc

SEQ ID NO: 43107 - RNA, 354 nt, Artificial Sequence
  derived and/or modified sequence opt5 from anti-influenza_Chain
cagcccgugcugagccaaccuccguccgccucugcuagccucggcgccuccgucacccugacaugcacgcuuucuagcggguucgacaacuaccagguugcgugguaucagcagagacccggaaagggcccucgguuugugaugcgcguggggaauggaggcaacgucgcuuccaaaggggauggaauccccgacagauucucugugagcggcuccggccugaaucgguaccucaccauuaagaacauccaagaggaugacgaaagcgauuauuacuguggggccgaccacggaucuggcaauaacuuuguuuccccuuauguguucgggggaggcacaaaacugaccguccuu

SEQ ID NO: 43108 - RNA, 354 nt, Artificial Sequence
  derived and/or modified sequence opt5 from anti-influenza_Chain
gaggugcagcuggucgaaagcggcgccgagguuaagaaacccggggcuuccgugaaggugucuugcaaagccagcggauacaccuucuccagauauuacauccacuggguccggcaagcgccuggccaggaacucgaguggaugggguggauuaacccggacucuggagauacaaauuaugcucagaaguuucgcggcagagugacgauggcccgggacaccagcaucuccacaguuuacauggaacugaacucucuucgcuaugaugacaccgccguguacuucugugcuagaauuaucuggagcuccagcgggauggaugucuggggacagggcacaaccgugacaguuucu

SEQ ID NO: 43109 - RNA, 354 nt, Artificial Sequence
  derived and/or modified sequence opt5 from anti-influenza_Chain
gaggugcagcugcucgaaagcggcgggggagucguucaacccggcagaucccugcggcuuucuugcgccgcuagcggguucaccuuucgcacauacggaaugcacugggugagacaggccccuggcaaggggcuggaguggguggcggucaucucccaugacggaaaucucaaauauuacggcggcucugugaaggggcgguucacgauuagccgcgauaauuccaaaaacgcucuguaucuucagaugaacucucugagaguugacgauaccgcccucuacuauugugcccggggaaucggcauuacagacgcuuuugauauccgcgggcagggaaccaugguggucgugagc

SEQ ID NO: 43110 - RNA, 354 nt, Artificial Sequence
  derived and/or modified sequence opt5 from anti-influenza_Chain
gaggugcagcuggucgaaagcggcgggggacucguucaacccggcgggucccugagacuuucuugcaccgccagcggacuguccgugucuagcacauacaugaacugggugcggcaggcuccuggcaaggggcucgagugggucuccguguucuauucugaaacgcgcaccuacuaugccgacagcguuaaaggaagauuuacagugucccggcacaauagcaacaauacccuguaccuucagaugaacucucugcgcgucgaggauacagcgguguauuacugugcuagaguucagcggcucuccuauggcauggacguguggggccaagggaccacagucaccgugagcucu

SEQ ID NO: 43111 - RNA, 354 nt, Artificial Sequence
  derived and/or modified sequence opt5 from anti-influenza_Chain
gaggugcagcuggucgaaagcggcgggggacucguucaacccggcgggucccugagacuuucuugcaccgccagcggacuguccgugucuagcacauacaugaacugggugcggcaggcuccuggcaaggggcucgagugggucuccguguucuauucugaaacgcgcaccuacuaugccgacagcguuaaaggaagauuuacagugucccggcacaauagcaacaauacccuguaccuucagaugaacucucugcgcgcggaggauacagcugucuauuacugugccagagugcagcggcucuccuauggcauggacguuuggggccaagggaccacagugaccgucagcucu

SEQ ID NO: 43112 - RNA, 354 nt, Artificial Sequence
  derived and/or modified sequence opt5 from anti-influenza_Chain
gacaugcagcugguggagagcggcgggggacucguucccccuggcgggucccugagacuuucuugcgccgcuagcggauucuccgucucugauaauuacaucaauugggugcggcaagccccgggcaaggggcuggacugggugagcgucuuuuauuccgcggaucgcaccucuuacgcugacagcgugaaaggaagauucacaguuuccagccacgauucuaagaacacgguguaucuccagaugaacucccugcgggccgaagacaccgccgucuacuauugugcucgcgugcagaaaagcuacuauggcauggauguuuggggccaggggacaaccgugacagucucuucc

SEQ ID NO: 43113 - RNA, 357 nt, Artificial Sequence
  derived and/or modified sequence opt5 from anti-influenza_Chain
gaggugcagcuggucgaaagcggccccguucucgugaagccuaccgagacacugacggugaccugcacagucuccggguucucuguggacaacgauagaaugggaguuagcuggauccggcaaccgcccggcaaagcccuugaauggcuggcucacaucuuuuccaaugacgagaagucuuacagcaccucccuccgcucuagacugacaauuagcaaagauaccuccaagcgccaggugguccuuagcaugacagacauggauccuguggacaccgccacguauuacugugcgcgggcucccucugaauaugccgccauggauguuugggggcagggaaccauggugacagucucc

SEQ ID NO: 43114 - RNA, 357 nt, Artificial Sequence
  derived and/or modified sequence opt5 from anti-influenza_Chain
caggugcaagucguucagagcggcaccgaggugaagaaacccggguccucugugaaggucagcugccagacauccggaggcagauucaugucuuacgccaucacgugggugcggcaggcuccugggcaaggacuggaauggaugggcgggauuguuccgguguuuggaaccgccaacuaugcgcagaaauuccagggccgcgucacaaucaccacagacgauagcaccagaacagcuuacauggagcucuccucucugcggagcgaagacaccgccguguauuacuguggcuuucgcuauggguccggauacggcuucgauagcugggggcagggaacgcuuguuaccgugucuucc

SEQ ID NO: 43115 - RNA, 357 nt, Artificial Sequence
  derived and/or modified sequence opt5 from anti-influenza_Chain
gaggugcagcuggucgaaagcggcgccgggguuaagaaacccggauccucugugaaggugagcugcaaggcuuccggcaacaccuucucuagcaaugccaucuccugggucagacaagcgccugggcagggacucgaguggaugggcgggauucugggaaugcuucggacaacgaacuacgcucagaaauuucagggccgcgugaccaucacagccgacgaguucaugaauaccgccuauauggaacugucuagccucacauccgaagauaccgcuguuuacuauugugccagaagcucuggcuacuauccggacuacuuucaccugugggggcaaggaacacuugugaccgucucc

SEQ ID NO: 43116 - RNA, 357 nt, Artificial Sequence
  derived and/or modified sequence opt5 from anti-influenza_Chain
caggugcaacugcaggagagcggccccgggcucgucaagccuuccgaaacccugucucuuacaugcacgguuagcggauccucuaucagcaacuacuauugguccuggauuagacagucuccgggcaaagggcuggaguggaucggauucauuuacuauggcgggaauaccaaguacaaccccagccucaaaucccgggugacaaucagccaggacaccucuaagucccaagugagccugacaaugucuuccgucaccgccgcugaaagcgccguguauuuuugugcgcgcgcuucuugcuccggaggcuacuguauucuugauuauuggggccaggggacacugguuaccgugagc

SEQ ID NO: 43117 - RNA, 357 nt, Artificial Sequence
  derived and/or modified sequence opt5 from anti-influenza_Chain
gaggugcagcuggucgaaagcggcgggggacucguucaacccggcgggucccugagaaucucuugcgccgcuagcggauucaccguguccucuaacuacaugagcugggugcggcaggccccuggcaaggggcuugagugggucuccgugauuuauucuggaggcagcacauacuaugcggacuccguuaaaggccgcuuuagcuucucuagagauaauuccaagaacacgguguuucugcagaugaauagccuccgggcugaagacaccgccgucuacuauugugcccgcugccugucuagaaugcggggguacggacuugauguguggggccaggggacaaccguuacagugucc

SEQ ID NO: 43118 - RNA, 357 nt, Artificial Sequence
  derived and/or modified sequence opt5 from anti-influenza_Chain
caggugcaacugcaggagagcggccccgggcucgucaagccuuccgaaacccugucucuuacaugcacgguuagcggagccuccaucucuagcgacuacugguccuggauuagacugccgcccggcaaagggcucgaguggaucggauauauuuacaaccggggcucuaccaaguauacaccuagccugaaaucccgcgugaccaucagccuugauacagcugaaaaucaguucucucugagacuccgguccgugaccgccgcggacacagcuauuuacuauugugcccgccacgucgggggacauaccuacggcaucgauuauuggggccaggggacgcuggugaccguuagcucu

SEQ ID NO: 43119 - RNA, 357 nt, Artificial Sequence
  derived and/or modified sequence opt5 from anti-influenza_Chain
caggugcaacugcaggagagcggccccgggcucgucaagccuuccgaaacccugucucuuacaugcacgguuagcggagccuccaucucuagcgacuacugguccuggauuagacugccgcccggcaaagggcucgaguggaucggauauauuuacaaccggggcucuaccaaguauacaccuagccugaaaucccgcgugaccaucagccuugauacagcugaaaaucaguucucucugagacuccgguccgugaccgccgcggacacagcugucuacuauugugcccgccacguugggggacauaccuacggcauugauuauuggggccaggggacgcuggugaccgugagcucu

SEQ ID NO: 43120 - RNA, 357 nt, Artificial Sequence
  derived and/or modified sequence opt5 from anti-influenza_Chain
caggugcaacugcaggagagcggccccagacucgucaagccuuccgaaucucugagccuuaccugcacaguuuccgggggaucuaucagcaacuccuucuggggcuggauucggcagccgcccggggagggacuggaauggaucggcuacguguauaauucugggaacacgaaguacaauccuagccucaagucccgcgugaccauuagcagagacacaucuaaaucccagcuguauaugaaacuucggagcgucaccgccgcugauacagccguguacuauugugcgcgccacgacgaugcuucucauggauacuccaucagcuggggccacggcacccugguuacagugucuucc

SEQ ID NO: 43121 - RNA, 357 nt, Artificial Sequence
  derived and/or modified sequence opt5 from anti-influenza_Chain
gaggugcaccuccagcaaagcggccccgaacuggucaagccuggggccuccguuaaaaugucuugcgaggcuagcggauacaccuucacagacuauuacguggccugggugaagcaguccccgggcgaaucuuuugaguggaucgggagagucaaccccuauagcggaggcacguccuacaaucagaaauucaaggggaaagcgacccugauuguggauaagucuagcuccacagcuuauauggaacuuagcucucugaccuccgaggacagcgccguuuacuauugugcccggugggauuacggaguguacgagggcuauaucgacuacuggggccaggggucugcucucacaguc

SEQ ID NO: 43122 - RNA, 360 nt, Artificial Sequence
  derived and/or modified sequence opt5 from anti-influenza_Chain
caggugcaacugguccagcccggcgccgagguuaagaaaccugggagcuccgugaaggugucuugcaaagcuagcggaggcaucuucuccccguacgccauuucuugggucagacaggcgcccgggcagggacucgaauggaugggcgggaucauugcuaucuuuggaaccacaaacuaugcccaaaaguuccagggccgggugacgauuaccgccgacaaaagcacaaccacagcuuaccuggagcuuaauucccugcgcuuugaagauaccgccguuuauuacugugcuagaggcgggcgguauuacguggacuauuucgauuacuggggacagggcacacucgucucugugagcucc

SEQ ID NO: 43123 - RNA, 360 nt, Artificial Sequence
  derived and/or modified sequence opt5 from anti-influenza_Chain
caggugcaacugcaggagagcggccccgaccucgucaagccuggggccuccguuaaaaugucuugcaaggcuagcggauacuccuucaccuauuaccacaugcauugggugaaacagacacacggcaagucucuggaauggaucgggcggauuccguauaacggaggcacgaauuacagccagagauuuaaagggaaggccguguucaccgucgauauguccucuagcacagcguauauggagcuucgcucccugaccagcgaagacucugcuguguacuauugugccagagaugccaacuacgagggagacugguacuuugauguuuggggccaaggcacaaccgugacagucuccagc

SEQ ID NO: 43124 - RNA, 360 nt, Artificial Sequence
  derived and/or modified sequence opt5 from anti-influenza_Chain
caggugcaacugguccagagcggcgccgagguuaaggaacccggguccgcuaugaaagugucuugcaaggccagcggaggcaccuucuccucugacgcguuuuguugggugagacaggcuccugggcggggacucgaguggaugggcgggaucauuccggucuuccagacagccaacuacggacccaauuuucaaggccgcgugacgaucagcgccgauguuuauaccacaacccuguaccuugaacuguccggccucacaucugaggacaccgcuguguauuucugcgccagaagcggggauggauacaacuauuacuuuccucuguggggccaggggacacuugucaccguguccagc

SEQ ID NO: 43125 - RNA, 360 nt, Artificial Sequence
  derived and/or modified sequence opt5 from anti-influenza_Chain
cagaucacccugagagagagcggccccacacucgugaagccuacgcaaacccugacacuuaccugcacauucuccggguuuucucugagcaccaacggagucaauguuggcuggauucggcagccgcccgggaaagcccucgaauggcuggcucuuaucuacugggacgaugacaagcgcuauuccccuucucugaaaagacggcucacaauuaccaaggauacgagcaaaaaccagguggugcugacccugacaaauauggaccccgucgauaccgccacauacuauugugcgcaccgcccugacuucuacggagauuuugaguauuggggccccgggacccucgugacgguuuccucu

SEQ ID NO: 43126 - RNA, 360 nt, Artificial Sequence
  derived and/or modified sequence opt5 from anti-influenza_Chain
caggugcaacugguccagagcggcuccgagguuaagaaacccgggaccucugugaaggugagcugcacagccuccggaucugucuucacgaacuacggcaucagcugggugagacaggcuccugggcagggacucgaauggaugggcgggauuaucccgcuguuuggagccgcgaaauaugcucaaaaguuccagggccggguuaccauuacagccgacgaguccaccaaaacaguguacauggaacuuucucgccugaccagcaaggauacagccaucuauuuuugugcuaaggcccccagagucuacgaguauuacuucgaccaguggggccaggggaccccugugacgguuuccagc

SEQ ID NO: 43127 - RNA, 360 nt, Artificial Sequence
  derived and/or modified sequence opt5 from anti-influenza_Chain
caggugcaacugguccagagcggcgccgaccucaagaaacccggggcuuccguuaaggugucuugcaaagccagcggauacaccuucacagauuauuacauccacugggugagacaggcgccuggccaggggcuggaguggaugggauggauuaacccggaauccggcgacacgaaguaugcucaaaaauuucaggggcgggucaccaugacacgcgauaccucuaucacaaccgccuacauggagcuuggaagacugcggagcgacgauacagccguguauuacugugcucgcgacguuuccaccacguggucuugguucgcccccuggggccagggcacccucgugacagucagcucc

SEQ ID NO: 43128 - RNA, 360 nt, Artificial Sequence
  derived and/or modified sequence opt5 from anti-influenza_Chain
caggugcaacugcaggagagcggccccgggcucgucaagccuuccgaaacccugucucuuacaugcagcguuuccggaggcucuaucaacuacuauuacuggagcuggauuagacagccgcccgggaaaggacuggaguguaucggcuauauuuccgacacggggcggaccuacuauaauccuucucuccgcagcagagugacaaucuccguggauaccagcaagaaccaguucucucugaaucuuacauccaugaccgccgcugacacagccgucuacuauugcgcgcgggaucccaccggaagccgccagaaaaacgcuuuugacauguggggccaaggcacgauggugaccguuucu

SEQ ID NO: 43129 - RNA, 360 nt, Artificial Sequence
  derived and/or modified sequence opt5 from anti-influenza_Chain
caggugcaacugcaggagagcggccccagagucguucggccuuccgaaacccucucucugacaugcacggugagcgggggauccaucucuagcuacaacuggauuuggauccgccagccgcccggcaaggggcuugaguggauuggacacaucuaugacuacggcagaaccuucuauaauuccucucugcagagccggccuacaauuuccguggaugccagcaaaaaccaacucucucugcgccuuaccuccgucacagcuagcgacaccgccguguacuauugugcgagaccccuggggauccuccauuacuaugcuauggaucuguggggacagggcacaaccguuacggugucuucc

SEQ ID NO: 43130 - RNA, 360 nt, Artificial Sequence
  derived and/or modified sequence opt5 from anti-influenza_Chain
caggugcaacugcaggagagcggccccgggcucgucaagccuuccgaaacccugucucuuacaugcagcguuuccggaggcucuaucagcuccgacuucuggucuuggauuagacagccgcccgggaaaggacuggaguggaucggcuacguguauaaccgggggagcacgaaguacuccccuagccucaaaucucgcgugaccauuuccgccgauaugagcaagaaucaguuuucucugaacauguccagcgucacagcugccgacaccgcgguguauuacugugcuaaaaauggaagaucuuccacaagcuggggcaucgauguuuggggcaaggggaccacagugaccgucuccucu

SEQ ID NO: 43131 - RNA, 360 nt, Artificial Sequence
  derived and/or modified sequence opt5 from anti-influenza_Chain
caggugcaacugcaggagagcggccccgggcucgucaagccuuccgaaacccugucucuuacaugcacgguuagcggaggcuccaucucugccuaccacuggagcuggauuagacagccgcccgggaaaggacuggaguggaucggccauauuuucgacuccgggucuaccuauuacaacccuagccucaagucccgggugacaaucagccuggaugcuucuaaaaaucagcuuucccugcgccucaccagcgugacagccucugacaccgcgauuuauuacugugcuagaccccugggaucccgguauuacuauggcauggaugucuggggccaagggacaaccgugacgguuagcucu

SEQ ID NO: 43132 - RNA, 360 nt, Artificial Sequence
  derived and/or modified sequence opt5 from anti-influenza_Chain
gaggugcagcuggucgaaagcggcgggggacucguucaacccggcgggucccugagaaucucuugcgccgcuagcggauucaccguguccucuaacuacaugagcugggugcggcaggccccuggcaaggggcuugagugggucuccgugauuuauucuggaggcagcacauacuaugcggacuccguuaaaggccgcuuuagcuucucuagagauaauuccaagaacacgguguuucugcagaugaauagccuccgggcugaagacaccgccgucuacuauugugcccgcugccugucuagaaugcggggguacggacuugauguguggggccaggggacaaccguuacaguguccagc

SEQ ID NO: 43133 - RNA, 360 nt, Artificial Sequence
  derived and/or modified sequence opt5 from anti-influenza_Chain
caggugcaacugcaggagagcggccccgggcucgucaagccuuccgaaacccugucucuuacaugcacgguuagcggauccucuaucagcaacuacuauugguccuggauuagacagucuccgggcaaagggcuggaguggaucggauucauuuacuauggcgggaauaccaaguacaaccccagccucaaaucccgggugacaaucagccaggacaccucuaagucccaagugagccugacaaugucuuccgucaccgccgcugaaagcgccguguauuuuugugcgcgcgcuucuugcuccggaggcuacuguauucuugauuauuggggccaggggacacugguuaccgugagcucc

SEQ ID NO: 43134 - RNA, 360 nt, Artificial Sequence
  derived and/or modified sequence opt5 from anti-influenza_Chain
caggugcaacugcagcagagcggcgccgaggucaagaaacccggguccucuguuaaggugagcugcaaaguguccggagucaucuucucuggcagcgcuauuuccugggugagacaggccccugggcaaggacucgaauggaugggcgggaucucuccgcuguuuggaaccacaaacuacgcgcagaaguuccagggccggguuacgauuaccgcugaccagagcacaaauaccacauauauggaggugaacucccuucgcuacgaagauaccgccgucuauuuuugugccagaggccccaaauacuauagcgaguacauggacgugugggggaagggaacaaccguuacggugucuucc

SEQ ID NO: 43135 - RNA, 360 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaccuucucuagcuacgccaucuccugggucagacaggcgccugggcagggacucgaauggaugggcgggauuaugggaauguuuggcacaacgaacuaugcucaaaaauuccagggccgggugaccaucacagccgacgaguuuaccucugccgcuuacauggaacugcgcagccuuagauccgaggauacagccguuuauuacugugcucggagcucuggguauuacccggaauauuuccaggacuggggacagggcacccuggugacagucuccagc

SEQ ID NO: 43136 - RNA, 360 nt, Artificial Sequence
  derived and/or modified sequence opt5 from anti-influenza_Chain
cagaugcaacuggugcagagcggcgccgaggucaagaaacccggguccucuguuaaggugagcugcaaagccuccggaggcaccuucucuagcuacgcuaucacaugggugagacaggcgccugggcagggacucgaauggaugggcgggauuaucggaauguuuggcuccacgaacuaugcucaaaauuuccagggccgggucaccauuacagccgacgagucuaccagcacagccuacauggaacuguccagccuucgcucugaggauaccgcuguguauuacugugccagauccacaggguauuacccggcuuaucugcaccauuggggacagggcacccucguuacggugagcucu

SEQ ID NO: 43137 - RNA, 360 nt, Artificial Sequence
  derived and/or modified sequence opt5 from anti-influenza_Chain
gaggugcagcuggucgaaagcggcgccgagguuaagaaacccggguccucugugaaggugagcugcaaagccuccggaggcaccuucucuagcuacgggaucuccugggucagacaagcuccuggacagggccucgaauggaugggggacauuaucggaauguuuggcucuacaaacuaugcgcagaauuuccagggccggcugacgauuaccgcugaugagagcacauccaccgccuacauggaacuuagcucucugcgcuccgaggacacagccguguauuacugugcuagaagcucuggguauuacccggccuaucucccccacuggggacaaggcacccugguuacaguguccagc

SEQ ID NO: 43138 - RNA, 360 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuagcuacgccaucuccugggucagacaagcgccugggcagggacucgaauggaugggcgggauuaucggaauguuuggcacagcuaacuaugcccagaaauuccagggccgggugacgauuaccgccgacgaguuuacaucuaccgcuuacauggaacugagcucccuucgcagcgaggauacagccguuuauuacugugcuagagggaauuauuacuaugagucuucccuggacuacuggggacaaggcacccucgugacagucagcucu

SEQ ID NO: 43139 - RNA, 360 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcccuuucagaaacuuugccaucaauuggguccggcaggcgccggggcagggacucgaauggaugggcgggauuaucgcuguguucggaaccacaaaauacgcccacaaauuucaaggccgcguuacgauuaccgccgacgauucuacaaacaccgcuuauauggagcugggcagccuuaaguccgaagacacagccguguacuauugugcuagagggccccauuacuauucuagcuacauggaugucuggggagagggcaccacagugaccguuuccagc

SEQ ID NO: 43140 - RNA, 360 nt, Artificial Sequence
  derived and/or modified sequence opt5 from anti-influenza_Chain
gagguggcccuggucgaaaccggcgcugagguuaagaaacccgggagcuccgugaaggugccuugcaaaucuagcggauccccguucagaucuaacgccgucagcugggugcggcaggcgcccggccaagggcucgaauggguuggaggcauccuggggguguuuggauccccuucuuacgcucagaaguuccagggccgcgucacaauuacggccgacgagagcaccaauacagugcacauggaacuuagaggccugcgguccgaggauaccgccguuuauuacugugcucgcgggcccacauauuacuauagcuacauggacguguggggaaaaggcaccacagucaccgugucuucc

SEQ ID NO: 43141 - RNA, 360 nt, Artificial Sequence
  derived and/or modified sequence opt5 from anti-influenza_Chain
cagaugcaacuggugcagagcggcgccgaggucaagaaacccggguccucuguuaaggugagcugcaaggcuuccggaggcaccuucucuagcuacgccaucuccugggugcgccaggcgccugggcagggacucgaauggaugggcgggauuuuuggaauguucggcacagcuaacuaugcccaaaaauuucagggccgggucacgaucaccgccgacgaguucacaucugcugccuacauggaacugagcucccuugggagcgaggauaccgcuauguauuacugugccagaucuuccggauauuacccgcaguauuuucaggacuggggccaagggacacuggugaccguuagcucu

SEQ ID NO: 43142 - RNA, 360 nt, Artificial Sequence
  derived and/or modified sequence opt5 from anti-influenza_Chain
caggugcaacugguccagagcggcgccgagguuaagaaacccggguccucugugaaggugagcugcaaggcuuccggagucaccuucucuuacuaugccaugagcugggugagacaggcgccuggccaggggcucgaauggaugggaggcaucuccccgauguuugggacaacgaccuacgcucaaaaauuccagggacggguuacaauuaccgccgacgauucuacaagcaccgccuauauggaggugcgcucccugagaagcgaagacacagcugucuacuauugugcccggucuuccaacuacuaugauagcguguacgacuacuggggccagggcacccuuguuacggugucuucc

SEQ ID NO: 43143 - RNA, 360 nt, Artificial Sequence
  derived and/or modified sequence opt5 from anti-influenza_Chain
gaggugcagcuggucgaaaccggcgccgagguuaagaaacccgggagcuccgugaaggugccuugcaaaucuagcggauccccguucagaucuaacgcugucagcugggugcggcaagcccccggccaggggcucgaauggguuggaggcauccuggggguguuuggauccccuucuuacgcgcagaaguuccagggccgcgucacaauuacggcugacgagagcaccaauacagugcacauggaacuuagaggccugcgguccgaggauaccgccguuuauuacugugcccgcgggcccacauauuacuauagcuacauggacguguggggaaaaggcaccacagucaccgugucuucc

SEQ ID NO: 43144 - RNA, 360 nt, Artificial Sequence
  derived and/or modified sequence opt5 from anti-influenza_Chain
caggugcaccugguccaaagcggcgccgagguuagaaagcccggggcuuccgugaaagugucuugcaaggucagcggauacacccucaacgaacuguccauccauuggcuucggcaggccccuggccgcgggcuggaguggaugggaucuuucgacccggaagauggcgagacaauuuaugcgcagaaauuucaggggagagugacgaugaccggagacacaagcaccgauacagcuuaccucgaacugaccucccuucggucugaggacacagcccuguauuacugugcccgcggcuggggcgcuguuaccagccccuucgauuuuugggggcaaggaacgcucgugaccgucuccagc

SEQ ID NO: 43145 - RNA, 360 nt, Artificial Sequence
  derived and/or modified sequence opt5 from anti-influenza_Chain
gaggugcagcugguccaaagcggcgccgaaguuaagaaacccggguccucuaugaaggugagcugcaaggcuuccggaucuaucuucagcaacuacggcauuuccugggugagacaggccccugggcagggacucgaguggaugggcgggaucauuccgaucuuuggagcggcuaauuaugcccagaaauuccaaggccgggucaccauuacagccgacgaaucuacgagcaccguguacauggagguucgcucccugagaagcgaagauacagcuguguauuacugugcccggcgccagcagcuuuauaaaggcuacuaucaccauugggggcagggaacccuggucacagugucuucc

SEQ ID NO: 43146 - RNA, 360 nt, Artificial Sequence
  derived and/or modified sequence opt5 from anti-influenza_Chain
caggugcaacugguccagagcggcgccgggguuaagaaacccggauccucuaugaaggugagcugcaaggcuuccggcucuaucuucagcaacuacgggauuuccugggugagacaggccccuggacagggccucgaguggaugggagggaucauuccgaucuuuggcgcggcuaauuaugcccaaaaauuccagggccgggucaccauuacagccgacgaaucuacgagcaccguguacauggagguucgcucccugagaagcgaagauacagcuguguauuacugugcccggcgccagcagcuuuauaaaggguacuaucaccauuggggacaaggcacccuggucacagugucuucc

SEQ ID NO: 43147 - RNA, 360 nt, Artificial Sequence
  derived and/or modified sequence opt5 from anti-influenza_Chain
caggugcaacugcaggagagcggccccgggcucgucaagccuuccgaaacccugucucuuacaugcacgguuagcggaggccugaucgggaccggauccuacuauuggggcuggauuagacagacaccggggaaaggaauggaguggaucggcucuauuagcuacuccggcucuaccuauuaccaccccagccucaagucccgggugacaaucagcgacgauaccucuaaaaaccagcuguuccuuaagcugcgcuccgugacagccgcugacaccgcccaauauuacugugcgagauauaauugggggauucgguacuuugauuucuggggacgcggcacgcucgucaccgugagcucu

SEQ ID NO: 43148 - RNA, 360 nt, Artificial Sequence
  derived and/or modified sequence opt5 from anti-influenza_Chain
caggugcaacugguccagagcggcgccgagguuagaaagcccggguccucugugaaagugagcugcaaggucuccggaggcaucauucggaaauacgcuaucaacugggugcgccaggccccugggcagggacucgaauggaugggcgggauuaucgcgauuuucaauaccgcuaacuaugcccaaaaguuucagggaagaguuacaaucacggccgacgagucuaccagcacaguguacauggaacuguccucucuucggagcgaggauaccgcucuguauuacugugcccgcggcaugaauuauuacuccgacuauuucgauuacuggggccaggggagccucgucacagugucuccg

SEQ ID NO: 43149 - RNA, 360 nt, Artificial Sequence
  derived and/or modified sequence opt5 from anti-influenza_Chain
caggugcaacugguccagagcggcgggggaguugugcagcccggcagaucccuccggcugucuugcgccgcuagcggguucaccuuucgcucccacgccaugcauugggugagacaggcgccuggaaagggcccggagugggucgcucuuaucucuuacgacgaagugaacaaauucuaugccgauagcguuaaggggcgguuuacaauuucccgcgacgugucuaaaaauacggucuuccugcaaaugaacagccucuccgccgaugacaccgcuguguacuauugugccagaggacacagcggcucuuaccggcuguuugauuucuggggccaggggacacuuguuaccguguccagc

SEQ ID NO: 43150 - RNA, 360 nt, Artificial Sequence
  derived and/or modified sequence opt5 from anti-influenza_Chain
caggugcaacuggucgagagcggcgggggacucguucagcccggcgggucccugagacuuucuugcgccgcuagcggauucaucuuuggcgacuucgccauucacugggugcggcaggcguccgggaagggacuggaauggguggcucgcaucagaucuggccucaaccgguuugagaccgccuacgccgcuagcgucgaaggccgccugacaauuuccagagaugacucuaaaagcauggccuaucuucagaugaauaacgugaaggcugaggauacggccguuuaccuguguaccuaucucgugggggcggucggauuccaacauuggggccaggggacacuggugaccguuuccagc

SEQ ID NO: 43151 - RNA, 360 nt, Artificial Sequence
  derived and/or modified sequence opt5 from anti-influenza_Chain
caggugcaacuggucgagagcggcgggggaguugugcagcccggcagaucccuccggcugucuugcgccgcuagcggguucaccuuuuccucuuacggaaucuauugggugcgccaggccccuggcaaggggcuugaaugggucgcguucauuagcuacgacgagaucaauaaauuuuaugcugauuccgugaagggaagauucacaauuucucgggacaauagcaaaaacacgguuuuucugcagaugaacucccuccgcgaugaagacaccgccguguacuauugugccaagccgcugagaggcagcuaccgguauuucgaucuuuggggccgcgggacagucgugaccguuucuucc

SEQ ID NO: 43152 - RNA, 363 nt, Artificial Sequence
  derived and/or modified sequence opt5 from anti-influenza_Chain
caggugcaacugcaggagagcggccccgaccucgucaagccuggggccuccguuaugaucucuugcaaagcuagcggauacuccuucaccuauuacuauaugcacugggugaagcagucucauggcaaaacacuggaauggauugggagaaucuacccguauaacggagauacgaauuacaaccggcgcuuuaaggacaaagccauucuuaccguggaugagagcuccucuacagcguauauggaacugagaagccucaccuccgaggacagcgcugucuacuucugugcccgggaugccaauuacgaaggcgacugguauuuugaugugugggggcagggaacaaccguuacagugucuucc

SEQ ID NO: 43153 - RNA, 363 nt, Artificial Sequence
  derived and/or modified sequence opt5 from anti-influenza_Chain
caggugcaacugguccagagcggagggggaguugugcagcccggcagaucccuccggcugucuugcgccgcuagcggguucaccuuuuccucuuacgccaugcacugggugcgccaggcgccuggaaagggccuugagugggucgcuaucauuagcuaugacgggaacgaucaauacuauacagacuccgugaaaggaagauucacgaucucucgggauagcuccaagguuuaccugcagaugcaucgccucagaccggaagacaccgccguguauuacugugccaaagaguuugaaacaagcggcuauuuccacggcucuuuugauuacugggggcagggcauucuggucaccguguccagc

SEQ ID NO: 43154 - RNA, 363 nt, Artificial Sequence
  derived and/or modified sequence opt5 from anti-influenza_Chain
caggugcaagucguucagagcggcgccgaggugaagaaacccggguccucugugagagucagcugccaggcuuccggaggcaccuucaugaacuacgccaucauuugggugcggcgcgcgccugggcagggacuggaauggaugggcgggaucauuccgguuuuucccacaccuaauuaugcucaaauguuccagggaagagugacgaucucuaccgacgagagccgguccacaucuuuucucgaacugaccaaccuucgcuacgaggauacagccgucuauuacugugccagacggauuuaucacggcggcaauagcggguucgacuuuuggggacagggcacccuggugacaguuuccagc

SEQ ID NO: 43155 - RNA, 363 nt, Artificial Sequence
  derived and/or modified sequence opt5 from anti-influenza_Chain
caggugcaacugcaggagagcggccccgggcuccugaagccuuccgacacccuugcccugacaugcacggucucuggaggcagcaucaccuccgauuacuggucuuggauuagacagccgcccgggcggggacucgacuggaucggcuucuuuuauaacgggggaagcacaaaauacaauccuucccugaagucucgcguuaccauuagcgcugauacauccaaaaaccagcuuagccugaagcucaccucugugacagccgcggacaccggcguguauuacugugcuagacacgaugccaaauucuccggcagcuauuacgucgccucuugggggcaaggaacgcgggugaccguuuccagc

SEQ ID NO: 43156 - RNA, 363 nt, Artificial Sequence
  derived and/or modified sequence opt5 from anti-influenza_Chain
caggugcaacugcaggagagcggccccgggcuccugaagccuuccgacacccuugcccugacaugcacggucucuggaggcagcaucaccuccgauuacuggucuuggauuagacagccgcccgggcggggacucgacuggaucggcuucuuuuauaacgggggaagcacaaaauacaauccuucccugaagucucgcguuaccauuagcgcugauacauccaaaaaccagcuuagccugaagcucaccucugugacagccgcggacaccggcguguauuacugugcuagacacgaugucaaauucuccggcagcuauuacguggccucuugggggcaaggaacgcggguuaccguguccagc

SEQ ID NO: 43157 - RNA, 363 nt, Artificial Sequence
  derived and/or modified sequence opt5 from anti-influenza_Chain
caggugcaacugcaggagagcggccccgggcucgucaagccuuccgaaacccugucuguuacaugcaaagugagcggagacuccaucucuagcuacuccuggucuuggauuagacagccgcccggcaaggggcuugagugggugggauaucuguacuauagcggcuccacgaaauacaacccuagccucaagucucggaccacaaucuccgucgauaccagcacaaaucagcugucucuuaaacuguccuucgugaccgccgcugacacagccguuuauuuuugugcgcgcaccgggagcgaaucuacgaccggauacggcauggauguguggggccaagggacaaccgucacaguguccagc

SEQ ID NO: 43158 - RNA, 363 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagc

SEQ ID NO: 43159 - RNA, 363 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcccuuucagaucuuacgccaucagcuggguccggcaggcgccggggcagggacccgaauggaugggcgggauuaucccuauuuuuggaaccacaaaauaugcucccaaauuccaaggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagc

SEQ ID NO: 43160 - RNA, 363 nt, Artificial Sequence
  derived and/or modified sequence opt5 from anti-influenza_Chain
gaggugcagcuggucgaaaccggcgccgagguuaagaaacccggggcuagcgugaagguguccugcaaagccucuggauacacauucacgagcuauuacaugcacugggucagacaagcgccuggccaggggcucgaauggaugggauggaucaaccccaauuccggcgggaccaacuaugcucagaaguuucagggacgggugacaaugacccgcgacacaucuauuagcaccgccuacauggagcuguccagacuucggucugaugacacagccguuuauuacugugcucgcgaaggcaaauggggcccgcaagccgcuuucgauaucugggggcagggaaccauggugacggucagcucc

SEQ ID NO: 43161 - RNA, 363 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuuuuuacagcauguccugggucagacaagccccugggcagggacucgaauggaugggcgggaucauuccgauguucggaacaacgaacuaugcgcagaaauuucagggccgggugaccaucacagcuguugagucuaccagcacagccuacauggaaguguccagccugcgcucugaggacaccgccgucuauuacugugcuagaggcgauaaagggauuuauuacuauuacauggacguguggggaaagggcacaaccguuacgguguccagc

SEQ ID NO: 43162 - RNA, 363 nt, Artificial Sequence
  derived and/or modified sequence opt5 from anti-influenza_Chain
gaggugcagcuggucgaaaccggcgccgagguuaagaaacccgggagcuccgugaaggugucuugcaaagcuagcggaggcacauucagaacgcacgccaucuccuggguccggcaagcgccugggcagggacucgaauggaugggcgggauuaucgcuauuuuuggaaccgccaacuacgcccagaaguuccagggccgcaucacaauuaccgcugacgagucuacaagcaccgccuauauggaacuguccucucuuagaagcgaggauacagcuguguacuuuugugcccggggcuccggguaucauaucagcaccccguucgacaauuggggacaaggcacgcugguuaccgugucuucc

SEQ ID NO: 43163 - RNA, 363 nt, Artificial Sequence
  derived and/or modified sequence opt5 from anti-influenza_Chain
gaggugcagcugguccaaagcggcgccgaaguuaagaaacccggguccucugugaaggugagcugcaaggcuuccggaggcaucuucagaucuaacagcauuuccuggguccggcaggccccugggcagggacucgaguggaugggcgggaucuuugcgcuguucggaaccacagacuacgcucagaaauuucaaggccgcgugacgauuaccgccgaugaaucuagcacaaccguuuaucuugagcuguccagccucacaucugaagacaccgccguguacuauugugcuagaggcuccggguacacaacccggaauuauuucgauuacuggggacagggcacgcuggucaccgugagcucu

SEQ ID NO: 43164 - RNA, 363 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaucuucaacucuuacgccauuagcugggucagacaagcgccugggcagggacucgaauggaugggcgggaucauugcuaucuuucacaccccgaaauaugcccagaaauuccagggacgggugacaauuacggccgacgaguccaccaauacagcuuacauggaacugcgcucucuuaagagcgaggauaccgcccuguauuacugugcuagaggcuccacauaugacuuuagcucuggccucgauuacugggggcaaggaacccugguuacaguguccagc

SEQ ID NO: 43165 - RNA, 363 nt, Artificial Sequence
  derived and/or modified sequence opt5 from anti-influenza_Chain
caggugcaacugguccagagcggcgccgagguuaagaaacccggguccucugugaaggugagcugcaaauccucuggaggcaacuucaauaacuacgcugucagcugggugagacaggccccugggcagggacucgaauggaugggcgggaucuccccgauuuuuggaucuaccaaucacgcgcaaaaguuccagggccggguuacaaucagcgcugacauuuuuacgaacaccgccuauauggagcuguccagccuucgcucugaugacacagccaucuacuauugugcuagaggccggggguacuauuucuaccaugccauggauguguggggacagggcuccaccgucacagugagcucu

SEQ ID NO: 43166 - RNA, 363 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaccuucaacaauuacgccaucaacugggucagacaggcgccugggcagggacucgaauggaugggcgggauuucuccgaucuuuggaagcgugaauuaugcucaaaaacugcagggccggguuacaauuacggccgacguguucaccuccacagccuacauggagcuuucuagccugcgcuccgaagauaccgcugucuauuacugugccaaaggcagcggguauuacuauuacuacggacucgacguguggggccuggggacaaccguuacagugucuucc

SEQ ID NO: 43167 - RNA, 363 nt, Artificial Sequence
  derived and/or modified sequence opt5 from anti-influenza_Chain
caggugcaacuggucgagagcggcgggggaguugugcagcccggcagaucccuccggcugucuugcgccgcuagcggguucaccuuuacaaauuacgccaugcacugggugcgccaggcgccuggaaagggccuugaaugggucgcugugaucuccuucgacgaggauaauaaaucuuaugccgacuacguuaaggggagauuuacgauuagccgggauaacuccaauaaccgccuguaucuccagaugaacucucugagagccgaagacaccgcuguguacuauugugcccggggaccggagggcgucuggggccgcagcaucgauuccugggggcaaggaacacuugugaccguuagcucu

SEQ ID NO: 43168 - RNA, 363 nt, Artificial Sequence
  derived and/or modified sequence opt5 from anti-influenza_Chain
caggugcaacugguccagagcggcggggaccucguucagcccggaggcucccugagacuuucuugcgccgcuagcggguucaccuuuucccgguacucuaugaacugggugcgccaggccccuggaaugggccuggaguggguggcguauaucagcgauacauccagaacgauuuacuaugcugacucugucaaggggcgguucaccaucagccgcgauaaugccaagaacucccucuaccugcaaaugaaaagccuuagagacgaagauacagccguguauuacugugcucgggacccggauacccccuuuguucgcgccuucgacucuuggggacagggcacacuggugaccgucuccagc

SEQ ID NO: 43169 - RNA, 363 nt, Artificial Sequence
  derived and/or modified sequence opt5 from anti-influenza_Chain
caggugcaacuggucgagagcggcgggggacucguucagcccggcgggucccugagacuuucuugcguggccagcggauucaccuuuucccgguucucuaugaacugggugcgccaggcuccuggcauggggcuggaaugggucagcuacaucuccgacacaggaagaacgauuuauuacgccgauucugugaagggccgguuuaccaucagccgcgacaaugauaaaaacacacucuaucugcagaugaagucccuuagagacgaggauagcgcguucuacuauugugcucgggacccggauacccccuuuguucgcgccuucgacucuuggggccaaggggugcuggucacaguguccagc

SEQ ID NO: 43170 - RNA, 363 nt, Artificial Sequence
  derived and/or modified sequence opt5 from anti-influenza_Chain
caggugcaacugcaggagagcggccccgaccucgucaagccuggggccuccguuaaaaugucuugcaaggcuagcggauacuccuucaccuauuaccacaugcauugggugaaacagacacacggcaagucucuggaauggaucgggagaauuuauccguacaacggaggcacgaauuauagccagcgguuuaaagggaaggccguguucaccgucgauauguccucuagcacagcguacauggagcuucgcucccugaccagcgaagacucugcuguguauuacugugccagagaugccaacuacgagggagacugguauuuugauguuuggggccaaggcacaaccgugacagucuccagc

SEQ ID NO: 43171 - RNA, 366 nt, Artificial Sequence
  derived and/or modified sequence opt5 from anti-influenza_Chain
cagggccaacuggugcagagcggggccgaggucaagaaauccggaucuagcguuaagguguccugcaaaaccucuggcgggacauucaacagccacgcuaucuccugggugagacaggcccccggacagggccucgaauggauugggggaaucauuccuauguuuggcacgaccaauuacgcgcaaaagcugaaaggccggaucgcuauuacagccgaccagcuuccgaccacagccuaucuggagcucucuagccugcgcuccgaagauaccgcugucuacuauugugccagagggcagcgguacuauuacgaccgcgauggaauggacguguggggccaggggacaaugguuaccgugagcucu

SEQ ID NO: 43172 - RNA, 366 nt, Artificial Sequence
  derived and/or modified sequence opt5 from anti-influenza_Chain
caggugcaccugguccaaagcggcgccgagguuaagaaacccggguccucugugagacucagcugcuccgcuucuggaggcccuuucagcggguuugccaucuccuggcugcggcaggcgccgggacagggccuugaauggcucgggggaauuucugcuguguucggcaccgccacauacgcccagaaguuucaaggccgcgucacgaucaccgcugaccaguucacaagcaccucccauauggaucugagcagacugacauaugacgauaccgccguguacuauugugcucggucugggggauaccuuccccagaacaauuggauugacccuuggggccaggggacacugguuaucguguccagc

SEQ ID NO: 43173 - RNA, 366 nt, Artificial Sequence
  derived and/or modified sequence opt5 from anti-influenza_Chain
caggugcaacugguccagagcggcgccgagguuaagaaagcuggguccucugugaaggugagcugccaguccucuggagucaccuucagcauguacgccguguccuggguuagacaggcgcccggccaagggcucgaauggaugggaggcaucauuccucuguuugggacaacgaccuaugcucagaaauucgagggacggcuuacaaucaccgccgacacaucuaccaacauggccuaccuggaacuccgcagccugagauccgaggauacagcuguguauuuuugugcccgggcuggcaccacggucacccgcuucaauugguuugacccguggggccaggggacacuugugaccguuagcucu

SEQ ID NO: 43174 - RNA, 366 nt, Artificial Sequence
  derived and/or modified sequence opt5 from anti-influenza_Chain
caggugcaacugguccagagcggcgccgagguuaagaaacccggguccucucucaaggugagcugcaaggcuuccggagugaccuucucuauguacacaaucagcugggucagacaggccccuggccaggggcuggaauggaugggaggcauuaucccgcuuuuugggacggcgaacuaugagcaaaaauuccagggacgggugaccauuacagcugacaccuccacaaauaccgccuacauggaacugucuagccuccgcuccgaggauacagccguuuauuacugugcuagagccggcaccacgcugacccgguuuaacugguucgaccccuggggccaggggacacuugugaccgucagcucu

SEQ ID NO: 43175 - RNA, 366 nt, Artificial Sequence
  derived and/or modified sequence opt5 from anti-influenza_Chain
auggccgacaacaugaccacaacgcagaucgaguggagaaugaagaaaauggcuauuggcagcuccacccacucuagcuccgugcugaugaaggauauccaaucucaguucgaacagcucaaacugcggugggagagcuaccccaaucuugucaaguccacagacuaucaucagaaacgcgaaaccauuagacuggccacagaggaacucuaccugcuuucuaagcggaucgaugacagcauucuguuucacaagaccguuaucgcgaacuccagcaucauugcugauaugaucgugucucucucccugcuggagacacucuaugagaugaaagacguggucgaaguguacagccgccaaugccug

SEQ ID NO: 43176 - RNA, 366 nt, Artificial Sequence
  derived and/or modified sequence opt5 from anti-influenza_Chain
gaggugcagcugguccaaagcggcgggggacucguucagcccggcgggucccugagacuugccugcguggugucuggauucaccgucacaagcaauuacaucacgugggugcggcaggcuccuggcaaggggcuggaauggguuuccgugauuuauucucacggacgcgccuacuauagcgcguccgucaauggcagauuuaccaucucucggcauacaagcaaaaacaccguguaccucgagaugaacucccugcgcccggaagacacagcuguuuauuacugugccggcgggggacuugugggcggguaugaugaguacuucuuugacuacuggggacagggcacccuggccacagucagcucu

SEQ ID NO: 43177 - RNA, 366 nt, Artificial Sequence
  derived and/or modified sequence opt5 from anti-influenza_Chain
caggugcaacugguccagagcggcgccgagguuaagaaacccggggcuuccgugaaggugucuugcaaagccagcggauacaccuucacaggcuauuacaugcacugggucagacaggcgccugggcagggacucgaauggaugggcuggaucaaccccaauuccggggacacgaacuaugcucaaaaguuucagggacgggugaccaugacacgcgauaccucuauuacaaccgccuacauggagcugagcucccuuagaucugacgauacagccguuuauuacugugcucgggacagcccguauuccagcucuugguccuucuuugauuacuggggccagggcccucuggugaccgucagcucu

SEQ ID NO: 43178 - RNA, 366 nt, Artificial Sequence
  derived and/or modified sequence opt5 from anti-influenza_Chain
gaggugcagcuggucgaaagcggcgggggacucguucaacccggcgggucccugagacuuucuugcgccgcuagcggauucaucuuucggaauuacuggauguccugggugcgccaggccccuggcaaggggcuggaguggguggcgaauauuaaacaggacggaagagaaaaguauuacgucgauucucuccggggccgcgugaacaucagcagagacaaugcugagaacucccuguaucuucacaugaacucucugcggguugaagauaccgccguguacuucugugcccgcgcuagaauggucgugguuacaggcgacggguuugauguguggggacauggcacgauggucaccgugagcucc

SEQ ID NO: 43179 - RNA, 366 nt, Artificial Sequence
  derived and/or modified sequence opt5 from anti-influenza_Chain
gaggugcagcugcucgaaagcggcgggggacugguccaacccggcgggucccuuagacugucuugcgccgcuagcggauucgccuuuuccucuuacggcaugagcuggguucggcaggcgccugggaagggacucgaguggguguccgcuuucucuggcagcggcaccuccacauauuacgccgacagcgugaaagggcgcuuuacgaucucuagagauaaguccaaaaacacccuguaucuucagaugaauagccugcgggccgaagacacagcuauuuacuauugugccaagccgcccggaccuuacaucgucguggcuggccucuucgagaacugggggcgcggaacccugguuacagugucu

SEQ ID NO: 43180 - RNA, 366 nt, Artificial Sequence
  derived and/or modified sequence opt5 from anti-influenza_Chain
gaggugcagcuggucgaaagcggcgggggaguugugcaacccggcagaucccuccggcugucuugcgccgcuagcggguucuccuuuucuaacuacgccaugcacugggugcgccaggcgccuggaaagggccuugagugggucgcucugaucagcuucgacggguccgauaaauauuacgccgacucugugaagggaagauuuaccaugagccgggauaauuccaaaaacacacucuaucugcagaugaauagccuucgcgccgaagacacggcuguuuacuauugugccagagaugagccguacugcggcggcgacuguuucgcuuuugaugugugggggcagggaaccauggucacagugucu

SEQ ID NO: 43181 - RNA, 366 nt, Artificial Sequence
  derived and/or modified sequence opt5 from anti-influenza_Chain
caggugcaacugcagcagagcggccccgggcucgucaagccuucccagacccugucucuuacaugcacgguuagcggaggcccgguguccgggggaggcuacucuuggaacuggaucagacaacggcccgggcagggacuggagugggugggcuucauguuucacagcggcuccccucgcuauaaucccacccucaaaucuagaauuacaaucagcgucgacaccuccaagaaccuggugagccuuaaacugucuuccguuacagccgcugauaccgccguguacuucugugcgcgggucgggcagauggacaaguauuacgcuauggauguguggggacagggcacaaccguuacggugagcucu

SEQ ID NO: 43182 - RNA, 366 nt, Artificial Sequence
  derived and/or modified sequence opt5 from anti-influenza_Chain
caggugcaacugguccagagcggcgggggacucguuaagcccggcgggucccugagacuuucuugcgccgcuagcggauucaccuuuuccucuuacagcaugaacugggugcggcaggccccuggcaaagggcuggaguggguguccucuaucagcuccucuagcuccuauauuuacuaugucgacagcgugaagggacgcuucacaaucucuagagauaaugcgaaaaacucccucuaccugcagaugaauagccuucgggcugaagacacggccguuuauuacugugcccgcggcggcgggucuuauggagcuuacgagggcuuugauuacugggggcaaggaacccuggugacagucuccagc

SEQ ID NO: 43183 - RNA, 366 nt, Artificial Sequence
  derived and/or modified sequence opt5 from anti-influenza_Chain
caggugcaacugguccagagcggcgggggaguugugcagcccggcagaucccuccggcugucuugcgccgcuagcggguucaauuuuuccucuuacggaaugcacugggugcgccaggccccuggcaaggggcuugaguggcugagcgucaucugguccggaggcucuaauaaauauuacgcggacagcgugaagggcagauucaccauuucccgggaugacagcaaaaacacaguuuaucuccaaaugaacucucugcgcgaugaagacacggcuguguacuauugugccagagcccauaccgcucuuacacgguuucgcuggcuggauccgugggggcagggaauccucgucaccguguccagc

SEQ ID NO: 43184 - RNA, 366 nt, Artificial Sequence
  derived and/or modified sequence opt5 from anti-influenza_Chain
caggugcaacugguccagagcggcgggggaguugugcagagaggccggucccuccgccugucuugcgccgcuagcggguucaccuuuagaacauacggaaugcacugggugcggcaggcccccggcaaggggcuugagugugucgcgcugaucuccuaugacggaacgaacaaauacuaugcugauucugugaagggccgcuucaccauuagcagagacaauuccaaagauacacucuaccugcaaaugaacucucuucgggccgaagacaccggcguuuauuacugcgccagccuggauuaugacuuuuccuacuacuaucaucgcgaugugugggggccuggaacaaccgucacagugagcucu

SEQ ID NO: 43185 - RNA, 366 nt, Artificial Sequence
  derived and/or modified sequence opt5 from anti-influenza_Chain
caggugcaacuggucgagagcggcgggggacucguucagcccggcgggucccugagacuuucuugcgccgcuagcggauucaccuuuuccgacuacuggauggugugggugcggcaggccccuggcaaggggcuggucugggugucucgcaucagcuccgauggaucuacaacgagcuaugcggacuccguuaaaggcccguucaccauuagcagagauaacgcuaagaauacacucuaccugcagaugaacucucuucgggccgaagacaccgccguguauuacugugcucgcgucgccacacccuauuacuaugaguccggcuuugauuacugggggcaaggagcucuggugaccguuagcucu

SEQ ID NO: 43186 - RNA, 369 nt, Artificial Sequence
  derived and/or modified sequence opt5 from anti-influenza_Chain
caguuccaacuggugcagagcggccccgaggucaagaaaccugggaccuccguuaaggugucuugcaaagccagcggauacacauccacgaccuauggcaucucuugggugagacaggucccggggcagggacucgaauggaugggcuggauuaaccccuacaaugggaacccucacuauggacaaaaguuucagggccgggugacacugacccgcgacacaagcaccaauacagcuuaccuugagauccugucccucagaucugaugacaccgccguuuauuacugugcgcgggauggcugggggcagcagcuggugcccuauuacuucgacuacuggggacaaggcacgcuugucaccgugagcucc

SEQ ID NO: 43187 - RNA, 369 nt, Artificial Sequence
  derived and/or modified sequence opt5 from anti-influenza_Chain
caggugcaacuggcccagagcggcgcugaggucaagagacccggguccucuguuaaagugagcugcaccgccuccggaggcaucuuccggaagaacgcgauuucuugggugcgccaggcuccugggcagggacucgaauggaugggcgggaucauugccgucuuuaauacagccaacuacgcucaaaaauuccagggaagagugaagaucacggccgacgagagcggcaauaccgcuuauauggaacuguccucucuucggagcgaugacacagccguuuacuauugugcgucccacccgaaauacuuuuauggcagcgggucuuaccccgauuucuggggacagggcacccuggugacagucuccagc

SEQ ID NO: 43188 - RNA, 369 nt, Artificial Sequence
  derived and/or modified sequence opt5 from anti-influenza_Chain
caggugcaacugcaggagagcggccccgggcucgucaagccuuccgaaacccugucucuuacaugcacgguuagcagaggauccaucggccacuacuucuggucuuggauucggcagccgcccgggaaaggacuggaguggaucggcuauauuagcuacuccgggucuaccaaguauaacccuagccuccgcuccagagugacaaucagcguggacaccucuaaaaaucaguuuucccugaaccuuaauagcgucacagccaccgauacagcucuguacuauugugcccgggaagacuacgauauucucaccggagcgggccccggcauggaggugugggggcaaggaacgaccguuacagugucuucc

SEQ ID NO: 43189 - RNA, 369 nt, Artificial Sequence
  derived and/or modified sequence opt5 from anti-influenza_Chain
caggugcaacugcaggagagcggccccgggcucgucaagccuuccgaaacccugucucuuacaugcacgguuagcggagccuccaucaacucucacuacuggagcuggauuagacagccgcccggcaaagggcuggaguggaucggauauguguacuauuccggcucuaccacauacaauccuagccucaagucccgggugacccugagcgucgacacaucuaaaaaccaguucucccuuaaucugagcucugugaccgcugccgauacagcguuuuauuacugugcucgccaucccuaugacguucucaccggguccggagauugguucgacccuuggggccaaggcacgcuggugaccgucagcucu

SEQ ID NO: 43190 - RNA, 369 nt, Artificial Sequence
  derived and/or modified sequence opt5 from anti-influenza_Chain
caggugcaacugguccagagcggcgccgagguuaagagacccggguccucugugaaagugagcugcaccgcuuccggaggcaucuuccggaagaacgccauuucuuggguccgccaggcgccugggcagggacucgaauggaugggcgggaucauugcuguguuuaauacagccaacuacgcccaaaaauuccagaauagaguuaagaucacggcugacgagagcggaaacaccgccuauauggaacuguccucucuuacaagcgaugacaccgcuguguacuauugugccucccacccgaaauacuuuuauggcagcggcucuuaccccgauuucugggggcagggaacacuggucaccguguccagc

SEQ ID NO: 43191 - RNA, 369 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucagaucuuacgccgucagcugggugcggcaagcgccugggcagggacucgaauggaugggcgggaucauugcuaucuuuggaacaacgaacuaugcccagaaauuccaggaccgcguuaccauuacagccgaugaccugccguccaccgcuuacauggagcuuacaucucugagaagcgaagauaccgccguguauuuuuguguccggggccgcggcuacuaucucgggggagacuacggcucccuggauagcugggggcaaggaacacuugugaccguuucu

SEQ ID NO: 43192 - RNA, 369 nt, Artificial Sequence
  derived and/or modified sequence opt5 from anti-influenza_Chain
gaggugcagcuggucgaaagcggcgggggacucguucaacccggcagaucccugcggcuuucuugcguggggagcggauucaacuuugacggcuacgccaugcagugggugcgccaggucccugggaagggacuggaguggguguccggcaucucuuggcacagcgauuccaccggcuaugcugacucuguuagagggcgguucacaauuagccgcgauaaugccaaaaacucccucuaccugcagauggacagccuuagaccggaagauacggcguuuuauuacuguggaaagucuaucggccaugucgggggauccuaucggcaccccauugacuacuggggccaagggacccuggugacagugagc

SEQ ID NO: 43193 - RNA, 369 nt, Artificial Sequence
  derived and/or modified sequence opt5 from anti-influenza_Chain
caggugcaacugcaggccagcggccccgggcucgucaagccuuccgagacccugucucuuacaugcacgguuagcggagacuccaucaccucuggcgcuuacuauuggacauggauuagacagcacccggggaaaggacuggaauggaucggcuacauuuauuacagcgggaacaccuauuacaaucccucccucaagucucgggugacaaucagccuggauaccuccaaaaaccaguucagccuuaaggucaauucugugacagccgcggacaccgcuguguauuacugugcccgcgccgcuuccacgagcguucugggauacggcauggauguguggggccaagggaccacagucaccgugucuucc

SEQ ID NO: 43194 - RNA, 369 nt, Artificial Sequence
  derived and/or modified sequence opt5 from anti-influenza_Chain
caggugcaacugguccagagcggcgccgagguuaagaaacccggguccucugugagagugagcugcaaggcuuccggaucuaucuuccggaacuacgccaugagcuggguccgccaggcgccuggccaggggcucgaauggaugggaggcauuaucgcuauuuuugggaccccgaaauaugcccaaaaguuccagggaagagugacaaucacggccgacgaguccaccucuacaguuuacauggaacugagcggccuucgguccgaggauaccgcuauguauuacugugcccgcauuccccacuauaauuuuggcagcgggucuuacuucgacuauuggggacagggcacacuggugaccgucuccagc

SEQ ID NO: 43195 - RNA, 369 nt, Artificial Sequence
  derived and/or modified sequence opt5 from anti-influenza_Chain
cagcugcaacuccaggagagcggccccagacuggugaagccuuccgaaacccuuucucugacaugcagcgucuccgggguuucuaucagcuccucuaacuacuauuggggauggauucggcagccgcccggcaaagggcucgaguggaucggaacgauuuaccacagcggcuccaccuauuacaauccuagccugaagucucgccuuaucauuuccguggacacaagcaaaaaccaguucuaucugcaacucaccucucugacagccgcugauuccgccguguacuauugugcgaccgggggaggcuuuggcuggagccagacauacuucggguacuggggacagggcacccuggucacggcuucuucc

SEQ ID NO: 43196 - RNA, 369 nt, Artificial Sequence
  derived and/or modified sequence opt5 from anti-influenza_Chain
gaggugcagcugcaacagagcggccccgaacucgucaagccuggggccuccguuaaaaugucuugcaaggcuagcggauacaccuucacauccuuuaucauguauugggugaaacagaagccgggccaggggcuggaguggcuuggauacauugaccccuauaacgauggcacgaaauacaaugaaaaguucgaggggaaggccacccugacaucugacaaaagcuccucuaccgcguauauggaacucagcucccugacaagcgaggauucugcuguguacuauugugccaagagaggaaacuacggcaauggcuuugccuacugggggcaaggaacccuugucacaguguccgcugccaaaaccagc

SEQ ID NO: 43197 - RNA, 369 nt, Artificial Sequence
  derived and/or modified sequence opt5 from anti-influenza_Chain
caggugcaacugcucgagagcggcggggacgucguucagcccggaaccucccugagacuuucuugcgccgcuagcggcuucucccuguggacaucugggaugcacugggugcggcaggccccuggaaagggccucgaauggguggcggucaugagcuacgaugagacgaaaaaguauuacgcugacuccgugcgcgggagauuuucuaucagccgggauaacucccgcaauacccuguaucuucagaugaacagccugagaguugaagacacagccguguacuucugugccaaaccgcggcucgauuaucuggacuacuuucaugcugccgauucuuggggacaaggcacccuggucuccgugagcucu

SEQ ID NO: 43198 - RNA, 369 nt, Artificial Sequence
  derived and/or modified sequence opt5 from anti-influenza_Chain
caggugcaacuggucgagagcggcgccgaaguuagaaaacccggggagucccuccggaucucuugcaaagcucacggagacagcuucaccuccuacuggauuggcugggugcgccagcugccugggaagggacuugaauggauggccgugaucuauccgagagauucugagacaaaauuuagccccgcguuccacggccaggucuccauuucuguggacaagagcacguccaccguucaucugcaguggaacagccucaaggcuucugauacagccguguacuauugugcccgguccccuggguacagcggauaucuguacggcugguuugaccccuggggccaagggaccccugucacagugucuucc

SEQ ID NO: 43199 - RNA, 369 nt, Artificial Sequence
  derived and/or modified sequence opt5 from anti-influenza_Chain
caggugcaacuggucgagagcggccccgggcucguuaagccuuccgaaacccugucucuuacaugcacggugagcggagacuccgugaucaacucugccuacuauugggauuggauucggcagccgcccggcaaagggcuggagugggucggaagcguguacuauuccggcaucaccuacuauaauccuucucucaagagccggguuacaauuuccguggacaccagcaaaaaccaguucucucugcgccuuuccuacgucacagcugccgauaccgcgcuguauuacugugcuagaagagggggaggcuggcaguacuauuacggcauggacgugugggggcaaggaacaaccguuacggugagcucu

SEQ ID NO: 43200 - RNA, 369 nt, Artificial Sequence
  derived and/or modified sequence opt5 from anti-influenza_Chain
caggugcaacugguccagagcggcgccgagguuaagaaacccggggcuuccgugaaggugucuugcaaagccagcggauacaucuucaccggcuauuacauucacugggucagacaggcgccugggcagggacucgaauggaugggccggaucgacccgaacggguccggaacaacguaugcucaaaaguuucagggccgcgugacccugacaauggauaccucuauuacaaccgccuacauggagcuuagcagacugcgguucgacgauacagccaucuauuacugugcucgcugggacuggaauuuugaucucuaucugggcugguucgaccccugggggcagggaaccccuguuacgguggccucc

SEQ ID NO: 43201 - RNA, 369 nt, Artificial Sequence
  derived and/or modified sequence opt5 from anti-influenza_Chain
gaggugcagcugguccaaagcggcgccgaaguuaagaaacccggggcuuccgugaaggugucuugcaaagccagcggauacaucuucaccggcuauuacauucacugggucagacaggcgccugggcagggacucgaguggaugggccggaucgacccgaacggggcuggaacaacguaugcccagaaguuucaaggccgcgugacccugacaauggauaccuccauuacaaccgccuacauggaacuuucuagacugcgguucgacgauacagcuaucuauuacugugcccgcugggacuggaauuuugaucucuaucugggcugguucgaccccugggggcagggaaccccuguuacgguggcuagc

SEQ ID NO: 43202 - RNA, 369 nt, Artificial Sequence
  derived and/or modified sequence opt5 from anti-influenza_Chain
caggugcaacugguccagagcggcgccgagguuaagaaacccggggcuuccgugaaggugucuugcaaagccagcggauacaccuucaacgcgcaccauaugcacugggucagacaggcuccuggccaggggcucggauggaugggcuggaucgacccgaauaacgaugggacaauuuaugcccaaaaguuucagggacgggugacgcugaccauggacacauccauccauaccgccuacauggaacuuucuggccugcgcuaugaugacacagcuauuuacuauuguguuagaugggccuggaauuucgacuuuuuccucggcugguuugaucccugggggcagggaacccuggugacagucgcuagc

SEQ ID NO: 43203 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacagcgauacaauuuacucccccucuuuucagggacaagucacgaucagcgcugacaacuccauuagcaccgccuaucuucaguggucuucccugaaagcgagcgauacagcuaucuacuauugugccucuggcccuggcuacuccggguaucacuacggaugguucgacaccuggggccaggggacacucgugaccguuagcucu

SEQ ID NO: 43204 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacgcugaugccauuuacagccccuccuuucagggacaagucacaaucucugcggacaacagcauuuccacggcuuaucuucaguggagcucucugaaagccuccgauaccgccaucuacuauugugcuagcggcccuggcuacucuggguaucacuacggaugguucgacacauggggccaggggacccucgugacaguuuccagc

SEQ ID NO: 43205 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggagagcgaaacaauuuacucccccucuuuucagggacaagucacgaucagcgcugacaacuccauuagcaccgccuaucuucaguggucuucccugaaagcgagcgauacagcuaucuacuauugugccucuggcccuggcuacuccggguaucacuacggaugguucgacaccuggggccaggggacacucgugaccguuagcucu

SEQ ID NO: 43206 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacgcugauacaauuuacagccccuccuuucagggacaagucacgaucucugccgacaacagcauuuccaccgcguaucuucaguggagcucucugaaagccuccgauacagcuaucuacuauugugccagcggcccuggcuacucuggguaucacuacggaugguucgacaccuggggccaggggacacucgugaccguuuccagc

SEQ ID NO: 43207 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccggggagcuccgacacaauuuacucucccagcuuucagggacaagucacgaucuccgcugauaacagcauuucuaccgccuaucuucagugguccagccugaaagcgucugacacagcuaucuacuauugugccuccggcccuggcuacagcggguaucacuacggaugguucgauaccuggggccaggggacacucgugaccguuucuucc

SEQ ID NO: 43208 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacagcgaugcuauuuacucccccucuuuucagggacaagucacaaucagcgccgacaacuccauuagcacggcguaucuucaguggucuucccugaaagcuagcgauaccgccaucuacuauugugccucuggcccuggcuacuccggguaucacuacggaugguucgacacauggggccaggggacccucgugacaguuagcucu

SEQ ID NO: 43209 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacacagauacgauuuacagccccuccuuucagggacaagucaccaucucugcugacaacagcauuuccacagccuaucuucaguggagcucucugaaagcguccgauaccgcuaucuacuauugugccagcggcccuggcuacucuggguaucacuacggaugguucgacacauggggccaggggacccucgugacaguuuccagc

SEQ ID NO: 43210 - RNA, 369 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggagagcgacacaauuuacucccccucuuuucagggacaagucacgaucagcgcugauaacuccauuagcaccgccuaucuucaguggucuucccugaaagcgagcgacacagcuaucuacuauugugccucuggcccuggcuacuccggguaucacuacggaugguucgauaccuggggccaggggacacucgugaccguuagcucu

SEQ ID NO: 43211 - RNA, 372 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaucuucauuucucaggccaucagcugggucagacaggcgccugggcaaggacucgaauggaugggcgggauuaucccgauguuuggagcuaccaacuacgcccagaaauuccagggccgggugacaauuacggccgacaaauccaccaauacaguuuauauggagcugucuagccuuaccuccgaagauacagcuguguacuauugugcccgccugggcagcgggucuuaccacaacggacccaauugguuugacccuuggggccaggggacccucgucacaguguccagc

SEQ ID NO: 43212 - RNA, 372 nt, Artificial Sequence
  derived and/or modified sequence opt5 from anti-influenza_Chain
caggugcaacugcaggagagcggccccgggcucgucaagccuuccgaaacccugucucuuaacugcgccguuagcggaggcuccaucucuaauuacuauuggagcuggauuagacagccgcccgggaaaggacuggaguggaucggcuacauuuccuauaacgggcggccuaaguacaaucccucucucacaagccgcgugacgaucuccguggacaccagcaaagaucaguucucucuggaacuuagauccgucacagcugccgacaccgcgcuguauuacugugcucgggagacacgcuuuggagaacuccugagcccuuaugaugccuucgagauuuggggccaaggcaccauggugacaguuucuucc

SEQ ID NO: 43213 - RNA, 372 nt, Artificial Sequence
  derived and/or modified sequence opt5 from anti-influenza_Chain
caggugcaacugcaggagagcggccccgggcucgucaagccuuccgaaacccugucucuuacaugcacgguuagcggaggcuccgugucuagcgagaccuacuauugguccuggaucagacagccgcccgggaaaggacuggaauggauuggcuacaucuauuacauugggaacacagacuaucggccuucucucaagagccgcgugaccaucucccuggauacaagcaaaaaucaguucucucuuaagcuguccagcgucaccgccgcugacacagccguguacuauugugcgagaggagcuuacuacgauucuuccggcuaucccgccuuuuacauuuggggccaagggaccaugguuacggugagcucu

SEQ ID NO: 43214 - RNA, 372 nt, Artificial Sequence
  derived and/or modified sequence opt5 from anti-influenza_Chain
caggugcaacugcaggagagcggccccgggcucgucaagccuuccgaaacccugucucuuacaugcgccguuagcggaguguccaucucuaacauugacuucuacuggggcuggaucagacagccgcccgggaaaggacuggaguggauuggcaauaucuauuacacggggauuaccuuuuauaacccuagccucuccucucggguggcuaucagcaucgauacauccaagaaucaguucagccugacccuuacaucugucaccgccgcggacacagcuauguacuauugugcccgccacuacggagauuccgaagccauuaacgacgcuuuugauaucuggggccaaggcaccaugcugacggugagcucu

SEQ ID NO: 43215 - RNA, 372 nt, Artificial Sequence
  derived and/or modified sequence opt5 from anti-influenza_Chain
caggugcaacuggucgagagcggcgccgaaguuaagaaauucggggcuuccgugaaggugucuugcaaagccagcggauacacccucaucgacuauuacaugcacugggucagaguggcgcccggccaggggcuggaguggaugggauggauuaacccuaucaauggcgggacaaacuaugcucagaaguuucagggacggguuacgaugacccgcgauacauccauuaauaccgccuacauggaccuuucuagccugagauccgaugacacagccauguauuacuguacccggggccgcccgaucggcagaaacugggaaccccgggauaaagacuauugggggcaaggaacaccugugaccgucucuagc

SEQ ID NO: 43216 - RNA, 372 nt, Artificial Sequence
  derived and/or modified sequence opt5 from anti-influenza_Chain
caggugcaacugguccagagcggcgccgagguuaagaaacccggguccucugugaccgugagcugcaagacauccggacacacguucaucucuuacgcuauuagcuggcucagacaggccccuggccaggggcuggaauggaugggaggcaucgucccgauuuuugggaccgugaacuauacacaaaaauuccagggacggcuuaccaucacagcggacgaguccaccucuacagcuuacauggaucugagccgccucaccuuugaagacacggccauuuauuucugugccagagaggcuggcuaccauuccagcuuuucuggcguuuauuucgauuacugggggcagggaacccugcuuacaguguccagc

SEQ ID NO: 43217 - RNA, 372 nt, Artificial Sequence
  derived and/or modified sequence opt5 from anti-influenza_Chain
gaggugcagcugcaacagagcggccccgaacucgucaagccuggggccuccguuaaaaucucuugcaaggcuagcggauacaccuucacagacuauaacaugcacugggugaaacagucccugggcaagucucuugaguggauuggguacaucuauccgaauaacggaggcacgggguacaaucagaaauuugaaagcaaggccacccugacaguggauaacuccucuagcaccgcguauauggagcucagaacacugaccuccgaagacagcgcugucuacuauugugugcggucuggagccuacuacuucaauuaucuuguucccuacuuugauuauuggggccaaggcacaacccugacgguguccagc

SEQ ID NO: 43218 - RNA, 372 nt, Artificial Sequence
  derived and/or modified sequence opt5 from anti-influenza_Chain
gaggugcagcugcaacagagcggccccgaacucgucaagccuggggccuccguuaaaaucucuugcaaggcuagcggauacaccuucacaggcuauaacaugcacugggugaaacagucccaugggaagucucuggaguggauuggaaaaaucuacccgaauaacggcgugacgggguauaaucaggaauuuagaagcaaggccacccuuacagucgacaacuccucuagcaccgcguacauggagcugcggucccucacaagcgaagauucugcuauuuauuucugugugcgcuccggagccuacuauguuaauuaccuggugcccuacuuugacuauuggggccaaggcaccacacuuaccgucagcucu

SEQ ID NO: 43219 - RNA, 375 nt, Artificial Sequence
  derived and/or modified sequence opt5 from anti-influenza_Chain
caggugcaacugguccagagcggcgccgagguuaagaaacccggguccucugugaaggugagcugcaaggcuuccggagucaccucuagcaacuacccuaucacaugggugagacaggccccgggccaggggcucgaauggaugggaggcguucugccccuuuucggggugacgaauuaugcgcaaaaauuucagggacgggucaccauuuccgcugacaaaucuacaaacaccgccuacauggagcugagcucccuccgcagcgaagauacagccguguauuacugugcuagaggcaagcggccuggcuauugcucugggggaguuuguuccagcgacuacuggggccaggggacccuggugacagucucuucc

SEQ ID NO: 43220 - RNA, 375 nt, Artificial Sequence
  derived and/or modified sequence opt5 from anti-influenza_Chain
caggugcaacugcaggagagcggccccgggcucgucaagccuucccagacccugucucuuacaugcacgguuagcggaggcuccaucucuagcgggaccuacuauugguccuggauuagacaccauccgggaaaaggccuggaauggaucggguacauuuaucacucuggaagcgccuacuauaaccccucccucgagagccgggugacaaugucuguggacaccuccaagaaucaguucagccugaaacuuucuuccgucacagcugccgauaccgcgaucuacuauugugcucgcgccgaaaaccugcucagcccuuaccuggccgagggcuuugaccccuggggccaagggacacuggugaccguuucuucc

SEQ ID NO: 43221 - RNA, 375 nt, Artificial Sequence
  derived and/or modified sequence opt5 from anti-influenza_Chain
gaggugcagcugguccaaagcggcgccgaaguuaagaaacccggggagucccucaagaucucuugccaggcuagcggauacuccuucaccucuagauggauuggcugggugcggcagaugccugggaaaggacuggaaugggugggcuuuaucuauccgagcgacuccgauguccgcuacucucccagcuucagaggacaggugacaauuuccgccgacaagagcaucucuacggcguaucuucaaugguccagccugaaggcuucugauaccgccauguacuuuugugcccggcucgggggcaacaaagacuauggcgauuaccugugguauuucgaccuuugggggcgcggagcucugguuacaguguccagc

SEQ ID NO: 43222 - RNA, 375 nt, Artificial Sequence
  derived and/or modified sequence opt5 from anti-influenza_Chain
caggugcaacuggucgagagcggcgggggaguugugcagcccggcagaucccuccggcugucuugcgccgcuagcggguucaccuuuuccucuuacggaaugcacugggugcgccaggccccuggcaaggggcuugaaugggucgcggugaucugguaugacggagauaacaaauacuauggcgacagcguuaagggcagauucacaauuucccgggauaauucuaaaaacacgcuguuucuccagaugaauagccugcgcgcugaggacaccgccguguacuauugugccaaggauacagcugaccauggggauuacgucgaccuuggauucuuugaugccuggggccaagggacccuggugacaguuuccagc

SEQ ID NO: 43223 - RNA, 375 nt, Artificial Sequence
  derived and/or modified sequence opt5 from anti-influenza_Chain
gaggugcagcugguccaaagcggcgccgaacucaagaugcccggggagucccugaaaaucucuugcaaggcuagcggauacaccuucacaaacuauuggauuggcuggguuagacagacgccugggaaaggacuugaauggaugggcaucauuuuuccgcccgacucccagaccucuuacagcccuuccuuccaggggcaagugacauuuucuguggauaauagcaucuccgucgccuauauucaguggagcucucugaaggcguccgacaccgcuaucuacuauugugcccggagcggaaucuucgauuggucugcuccccucguggaggccuuugacauuuggggccagggcacaguugugaccgucuccagc

SEQ ID NO: 43224 - RNA, 375 nt, Artificial Sequence
  derived and/or modified sequence opt5 from anti-influenza_Chain
gaggugcagcugguccaaagcggcgccgaaguuaagaaacccggggagucccucaagaucucuugcaaaggaagcggcuacuccuucucugacuauuggauugggugggugagacagaugccuggagaaggccuggaguggauggggaucauuuacccggcuagcuccgaaauccgguauucucccagcuuucagggacuugugaccauuuccgccgauaagagcaucaacacagcgucucugcagugguccagccucaaagccucugacacggcuaucuacuauugugcccgccacgcuuccugcagcgccagaucuuguuacuggggcccugucgauuauuggggccaagggacccuggugacaguuuccagc

SEQ ID NO: 43225 - RNA, 375 nt, Artificial Sequence
  derived and/or modified sequence opt5 from anti-influenza_Chain
caggugcaacuggucgagagcggcgggggaguugugcagcccggcagaucccuccggcugucuugcgccgcuagcgaaaucaccuucauuacauacgccaugcacugggugcgccaggcgccugggaagggacuugagugggucgcucugaucuccgacgauggcucuaacaaauuuuaugccgacagcgugaaggggagauucacgauuucccgggauaauucuaaaaacacccucuaccugcagaugaauagccuucgcgccgaagacacagcugccuauuacugugcuagagagggaguuuauuuugauuccggcaccuaccggggcuauuucgacuacugggggcaagaaacacuggugaccgucagcucu

SEQ ID NO: 43226 - RNA, 375 nt, Artificial Sequence
  derived and/or modified sequence opt5 from anti-influenza_Chain
caggugcaacugcaggagagcggccccgggcucgucaagccuucccagacccugucucuuacaugcacgguuagcggaggcuccaucucuagcgggaacuacuauuggaauugggugagacagcacccgggaaaaggccuggaauggauuggguacaucuauuaccggggauccaccuucuauaaccccucucucaagagccgcgugacaauuuccaucgacaccagcaaaaaucaauuuucucugagacuuuccagcgucacagccgcugauaccgccguguacuauugugcgaaggacacacggucuucccuggauaacuaccaguacggcauggacguuuggggccaggggaccacggugaccgucagcucu

SEQ ID NO: 43227 - RNA, 375 nt, Artificial Sequence
  derived and/or modified sequence opt5 from anti-influenza_Chain
gaggugcagcugcucgaaagcggcgggggacugguccaacccggcgggucccuuagacugucuugcgccgcuagcggauucuccuuuucuaccuacgccaugagcuggguucggcaggcgccuggcaaggggcucgaguggguguccggaaucucuggcagcggcgaauccacauauuacgcugacagcgugaaagggcgcuucacggucucuagagauaacuccaagaauacccuguaucuucagaugaacagccugcgggccgaggacacagccguguacuauugugcuaaacagggagaucacauugccuggcuccugcgcggcaucaauuuugacuacugggggcaaggaguucuggugaccgucucuucc

SEQ ID NO: 43228 - RNA, 375 nt, Artificial Sequence
  derived and/or modified sequence opt5 from anti-influenza_Chain
caggugcaacuggucgagagcggcgggggaguugugcagcccggcagaucccuccggcugucuugcgccgcuagcggguucgccuuucacaaucgcgcgaugcauugggugagacaggcuccuggaaagggccuugaaugggucgcccugaucuacuucgacggguccaaacaguauuacgccgauucugugaagggacgguuuaccauuagccgcgacaauuccaaaaacacaguuuuccuccaaaugaacucucugagaccggaggauacggcuguguauuacugugccguccccggcccuaucuuuggcauuuuucccccuuggagcuauuucgaccacugggggcagggaauccuugugaccguuuccagc

SEQ ID NO: 43229 - RNA, 375 nt, Artificial Sequence
  derived and/or modified sequence opt5 from anti-influenza_Chain
gaggugcagcuggucgaaagcggcgggggaguugugcaacccggcagaucccuccggcugucuugcgccgcuagcggguucgccuuucacaaucgcgcgaugcauugggugagacaggcuccuggaaagggccuugagugggucgcccugaucuacuucgacggguccaaacaguauuacgccgauucugugaagggacgguuuaccauuagccgcgacaauuccaaaaacacaguuuuccuccagaugaacucucugagaccggaagauacggcuguguauuacugugccguccccggcccuaucuuuggcauuuuucccccuuggagcuauuucgaccacugggggcaaggaauccuugugaccguuuccagc

SEQ ID NO: 43230 - RNA, 375 nt, Artificial Sequence
  derived and/or modified sequence opt5 from anti-influenza_Chain
gaggugcagcugguccaaagcggagggggaguugugcagcccggcaagucccucagacugucuugcgccgcuagcgggcuuaccuucuccucuuacgccgugcacuggguccggcaggcgccuggaaaaggccuggaaugggugacacucaucagcuaugacggggcuaaccaguacuaugccgauuccguuaagggacgcuuuacgauuucuagagacaauagcaaaaacaccguguaccugcaaaugaacucccuucggccggaggauacagccgucuauuacugugcugugcccggcccuguuuucggcaucuuucccccuuggagcuauuucgacaauugggggcagggcauucuggugaccgucucuucc

SEQ ID NO: 43231 - RNA, 375 nt, Artificial Sequence
  derived and/or modified sequence opt5 from anti-influenza_Chain
caggugcaacuggucgagagcggagggggaguugugcagcccggcaagucccucagacugucuugcgccgcuagcgggcuuaccuucuccucuuacgccgugcacuggguccggcaggcgccuggaaaaggccuggaaugggugacacucaucagcuaugacggggcuaaccaguacuaugccgauuccguuaagggacgcuuuacgauuucuagagacaauagcaaaaacaccguguaccugcaaaugaacucccuucggccggaggauacagccgucuauuacugugcugugcccggcccuguuuucggcaucuuucccccuuggagcuauuucgacaauugggggcagggcauucuggugaccgucucuucc

SEQ ID NO: 43232 - RNA, 375 nt, Artificial Sequence
  derived and/or modified sequence opt5 from anti-influenza_Chain
caggugcaacuggucgagagcggagggggaguugugcagcccggcaaguccccuagacucucuugcgccgcuagcgggccgaccuucuccucuuacgccgugcacuggguccggcaggcgcccggaaaaggccuggaaugggugacacuuaucagcuaugacggggcuaaccaguacuaugccgauuccguuaagggacgcuuuacgauuucuagagacaauagcaaaaacaccguguaccugcaaaugaacucccuccggccugaggauacagccgucuauuacugugcugugcccggcccuguuuucggcaucuuucccccuuggagcuauuucgacaauugggggcagggcauucuggugaccgucucuucc

SEQ ID NO: 43233 - RNA, 375 nt, Artificial Sequence
  derived and/or modified sequence opt5 from anti-influenza_Chain
gaggugcagcuggucgaaagcggagggggaguugugcaacccggcaagucccucagacugucuugcgccgcuagcgggcuuaccuucuccucuuacgccgugcacuggguccggcaggcgccuggaaaaggccuggagugggugacacucaucagcuaugacggggcuaaccaguacuaugccgauuccguuaagggacgcuuuacgauuucuagagacaauagcaaaaacaccguguaccugcagaugaacucccuucggccggaagauacagccgucuauuacugugcugugcccggcccuguuuucggcaucuuucccccuuggagcuauuucgacaauugggggcaaggcauucuggugaccgucucuucc

SEQ ID NO: 43234 - RNA, 375 nt, Artificial Sequence
  derived and/or modified sequence opt5 from anti-influenza_Chain
caggugcaacugguccagagcggcgccgagcucaagagacccggggcuuccguuaaagugucuugcaagaccagcggauacuccuucaacaauuauggcaucaacugggugcggcaggccccugggcagggacuggaauggaugggcuggauuucugcguacacagggaauacgcacuaugcuaaaaacuuugagggacgcgucacccuuacaaccgacacaagcaccuccacagccuacauggaagugagaucucugcggagcgaugacuccgccguuuauuucugugcucgcgccaugauccaaggcguggucacccucuaccugagaccgggcgauuauugggggcagggaacgcuugugaccguuagcucu

SEQ ID NO: 43235 - RNA, 375 nt, Artificial Sequence
  derived and/or modified sequence opt5 from anti-influenza_Chain
caggugcaacugguccagagcggcgccgagguuaagcagcccggggcuuccgugaaagugucuugcaaggccagcggauacaccuucaacgcguauuacauccacugggucagacaggcuccuggccaagggcucgaauggaugggauggauuaauccgaacuuuggcgggacacauuaugcccggaaauuccagggacgcgugacgaugaccagagacgccuccaucaauacagcuuacauggagcuggaucggcuuauuucugacgauaccgccguuuauuacugugugcgcuggagagcugccgcggucaucauggaccaguuuuauaagauggauguguggggccagggcacacugguuaccgugagcucc

SEQ ID NO: 43236 - RNA, 375 nt, Artificial Sequence
  derived and/or modified sequence opt5 from anti-influenza_Chain
caggugcaacugguccagagcggccccgagcucaagaaaccuggguccucuguuaagcugagcugcauggccaccggaggcacauucaucaacuacgcuuuuuccugggugagacaggccccggggcagggacuugaauggcugggcgggauuauccccguguauggaacgucuaaucacgucgagaaacuccaaggccgggugaccauuacagcggacgcuagcaccaacacagccuacauggaacuguccggccuucgcuucgaugacaccgccguuuauuuuugugcugccucuacagcuaccagcgggacguacuaugccaugagaccuuucgauuuuuggggacagggcacccugguguccgucagcucu

SEQ ID NO: 43237 - RNA, 378 nt, Artificial Sequence
  derived and/or modified sequence opt5 from anti-influenza_Chain
gaggugcagcuggucgaaagcggcgggggaguugugcaacccggcgggucccucagacugucuugcaucgccagcgcuuucaaccuuggaauuuuuggcaugcacugggugcggcaggccccugggaagggacuggagugggucgcguucauccgcuacgacggcggcaaaaccuuuuaugcugauuccgugaaggggagauucacaauuucucgggacaauagcaaaaacacgcucuaccugcagaugaacucccuucgcaccgaagauacagcccuguauuacugugccagagacgcuaccgccgauuauuacggaccgggcucuuaucccaauuggcucgacccuugggggcagggaacacugguuaccgugagc

SEQ ID NO: 43238 - RNA, 378 nt, Artificial Sequence
  derived and/or modified sequence opt5 from anti-influenza_Chain
gaggugcagcuggucgaaagcggccccgcccucguuaagccuacccaaacacugacgcuuaccugcuccuucucuggguuuagccuguccacaucuggaaugagcguguccuggaucagacagccgcccggcaaagcucucgaguggcuggcccuuauugacugggaugacgauaccuacuauaucacauacucuagcucccugaagacccggcucacaauuagcaaagacaccucuaagucccaggugguccugacgaugaccaacauggauccuguggacacagcgaccuauuacugugcucgcacacugagaguuagcggggauuaugugcgggacuucgaucucuggggacgcggcacccuggucacggugucu

SEQ ID NO: 43239 - RNA, 378 nt, Artificial Sequence
  derived and/or modified sequence opt5 from anti-influenza_Chain
caggugcaacugcaggagagcggccccgggcucgucaagccuuccgaaacccugucucuuacaugcacgguuagcggaggcuccaucaacucuuacuauuggaauuggauuagacagccgcccgggaaaggacuggaguggaucggcuacauuuaucacagcggguccaccaacuacaauccuucucucaagagccgggugacaaucuccguggacaccagcaaaaaccaguucucucugcaacuuuccagcgucacagccgcugauaccgccguguauuacugugcgcgccugagaacagacuauggagaucccgacucuguuuacuacuauggcauggauguguggggccaggggaccacggucaccguguccagc

SEQ ID NO: 43240 - RNA, 378 nt, Artificial Sequence
  derived and/or modified sequence opt5 from anti-influenza_Chain
caggugcaccugguccaaagcggcgccgagguuagaaagcccggggacuccgugaaagugucuugcaagaccagcggauacacauucuccacguauccugucgcuugggugcggcagguuccgggccaggggcucgaauggaugggauggaucucuaccuacaacggcaauacaaacuuugcccagaauuuccaagggcgcgugacccugacaaccgauacaaccacgaacaccgcguauauggaggucagaagccuuaaauuugacgauacagcuguguacuauugugcccggguugaaggauccuaccgcgacuucuggaauaaccagaauagauuugaucccuggggccagggcacccuggugacagucucuagc

SEQ ID NO: 43241 - RNA, 378 nt, Artificial Sequence
  derived and/or modified sequence opt5 from anti-influenza_Chain
gaggugcagcuggucgaaagcggcgccgagguuaagaaacccggggcuuccgugaaggugucuugcaaagccagcggauacaccuucacauccuuugacaucaacugggucagacaagcgccuggccaggggcucgaauggaugggauggaugacgccgaccucuggcaagacaggguaugcucagaaauuccagggacggauuaccaugacacgcaauaccagcaucaacacagccuacauggagcuguccucucuuagaagcgaagauaccgccguguauuuuugugcucggggccccgagcgcagaacgaccauuuucgacguuauccuggauugguuugacccuuggggccaagggacacucgugaccgucucc

SEQ ID NO: 43242 - RNA, 378 nt, Artificial Sequence
  derived and/or modified sequence opt5 from anti-influenza_Chain
caggugcaacugguccagagcggcgccgagguuaagaaacccggguccucugugaaggugagcugcaaagccuccggaggcuucuuuucuagcuacgcuaucuccugggucagacaggcgccugggcagggacucgaauggaugggcggggugauuccgaucuuccggaccgcuaacuaugcccaaaauuuucagggacgcguuacaauuacggccgacgaguucaccucuuacauggaacugagcucccuuagaagcgaugacacagcuguguauuacugugcccggcugaacuaucacgauucuggcaccuacuauaaugcuccccgcggcugguuugacccuugggggcagggaacacucgucaccguguccagc

SEQ ID NO: 43243 - RNA, 378 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcgccuucucuaacuacgcgaucagcugggucagacaggcuccugggcagggacucgaauggaugggcgggauuaucccgauuuuuggaaccacaaauuaugcccaaaaauuccagggccgggugacgaucaccgccgacaaauuuacaaccauugcuuacauggagcugcgcucccuuagaucugaagauacagccguuuauuacugugcucggcacggcgggguguauuacuauggaagcgccuccagcggcugguucgaccccugggggcagggaacccuggucacagugucuucc

SEQ ID NO: 43244 - RNA, 378 nt, Artificial Sequence
  derived and/or modified sequence opt5 from anti-influenza_Chain
caggugcaacugcucgagagcggcgggggagucguuagacccggccggucccugcgccuugccugcgcugggucuggauucaccuuuagcgccuacgcgaugcacugggugagacaggcuccuggcaaggggcuggaauggguggcccauacauccuaugacggacgggauucuuacuaugucgacagcgugaaaggccgcuucacgaucuccagagaugacucuaagaacacccucuaccugcagaugaauagccuucggccggaggauacagccguuuauuacugugcuaaagugggccccuauaccggguacgacgauuacaacuauuacggaauggacgucuggggccacgggacaaccgugacaguuuccagc

SEQ ID NO: 43245 - RNA, 378 nt, Artificial Sequence
  derived and/or modified sequence opt5 from anti-influenza_Chain
caggugcaacuggucgagagcggcgggggaguugugcagcccggcgggucccucagacugucuugcgccgcuagcggauucaacuuugacgaauacgugauguauuggguccggcaguccccuggcaaggggcuugagugggugucucugaucggagccgauggccgcggcaccuacaauagcgacuccguuaaagggagauucacaauuucucgggauaaccgcaagaauagccucuaucugcagaugaacucccuuagaagcgacgauacggcgcuguacuauugugcuaaaguggaacggucuuuuuacgacggauccggcuauggggaugcccucgagaucuggggacaaggcaccauggucacagugagcucu

SEQ ID NO: 43246 - RNA, 381 nt, Artificial Sequence
  derived and/or modified sequence opt5 from anti-influenza_Chain
gaggugcagcugcucgaaagcggcgggggacugguccaccccggcgggucccuuagacugucuugcgccgcuagcggauucaccuuuuccaacuacgccaugucuuggguucggcaagcgccuggcaaggggcucgagugggugagcuccaucaauucuggaggcggcgcuacauauuacgccgacagcgugaaagggcgcuucacgauuuccagagauaacagcaagaauacccugucucuucagaugaacucccugcgggccgaagacacagcugucuauuacugugccaaagagggaggcaauaccaucuuugggcucgugacaauggcuuauuacuucgauagcuggggacagggcacccugguuacagugucuucc

SEQ ID NO: 43247 - RNA, 381 nt, Artificial Sequence
  derived and/or modified sequence opt5 from anti-influenza_Chain
cagccccaacugcaggagagcggcccugggcucgugagaccguccgaaacccugucucuuacaugcacggucagcggagacuccguuacccggggcggguucuacuggggauggauccgccagcccccuggcaaggggcuggaguggauuggaucuaucuauuacaacuauaauauuuaccacagccccucccucaaaucuagagugagccuguccguggauacaagcaagaaccaggucucucuuaaacuggccuccgugaccgcugccgacacagcgguuuauuacugugcucggcauuauccuuacuacgaucuccccaccggcuuuuauagccaauucgacuuuuggggccaggggacaccugugaccgucucuucc

SEQ ID NO: 43248 - RNA, 381 nt, Artificial Sequence
  derived and/or modified sequence opt5 from anti-influenza_Chain
ugguggcagcuggugcaaagcggcgccgaggucaagaaacccggguccucuguuaaggugagcugcaaggcuuccggaggcaccuucucuagcuacgacaucuccugggugagacaggccccugggcagggacucgaauggaugggcgggauuaucccgauuuauggaacagcgaacuacgcucagaaauuucaaggccgggucacgaucaccgccgaugagucuacaagcaccgccuauauggaacuguccagccuucgcucugaggacacagcuguguacuauugugccagagcuggcggggauuccagcggauacuauggcgcccuggggcgguucuuucagcacuggggacagggcacccucguuacagugucuucc

SEQ ID NO: 43249 - RNA, 381 nt, Artificial Sequence
  derived and/or modified sequence opt5 from anti-influenza_Chain
gaggugcagcugguccaaagcggcggggccguugugcagcccggaagaucccuccggcugucuugcgcugccagcggcuucaccuuuuccaucuacgcgaugcacugggugcgccagacaccugggaagggacuugaaugggucgcucugauuucuuaugacggcaacaauaaauacuaugccgauagcgugaaggggagauucacgaucucccgggacaacuacaaaaauacccucuaucugcagaugaagggacuucgcgccgaggauacagcucuguacuauugugccagacggauuaccgaaaaaggcuacuacaacgacucuggccgcccgaauugguuugaucccugggggcaaggaacacucguuaccgugagc

SEQ ID NO: 43250 - RNA, 381 nt, Artificial Sequence
  derived and/or modified sequence opt5 from anti-influenza_Chain
caggugcaacugcagcagagcggccccagacucgucaagccuucccagacccugucucuuacaugcgccaucagcggggacuccguuucuggagauagcggcacguggaacuggauucggcaauccccgucucgcgggcuggaguggcucggaagaaccuacuaucggagcaaaugguacaaugacuaugcugaauccgucaagagccgcaucgugauuaaagccgauacaucuaagaacgaguucucccugcagcuuaauagcgugacccccgaagacacagcgaucuacuauugugcuagagccggcgugaaaauuuuugggcugaucguuggagcccucgauaacuggggccggggcacccuggugacagucucuucc

SEQ ID NO: 43251 - RNA, 381 nt, Artificial Sequence
  derived and/or modified sequence opt5 from anti-influenza_Chain
caggugcaacugcagcaguggggcgccgggcuccugaagcccagcgagacccuuucccugacaugcacggucucuggaggcagccucaccgacuacuccuggaacuggaucagacagccuccggggaaaggacuggaauggauuggcgauacacuucacaauggguauaccaacuacaaucccucucugcggggacgcguuagcaucuccauugacacaucuaagaaccaagugagccucagacugaccuccgugacagcugccgauaccgcgcuguauuacugugcucggggcagcggcggguauggaggcuucgacuacuuugggaaacuccgcacgugggauuucuggggacagggcacccuggucacagugucuucc

SEQ ID NO: 43252 - RNA, 381 nt, Artificial Sequence
  derived and/or modified sequence opt5 from anti-influenza_Chain
caggugcaacugguccagagcggcgccgagguuagaaagcccggggaaucccuccggaucucuugccgcggaagcggcuacaacuucccuaaauauuggauugggugggugagacagaugccgggaaagggccuggaguggauggggaugaucuaccccggagacuccgaugugcgguauaauccuucuuuucagggccaagucaccauuagcgcugacgaauccaucaacacagccuaccuucaguggucuagccugcgcacguccgauaccgcgagauauuacugugcucggcaccucggccagcagcuggugagcaauacauauuacuacuaugggauggacguuuggggacaaggcaccacagugaccgucucuucc

SEQ ID NO: 43253 - RNA, 384 nt, Artificial Sequence
  derived and/or modified sequence opt5 from anti-influenza_Chain
cagauccaacugcaggagagcggccccgggcucgugaagccuucccagacccugucucuuacaugcgccauuagcggagacuccgucucuagcaacaaugcuguuuggaacuggaucagacaguccccgucucggggccuggaauggcucgggcgcacguacuauagaagcaaaugguacaaugauuaugccgaguccgucaagagccggauuaccgugaaccccgacacaucuaaaaaucaauucucccugcaccuuaagagcgugaccccugaagauacagcgguguuuuacuguguucgcucuggacauaucaccguguucggcgucaacguggacgcuuuugauaugugggggcagggaacaaugguuaccguguccagc

SEQ ID NO: 43254 - RNA, 384 nt, Artificial Sequence
  derived and/or modified sequence opt5 from anti-influenza_Chain
caggugcaacugcaggagagcggccccgggcucgucaagccuucccagacccugucucuuacaugcgccaucagcggagacuccguuucuagcaacaaugcuguguggaacuggauuagacaguccccgucucggggccuggaauggcucgggcgcacguacuauagaagcaaaugguacaaugauuaugccgaguccguuaagagccggaucaccgucaaccccgacacaucuaaaaaucaauucucccugcaccuuaagagcgugaccccugaagauacagcgguguuuuacugugugcgcucuggacauauuaccgucuucggcgugaacguugacgcuuuugauaugugggggcagggaacaauggugaccgucuccagc

SEQ ID NO: 43255 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacagaguuuccucuaacagcgcuguguggaauuggauucggcaauccccgucucgcggccuggaguggcucgggagaacguacuaucggagcaaaugguacuaugauuacgccgaauccgucaagagccgcaucgugauugaccccgauaccucuaaaaaccaggugucccugcagcuuaauagcguuacaccugaggacucugcgaucuauuacugugcuagaggaggccacauuaccguguucgggcugaacaucgaugccuaugacaucuggggacagggcgccaaggucacaguguccagc

SEQ ID NO: 43256 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacagaguuuccucuaacagcgcuguguggaauuggauucggcaauccccgucucgcggccuggaguggcucgggagaacguacuaucggagcaaaugguacuaugauuacgccgaauccgucaagagccgcaucgugauugaccccgauaccucuaaaaaccaggugucccugcagcuuaauagcguuacaccugaggacucugcgaucuauuacugugcuagaggaggccacauuaccguguucgggcugaacaucgaugccuaugacaucuggggacagggcgccauggucacaguguccagc

SEQ ID NO: 43257 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacagaguuuccucuaacagcgcuguguggaauuggauucggcaauccccgucucgcggccuggaauggcucgggagaacguacuaucggagcaaaugguacuaugauuacgccgaauccgucaagagccgcaucgugauugaccccgauaccucuaaaaaccaggugucccugcagcuuaauagcguuacaccugaggacucugcgaucuauuacugugcuagaggaggccacauuaccgaguucgggcugaacaucgaugccuaugacaucuggggacagggcgccauggugacagucuccagc

SEQ ID NO: 43258 - RNA, 384 nt, Artificial Sequence
  derived and/or modified sequence opt5 from anti-influenza_Chain
caggugcaacugcagcagagcggccccgggcucgucaagccuucccagacccugucucuuacaugcguuaucagcggagacacgguguccucuaacagagccaccuggaauuggaugcggcaaagcccgcugcgcggccucgaguggcuggggagaacauacuaucgguccaaaugguacaacgauuaugcugugucugucaagagccgcgugguuauuaaucccgacaccuccaaaaaccaggugagccuucagcugaauacagucaccccugaugacucuggaguguacuucugugccagaggcgggcacaucacaguuuuuggagugaacauugaugcguucgacaucuggggccucggcaccaaggucacgguguccagc

SEQ ID NO: 43259 - RNA, 384 nt, Artificial Sequence
  derived and/or modified sequence opt5 from anti-influenza_Chain
cagguggagcugcaacagagcggccccgggcucgucaagccuucccagacccugucucuuacaugcgccaucagcggagacuccguuucuagcaacuccgcuacguggaauuggauuagacagucuccgagccggggccuggaauggcucgggcgcaccuacuauagauccaaaugguacaacgauuaugccgacuuccugaagcggcgcaucacaauuaaucccgauaccagcaacaaugaggugucucuuagacugacauccgugaccccugacgauacagcgcucuacuauugugcucggggaggccacaucaccgucuuuggggugaacauugacgccuucgauguuuggggacaaggcacgauggccaccgugagcucu

SEQ ID NO: 43260 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacuccguuucuagcaacuccgcuacguggaauuggauuagacaaucuccgagccggggccuggaguggcucgggcgcaccuacuauagauccaaaugguacaacgauuaugccgacuuccugaagcggcgcaucacaauuaaucccgauaccagcaacaaugaagugucucuuagacugacauccgugaccccugacgauacagcgcucuacuauugugcucggggaggccacaucaccgucuuuggggugaacauugacgccuucgauguuuggggacagggcacgauggugaccgucagcucu

SEQ ID NO: 43261 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacuccguuucuagcuacaacgcuguguggaauuggauuagacaauccccgucucggggccuggaguggcucgggcgcacguauuacagaagcggaugguauaacgauuacgccgaauccgugaaaagccggaucaccauuaaucccgacacaucuaagaaccaguucucccugcagcuuaauagcgucaccccugaggauacagcgguguauuacugugcucgcucuggccacaucaccguuuuuggggugaacgucgacgccuucgauauguggggacagggcacaauggugaccguuuccagc

SEQ ID NO: 43262 - RNA, 384 nt, Artificial Sequence
  derived and/or modified sequence opt5 from anti-influenza_Chain
caggugcaacugcagcagagcggccccgggcucgucaagccuucccagacccugucucuuacaugcgccaucagcggagacuccguuucuagcaacaaugcuguguggaacuggauuagacaauccccgucucggggccuggaguggcucgggcgcacguacuauagaagcaaaugguacaaugauuaugccgaauccgucaagagccggaucaccauuaaccccgacacaucuaaaaaucaguucucccugcagcuuaacagcgugaccccugaggauacagcgguguacuauugugcucgcucuggacacaucaccguuuuuggcgugaaugucgacgccuucgauaugugggggcagggaacaaccgugacgguuuccagc

SEQ ID NO: 43263 - RNA, 384 nt, Artificial Sequence
  derived and/or modified sequence opt5 from anti-influenza_Chain
agaggccagcuggugcaaagcgggggaggcgucguucagcccgggcggucccuccgccugucuugcgccgcuagcggauucguguuuaacguguucggcauccacugggucagacaggccccugggaagggacuugaguggcuggcgaccauuuccuacgacggccucaauaaauauuacgcugauucugugaagggccggaucacaauuagccgcgacaacuccaaaaauacgcuguaucuucagaugaacucucugagagccgaagauaccgccguuuacuauugugugcgggacagcgaggaauccacauacuauggggauuacaugugggucuacaauugguuugaccucuggggacaaggcacccuggugacaguuagc

SEQ ID NO: 43264 - RNA, 384 nt, Artificial Sequence
  derived and/or modified sequence opt5 from anti-influenza_Chain
caggugcaacugcagcaguggggcagcgggcuccugaagcccuccgagacccuuucucugacaugcgccgucuacggaggcagcuucagagacgauuauuggacguggauccggcagccuccggggaaaggacucgaauggauuggcgagaucaaccacuccgggcgcaccaauuacaaccccucucuuaagagcagaguuacaauuuccguggacaccucucugaaacaauuuagccugaaggugaucuccgucacagcugccgauaccgcgguguauuacugugcucggggaacaagccauguuucucgcuauuucgacuggcucccucccaccaauugguuugauccuuggggccagggcacccaggugacggucuccagc

SEQ ID NO: 43265 - RNA, 384 nt, Artificial Sequence
  derived and/or modified sequence opt5 from anti-influenza_Chain
caggugcaacugcagcaguggggcgccgggcuccugaagcccagcgagacccuuucccugucuugcgcugucuucggaggcagcuuuuccgacuacuauuggacauggaucagacagccuccggggaaaggacucgaauggauuggcgagaucaagcacucugggcggacgaacuacaaucccagccuggaaucccgcguuaccauuucuguggauacaagcaaaaaccaauucucccuuaagcugagcucugugaccgccgcggacacagcuaucuauuacugugccagaggaaccgauccugacacagagggcuauugccgguccggcagcuguucugccuuugauuucugggggcagggaacccucgucacgguguccagc

SEQ ID NO: 43266 - RNA, 384 nt, Artificial Sequence
  derived and/or modified sequence opt5 from anti-influenza_Chain
caggugcaacugcagcaguggggcgccgggcuccugaagcccagcgagacccuuucccugacaugcggagucuacggcgggucucucagcgacuauuacugguccuggaucagacagccuccgggaaaaggccuggaauggauuggggagaucaaccacucuggaggcacgaauuauaaccccagccuuaagcggcgcguuaccauuuccguggauacaucuaaaaagcaauucagccugaaaaugaacuccgugaccgcugccgacacagcggucuacuauugugcuagaggcaccgauccugacacagaaguguacugccgggccgggaauugugccgcuuuugauuucuggggacagggcacccucguuacggugagcucu

SEQ ID NO: 43267 - RNA, 384 nt, Artificial Sequence
  derived and/or modified sequence opt5 from anti-influenza_Chain
caggugcaacugcaggagagcggccccgggcucgucaagccuucccagacccugucucuuacaugcacgguuagcggagacuccaucucuagcguggaucacuacugguccuggauuagacagcauccggugaaaggccuggaauggaucggguucauguauuacucugccagcaccuauuacaaccccucccucaagagccgggucacaauuucuaccgacacauccaaaaaucaauuuagccugcgccuuucuuccgugaccgcugccgauacagcgguuuauuacugugcuagaggaaccugcgccggcgacuguagccugcacuauuacuacuaugggcucgauguguggggacagggccggacggucaccgugucuucc

SEQ ID NO: 43268 - RNA, 384 nt, Artificial Sequence
  derived and/or modified sequence opt5 from anti-influenza_Chain
gagguggcccuggucgaaagcggcgcugagguuaagaaacccggguccucugugaaggugagcugcaaagccuccggacacaucuucucuggcuacgcgauuagcugggucagacaggcuccugggcaaggacucgaauggaugggcgggaucauuccgaucuuuggaaccacaaacuaugcccagaaguuccagggccgggugacgauuaccgccgaccaguccacaucuaccgcuuacauggaucugagcaaucuucgcuccgaggacacagccguuuauuacugugcuagagugaaagauggcuauugcacccugacaagcugucccgucgggugguacuuugaccucuggggacggggcacccuggugacgguuucuucc

SEQ ID NO: 43269 - RNA, 384 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggacacaucuucucuggcuacgccauuagcugggucagacaagcgccugggcagggacucgaauggaugggcgggaucauuccgaucuuuggaaccacaaacuaugcucagaaauuccagggccgggugacgauuaccgccgaccaauccacaucuaccgccuacauggaucugagcaaucuucgcuccgaggacacagcuguuuauuacugugccagagugaaagauggcuauugcacccugacaagcugucccgucgggugguacuuugaccucuggggacggggcacccuggugacgguuucuucc

SEQ ID NO: 43270 - RNA, 384 nt, Artificial Sequence
  derived and/or modified sequence opt5 from anti-influenza_Chain
caggugcaacugguccagagcggcgccgagguuagaaagcccggggcuuccgugaaagugucuugcaaggccagcggauacaccuucacacggcacggcaucuccuggguccgccaggcgccugggcagggacucgaauggaugggcuggauuucugcuuauacgggggacaccgauuacgcccaaaaauuucagggaagagugacaaugaccacagacaccagcacaaacaccgccuauauggagcugcggucccuucgcucugaugacgcugccguuuacuauugugcuagacugcggcuccagggcgaaguggucgugccgcccagccaguccaauugguucgauccuuggggccaagggacgcugguuaccgugagcucu

SEQ ID NO: 43271 - RNA, 384 nt, Artificial Sequence
  derived and/or modified sequence opt5 from anti-influenza_Chain
caggugcaacuggucgagagcggccccgggcucaugaagccuuccgaaacccugucucuuacaugcacgguuagcggaggcuccgugucuaacuacuauuggagcuggaucagacagccgcccgggaaaggacuggaguggauuggcuacguguucuauuccgggucuagcaauuacaacccuucccucaauaaccccagccugaagucucgggucaccaucuccauugacacaagcaauaaccaguuuucucuuaaacuguccagcgugaccgccgcugauacagccguuuauuacugugcgcgcggaagagucaauucuggcuaugacuggggcccuaacuucgauuccugggggcagggagcucucgugaccgugagcucc

SEQ ID NO: 43272 - RNA, 384 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaccuucucuuacuaugccaucagcugggucagacaggcgccugggcagggacucgaauggaugggcgggauuaucccgauugugggaacagcucacuacacgcaaaaauuucagggccggguuaccaucacagccgacgaguccaccucuacagccuauauggaacugagcucccuucgcagcgaggauaccgcuguguacuucugugccagagcugccgacgaaucugucgagucccugacaauuaaagcguuucggaccaacuaucauuggggccaggggacgcucgugaccguuagcucu

SEQ ID NO: 43273 - RNA, 387 nt, Artificial Sequence
  derived and/or modified sequence opt5 from anti-influenza_Chain
gaggugcagcuggucgaaagcggcgggggagccguucaacccggcgagucccucaagcugccuugcgcugccucuggguucaccuuuagcaacuacggaaugcacugggugagacaggcgccgggcaaagggcuugaauggguggcugucaucuccuaugacggaucuaauaaguacuaugccgauagcgugaaaggccgguucacaauuucccgcgacaacucuaaggauacgcuguaccuccagaugaauagccugagagccgaggacaccgcucuguuuuauugugccaaagaacggccccuucgccuccugagauacuucgauuggcuguccggcggggcuaacgacuauuggggacagggcacacucguuaccgugagcucu

SEQ ID NO: 43274 - RNA, 387 nt, Artificial Sequence
  derived and/or modified sequence opt5 from anti-influenza_Chain
gaggugcagcuggucgaaagcggcgggggagccguucaacccggcgagucccucaagcugucuugcgcugccagcggguucaccuuuuccaacuacggaaugcacugggugagacaggcgccuggcaaagggcuugaauggguggcugucaucucuuaugacggaagcaauaaguacuaugccgauuccgugaaaggccgguucacaauuucucgcgacaacagcaaggauacgcuguaccuccagaugaacucccugagagccgaggacaccgcucuguuuuauugugccaaagaacggccgcuucgccuccugagauacuucgauuggcugagcggcggggcuaaugacuauuggggacagggcacacucguuaccgugucuucc

SEQ ID NO: 43275 - RNA, 387 nt, Artificial Sequence
  derived and/or modified sequence opt5 from anti-influenza_Chain
caggugcaacuggucgagagcggcgggggaguugugcagcccggcagaucccuccggcugucuugcgccgugagcggguucaccuuuuccucuuacgcuaugcacuggguccgccaggccccuggaaagggccuugaauggguggcgguuaucagcuaugacggguccaaccaguacuaugcugauucugugaaaggaagauucacaauuagccgggacaauuccaagaacacgcuguaccuccaaaugaauagccugcgcgccgaggauaccgcccuuuauuacugugcuaaagacccgagacugcggcaucuccuguauuuucccuucacaucuaugaucuacuuugauuacuggggccagggcacccuggucacaguguccagc

SEQ ID NO: 43276 - RNA, 387 nt, Artificial Sequence
  derived and/or modified sequence opt5 from anti-influenza_Chain
caggugcaacugguccagagcggcgggggaguugugcagcccggcagaucccuccggcugucuugcguggccagcggguucaccuuuuccacauacgcuaugcacuggguccgccaggccccuggaagaggccuugaguggguggcgguuaucucuuaugacgcuaacuacaaguauuacgccgauagcgugaaagggcgguucuccauuucucgcgacaauagccaaaacacgcugcaucucgaaaugaauacccugagaacagaggauaccgcccuuuauuacugugcuaaggacucccagcugcggagccuccuguauuuugaauggcugucucagggauacuucgagccguggggccagggcacacucgucaccgugacaucc

SEQ ID NO: 43277 - RNA, 387 nt, Artificial Sequence
  derived and/or modified sequence opt5 from anti-influenza_Chain
caggugcaacugguccagagcggcgggggaguugugcagcccggcagaucccuccggcugucuugcguggccagcggguucaccuuuuccacauacgcuaugcacuggguccgccaggccccuggaagaggccuugaguggguggcgguuaucucuuaugacgggaacuacaaguauuacgcugauagcgugaaaggacgguucuccauuucucgcgacaauagcaacuccacgcugcaucucgaaaugaauacccugagaacagaggauaccgcccuuuauuacugugccaaggacagccaacugcggucucuccuguauuuugaauggcugucccagggcuacuucgauccguggggccaggggacacucgucaccgugacaagc

SEQ ID NO: 43278 - RNA, 387 nt, Artificial Sequence
  derived and/or modified sequence opt5 from anti-influenza_Chain
caggugcaacugguccagagcggcgccgagguuaagaaacccggguccucugugaccgugagcugcaaggcuuccggaggcacauucucuaacuacgggaucagcugggucagacaggccccuggacagggccucgacuggaugggagggauuaucccgcuguuuggcacggcgaauuaugcucaaaaauuccagggccgggugaccauuacagccgaugaauccaccucuagcuccaacauggagcuuagcucucugcgcuccgaagacacagccguuuacuauugugcuagagaugugcacaauuacgacuuucucaccggguauccccugcaucuuuacggaauggaugucuggggccaggggacaaccgugacgguuagcucu

SEQ ID NO: 43279 - RNA, 387 nt, Artificial Sequence
  derived and/or modified sequence opt5 from anti-influenza_Chain
caggugcaacugcaggagagcggccccgggcucgucaagccuuccgaaacccugucucuuaucugcgccguuagcggagcuuccauuucuagcuccuacuggucuuggaucagacagccgcccggcaaagggcuggaguggauuggauauaucuacuauagcggcgugacaaaguacaacccuucccucaaaagccgggugacgcugucugucgacaccuccaagaaucacuucagccuuaaacugucuuaugugacagccgcggauaccgcuguuuacuauugugcccgcaaccuccccgacauugccguggucacagcugugcaggaugccaccccuguuugguuugaccccugggggccuggaacacugguguccgucagcucu

SEQ ID NO: 43280 - RNA, 387 nt, Artificial Sequence
  derived and/or modified sequence opt5 from anti-influenza_Chain
gaggugcagcuggucgaaagcggcgggggacucguucaacccggcagaucccugcggcuuucuugcgccgcuagcggguucaccuuuuccgacuucuggaugucuugggugcgccaggccccuggaaagggccuggaguggguggcgaacaucgaucaggacgggaaugaaagauuuuacgcugauagcgucaaaggacgguucacaauuucccgcgacaacgccaagaauagccucuaucugcagaugacgagccuuagagccgaugacaccgcuguguacuauugugcccgggauggccgcgagggcuacuuuuauggguccggaucuuucuacaaccugaaaggccucaauugggggcaaggaacacugcugaccguuucuucc

SEQ ID NO: 43281 - RNA, 387 nt, Artificial Sequence
  derived and/or modified sequence opt5 from anti-influenza_Chain
gaggugcugauggucgaaagcggcgggggacucguucagcccggcggguccgugagacugucuugcguggccagcggauucuccuuuucuagccacuggaugaccuggguccggcaagcuccuggcaaggggcuugaguggguggccaauaucgaagacgauggaggcgacaaauacuauguugauuccgugaagggccgcuucauuaucucuagagacaaugcgaaaaacagcgucuaccugcagaugaacucccuccgggcugaggauacagccguguauuuuugugcccgcgggagcggaucuuccgacagaagcgauuacgacccgcauuauuacuauuaccuggauguuuggggcaagggggcuacggugaccgucucuucc

SEQ ID NO: 43282 - RNA, 387 nt, Artificial Sequence
  derived and/or modified sequence opt5 from anti-influenza_Chain
gaggugcagcuggucgaaagcggcggggaccucguucaacccggaagaucccugaaacuuucuugcaccggcagcggguucacauuuggagauuacggcgugacgugggugcggcaggccccugggaagggacuggagugggucggcuucauccgcaccagaccguggggcgggacagcugacaccgccgcguccgugaagggacgguuuacaauuucucgcgaugacagcaaaucccucgcuuaucugcagaugaacucucuuaagaccgaagauacagccguuuacuauuguugcagagacgcucccccuaauguggaggucgccagcaugaccaacugguacuucgaucuguggggccgggggacgcucgugaccguuuccagc

SEQ ID NO: 43283 - RNA, 387 nt, Artificial Sequence
  derived and/or modified sequence opt5 from anti-influenza_Chain
gaggugcagcugguccaaagcggcuccgaaguuaagaaacccggggagucucucaagaucagcugcaaaggauccggcuacucuuucagcaacuauuggauugggugggugagacacaugccuggaaagggccuggaauggauggggaucauuuacccgggagacuccgauacccgguauucucccagcuuucagggccaggugacaauguccgccgacaaaucuagcuccacggucuaccuucaguggagcucucugaaggcuuccgauaccgccaucuauuacugugcgcgcagaggcgggcauagcuucggauauggcucugggggagacacacacuccgaguuugauagcuggggccaagggacccucgugacaguuuccucu

SEQ ID NO: 43284 - RNA, 387 nt, Artificial Sequence
  derived and/or modified sequence opt5 from anti-influenza_Chain
caggugcaacugcucgagaccggcgggggacuggucaagcccggccagagccuuaaacuguccugcgccgcuucuggguucacauuuacgagcuacgccaugcacuggguuagacagccuccgggaaagggccucgaauggguggcgguggucuccuaugacgggaacuacaaauauuacgcugauucugugcagggacgguucaccaucagccgcgacaauuccaagaacacacuguaucuucaaaugaacucucugagagccgaggauaccgccguuuacuauugugcuaaagacagccggcuccgcucccugcuguacuuugaauggcucagccagggcuacuucaaucccuggggccaggggacaacccugacagugucuucc

SEQ ID NO: 43285 - RNA, 387 nt, Artificial Sequence
  derived and/or modified sequence opt5 from anti-influenza_Chain
caggugcaacuggucgagagcggcgccgaaguuaagaaacccggggcuuccgugaagcucucuugcaccgccagcggauacaacuucgcggcuuauuacauccacugggugagacaggccccuggccaggggcuggaguggaugggaugguccaauccgaacacaggcggggccaauuaugcucaggacuuucaaggacgggucacgaugaccgccgugacaucuaccagcacagcuuacauggaacuuucccgccugaccucugaugacacagcccucuauuucugugcgagaguuccccgggaucgccugcuuacccuguacuaugagagcuccacguacggcuuugacuacuggggccaggggacccucgugacagucagcucu

SEQ ID NO: 43286 - RNA, 387 nt, Artificial Sequence
  derived and/or modified sequence opt5 from anti-influenza_Chain
caggugcaacuggucgagagcggcgggggacucguucagcccggcgggucccugagacuuucuugcaccgugagcggauucacauuuaacuccuacgccaugaauugggugcggcaggcuccuggcaaggggcuggaaugggucucuggaauccgcggcagcggcgagaacacguauuacgccgaaaccgugaaagggagauucacaauuucccgggacaauucuaagaacacccucuaucuggagaugaauagccuucgcgcggaagauacagcuguuuacuauugugccagaaaauggggacggaugaccguguuuggcgucgccacagaccagcuguacuauuucgauuacugggggcaaggaacccucgugacgguuuccagc

SEQ ID NO: 43287 - RNA, 387 nt, Artificial Sequence
  derived and/or modified sequence opt5 from anti-influenza_Chain
caggugcaacuggucgagagcggccccgggcucguuaagccuucccagacccugucucuuacaugcacggugagcggaggcuccaucucuaacgggggauaccacuggagcuggauuagacagcauccgggcaaggggcuggaauggaucggaaauauuuauuaccggggcuccaccuucuaugaccccucucucaagagccgcgugacaaucuccgucgauaccagcaaaucucaguuuucccugaaacuuacaagcgugaccgccgcugacacagccguuuacuauugugcgagaaugccucuggcuaacuacgaucuccugaccggccuguauauuggggccuucgaccucuggggacaaggcacgauggugaccgucucuucc

SEQ ID NO: 43288 - RNA, 387 nt, Artificial Sequence
  derived and/or modified sequence opt5 from anti-influenza_Chain
caggugcaacuggucgagagcggcgccgaaguuaagaaaccgggggcuuccgugagagugucuugcaagggaagcggcuacaccuucacagccuaucacaugcauuggguccggcaggcgccugggcagggauuugagugggugggcuggaucaaccccaauuccggggcuacguacuauaccucuacauucgaaggacgcguuaccaugacaagagacaccagcauuacaaccgccuacauggagcucuccucucugcggagcgaugacacggccguguauuacugugcuaccgauaucgucguggaacgcgacgccucccuuggcggcuuuaacagcuaugggauggauguuuggggacagggcacaaccgugacagucucuucc

SEQ ID NO: 43289 - RNA, 390 nt, Artificial Sequence
  derived and/or modified sequence opt5 from anti-influenza_Chain
caggugcaacugcagcaguggggcgccgggcuccugaagcccagcgagacccuuucccugacaugcgcugucuacggaggcucuuucagcguuuccggguauuacuggucuuggaucagacagccuccgggacggggccucgaauggauuggggagaucagccacggaggcuccacgaacuauaaucccucucugaaaagccgcgugaccauuuccguggacacaaccaagaaccaauuuagccuuagacugucuuccgucacagccgcggauaccgcuguguacuauugugcccggggcacagacccugauaccgaaguuuacugccgcguggggaauugugccgcuuucgacuauuggggacagggcagccucgucacggugucuucc

SEQ ID NO: 43290 - RNA, 390 nt, Artificial Sequence
  derived and/or modified sequence opt5 from anti-influenza_Chain
caggugcaacugcucgagagcggccccgggcuggucaagccuucccagacccuucugcucacaugcacgguuucuggagccagcaucuccaccggcgggaacuacuggucuuggauuagacagcacccgggaaaagaccuggaauggaucggcuauauuuucuacagcgggacaaccaaguauaaucccuccguggauaacccuucucuuaaaagccgggugacaauguccgucgacaccagcgagaaucaguuuucucugaagcucuccagcgugacagcugccgauaccgcgguuuacuucugugcucgcggaucucccaacuccggcuaugacuggggcccucauuuugauuacugggggcaaggaacgcuggugaccgucagcucu

SEQ ID NO: 43291 - RNA, 390 nt, Artificial Sequence
  derived and/or modified sequence opt5 from anti-influenza_Chain
gaggugcagcuggucgaaagcggcgggcaccucguucaacccggaagaucccugcggcuuucuugcgccgcuagcggcuucaccuuugaggacuacgccaugaacugggugcgccaggcgccugggaagggacuggaauggguguccgucaucucuugggauagcggcagaauuggguaugcugacuccgugaaaggacgguucacaaucucucgcgauaaugccaagaacagcuccuaccuccagaugaauagccugagaccggaggacacggcccuuuauuacuguguucgggauaugcuggcuuauuacucugacaacuccggcaaaaaguauaauguguacggcauggaugucugggggcagggaaccacagugaccguuagcucu

SEQ ID NO: 43292 - RNA, 390 nt, Artificial Sequence
  derived and/or modified sequence opt5 from anti-influenza_Chain
gaggugcagcuggucgaaagcggcgggggacucguucaacccggcagaucccugcggcuuucuugcgccgugagcggguucaucuuugaggacuacgcuauuaacugggugcgccaggccccuggaaagggccuggaaugggucuccaucauuucuugggauagcgggagaaucggauaugcggacuccgugcggggccgcuucaccauuucuagagauaaugcuaaaaacagcuccuuucuccagaugaauagccugcggccggaggacacagccguuuacuauugugugaaggauaugcuugccuacuauuacgacggcucugggauccgcuauaaccuguacggaauggaugucuggggccaggggacgaccgugacaguuuccagc

SEQ ID NO: 43293 - RNA, 390 nt, Artificial Sequence
  derived and/or modified sequence opt5 from anti-influenza_Chain
gaggugcagcuggucgaaagcggcgggggacucguucaacccggcagaucccugcggcuuucuugcgccgugagcggguucaucuuugaggacuacgcuauuaacugggugcgccaggccccuggaaagugucuggaaugggucuccaucauuucuugggauagcggcagaaucggguaugcggacuccgugcggggacgcuucaccauuucuagagauaaugcuaaaaacagcuccuuucuccagaugaauagccugcggccggaggacacagccguuuacuauugcgugaaggauaugcuugccuacuauuacgacggcucuggcauccgcuauaaccuguacgggauggaugucuggggacagggcacgaccgugacaguuuccagc

SEQ ID NO: 43294 - RNA, 396 nt, Artificial Sequence
  derived and/or modified sequence opt5 from anti-influenza_Chain
cagaucacccugaaggagagcggccccacacucgugaaaccuacgcaaacccugacacuuaccugcgucuucuccggguuuucucugagcauuacaggaguuagagugggcuggauccggcagccgcccgggaaggcccucgaauggcuggcucuuauuuccugggacgaugagaaacacuacucuccuagccugcagucccgccucaccaucacaaaggacaccucuaaaaaccaggugguccugacgaugaccaaucuggaucccguggacacagccaccuauuacugugcgagaagcacagaucggggacauguucuccgcuauuucggcuggaugcugccuggggacgcuuuugauguguggggacaaggcaccauggucacgguguccagc

SEQ ID NO: 43295 - RNA, 396 nt, Artificial Sequence
  derived and/or modified sequence opt5 from anti-influenza_Chain
caggugcaacugcaggagagcggccccgggcucgucaagccuuccgaaacccugucucuuacaugcacgguuagcuccggaccgaugucugacuacuauuggagcuggaucagacagcccccuggcaaagggcuggaguggauuggacacguguccgugucucauggcgggcggaccaagagcaaccccuccgucaugagccgcgugacaaucucuguugaaaccuccaaaaaucaguucagccucaagcugacaucugugaccgccgcugauacagccgucuacuauugugcgagacuuaacuacuaugaccgguccggauaccacagcccugauggccccucuaauaacugguuugacccuuggggccaagggacccuggugacgguuuccagc

SEQ ID NO: 43296 - RNA, 396 nt, Artificial Sequence
  derived and/or modified sequence opt5 from anti-influenza_Chain
caggugcaacugguccagagcggcgccgagguuaagaaacccggggcuuccgugaaggugucuugcaaaaccagcggauacacauucacggccuauaccauccacugggucagacaggcgccuggccagcggcucgaauggaugggguggauuaacgcuggaaauggccauacaaaguacucccaacgcuuuaaagggagagugaccaucacacgggacaccucugcccgcacaaccuauauggagcugagaagccuuacguccgaagauaccgcccuguacuucugugcucggggaccggagacauauuacuaugacaagaccaacuggcucaauucucaccccgaugaauacuuucagcauuggggccacggcacacagguuaccgugagcucc

SEQ ID NO: 43297 - RNA, 399 nt, Artificial Sequence
  derived and/or modified sequence opt5 from anti-influenza_Chain
caggugcaacugguccagagcggcuccgagguuaagaaacccggggccucugugaaggugagcugcaaagccuccggauacaccuucacaaacuaugacaucaauuggauuagacaggcuccuggccaggggcucgaauggaugggauggaucaaccccaauucuggcacgaccgggagcgcgcaacgguuucagggacgcgucacaauuaccguggauacauccaucaccacaguuuacauggagcugucuagccuuagauccgacgauaccgcuauuuauuacugugcccggggccgcgaacugcucagacugcagcacuuccuuacggacagccagucugagcggcgcgauugcuuugacccguggggccaagggacccuggugacagucuccagc

SEQ ID NO: 43298 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggacuguccuuccucaacgccuggaugucuugggugcggcaagcgccuggcaaagggcuggagugggugggacgcaucaagagcaauaccgacggcggcacaacggauuacgcugccccggucaaagggagauuuaccauuucccgggacgauucuaagaacacacuuuaucugcagaugagcucccucaaaaccgaagacacagccguguacuauuguaccacagauggacccuacagcgacgauuuccgcucuggcuaugcugccagauaccgguauuuugggauggacguuuggggacagggcaccacggugaccgucuccagc

SEQ ID NO: 43299 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucuccuuucugaacgccuggaugucuugggugcggcaagcgccuggcaaagggcucgagugggugggacgcaucaagagcaauaccgacggcggcacaacggauuacgcugccccggucaaagggagauucaccauuucccgggacgauucuaagaacacacuguaucuucagaugagcucccugaaaaccgaagacacagccguguacuauuguaccacagauggacccuacagcgacgauuuucgcucuggcuaugcugccagauaccgguauuucgggauggacguuuggggacagggcaccacggugaccgucuccagc

SEQ ID NO: 43300 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggacugaccuuccucaacgccuggauguccugggugcggcaagcgccuggcaaagggcuggagugggugggacgcaucaagucuaauacagacggcggcacgaccgauuacgcugccccggucaaagggagauuuacaauuagccgggacgauuccaagaacacccuuuaucugcagaugucuagccucaaaacagaagacaccgccguguacuauuguacaaccgauggacccuacuccgacgauuuccgcagcggcuaugcugccagauaccgguauuuugggauggacguuuggggacagggcacgaccgugacagucucuucc

SEQ ID NO: 43301 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucuccuuuucuaacgccuggaugagcugggugcggcaagcgccuggcaaagggcuggagugggugggacgcaucaaguccaauaccgacggcggcacaacggauuacgcugccccggucaaagggagauucaccauuucucgggacgauagcaagaacacacucuaucugcagauguccagccuuaaaaccgaagacacagccguguacuauuguaccacagauggacccuacucugacgauuuucgcuccggcuaugcugccagauaccgguauuucgggauggacguuuggggacagggcaccacggugaccgucagcucu

SEQ ID NO: 43302 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggacugaccuucuccaacgccuggaugucuugggugcggcaagcgccuggcaaagggcucgagugggugggacgcaucaagagcaauacagacggcggcacgaccgauuacgcugccccggucaaagggagauuuacaauuucccgggacgauucuaagaacacccuguaucuucagaugagcucccugaaaacagaagacaccgccguguacuauuguacaaccgauggacccuacagcgacgauuuccgcucuggcuaugcugccagauaccgguauuuugggauggacguuuggggacagggcacgaccgugacagucuccagc

SEQ ID NO: 43303 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucaccuuuuccaacgccuggaugucuugggugcggcaagcgccuggcaaagggcuggagugggugggacgcaucaagagcaauacagacggcggcacgaccgauuacgcugccccggucaaagggagauucacaauuucccgggacgauucuaagaacacccucuaucugcagaugagcucccuuaaaacagaagacaccgccguguacuauuguacaaccgauggacccuacagcgacgauuuucgcucuggcuaugcugccagauaccgguauuucgggauggacguuuggggacagggcacgaccgugacagucuccagc

SEQ ID NO: 43304 - RNA, 402 nt, Artificial Sequence
  derived and/or modified sequence opt5 from anti-influenza_Chain
gaggugcagcuggucguuagcggcgggggacucgugaagcccggcgggucccugagacuuucuugcgccgcuagcggacuguccuuccucaacgccuggaugucuugggugcggcaagcgccuggcaaagggcuggaaugggucggacgcaucaagagcaauaccgacggcggcacaacggauuacgcugccccggugaaagggagauuuuccauuucucgggacgauagcaagaacaugcuuuuccugcacauguccagccuccgcaccgaggacacagccguuuauuacugugcuaccgauggacccuauucugacgauuuuagauccggcuacgccgcucgguaucgcuacuucgggauggacguguggggacagggcacaaccgucacagugagcucu

SEQ ID NO: 43305 - RNA, 402 nt, Artificial Sequence
  derived and/or modified sequence opt5 from anti-influenza_Chain
gaggugcagcuggucguuagcggcgggggacucgugaagcccggcgggucccugagacuuucuugcgccgcuagcggacuguccuuccucaacgccuggaugucuugggugcggcaagcgccuggcaaaugucuggaaugggucgggcgcaucaagagcaauaccgacggaggcacaacggauuacgcugccccggugaaaggcagauuuuccauuucucgggacgauagcaagaacaugcuuuuccugcacauguccagccuccgcaccgaggacacagccguuuauuacugcgcuaccgaugggcccuauucugacgauuuuagauccggauacgccgcucgguaucgcuacuucggcauggacgugugggggcagggaacaaccgucacagugagcucu

SEQ ID NO: 43306 - RNA, 402 nt, Artificial Sequence
  derived and/or modified sequence opt5 from anti-influenza_Chain
gaggugcagcuggucguuagcggcgggggacucgugaagcccggcgggucccugagacuuucuugcgccgcuagcggacuguccuuccucaacgccuggaugucuugggugcggcaagcgccuggcaaagggcuggaaugggucggacgcaucaagagcaauaccgacggcggcacaacggauuacgcugccccggugaaagggagauuuuccauuucucgggacgauagcaagaacaugcuuuuccugcacauguccagccuccgcaccgaggacacagccguuuauuacugugcuaccgauggacccuauucugacgauuuuagauccggcuacgccgcucgguaucgcuacuucgggauggacguguggggaugcggcacaaccgucacagugagcucu

SEQ ID NO: 43307 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucaccuuucugaacgccuggauguccugggugcggcaagcgccuggcaaagggcucgagugggugggacgcaucaagucuaauacagacggcggcacgaccgauuacgcugccccggucaaagggagauucacaauuagccgggacgauuccaagaacacccuguaucuucagaugucuagccugaaaacagaagacaccgccguguacuauuguacaaccgauggacccuacuccgacgauuuucgcagcggcuaugcugccagauaccgguauuucgggauggacguuuggggacagggcacgaccgugacagucucuucc

SEQ ID NO: 43308 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucaccuuucugaacgccuggauguccugggugcggcaagcgccuggcaaaugucucgaguggguggggcgcaucaagucuaauacagacggaggcacgaccgauuacgcugccccggucaaaggcagauucacaauuagccgggacgauuccaagaacacccuguaucuucagaugucuagccugaaaacagaagacaccgccguguacuauugcacaaccgaugggcccuacuccgacgauuuucgcagcggauaugcugccagauaccgguauuucggcauggacguuugggggcagggaacgaccgugacagucucuucc

SEQ ID NO: 43309 - RNA, 402 nt, Artificial Sequence
  derived and/or modified sequence opt5 from anti-influenza_Chain
gaggugcagcuggucgaaagcggcgggggacucguuaagcccggcgggucccugagacuuucuugcgccgcuagcggauucaccuuucugaacgccuggauguccugggugcggcaagcgccuggcaaagggcucgagugggugggacgcaucaagucuaauacagacggcggcacgaccgauuacgcugccccggucaaagggagauucacaauuagccgggacgauuccaagaacacccuguaucuucagaugucuagccugaaaacagaagacaccgccguguacuauuguacaaccgauggacccuacuccgacgauuuucgcagcggcuaugcugccagauaccgguauuucgggauggacguuuggggaugcggcacgaccgugacagucucuucc

SEQ ID NO: 43310 - RNA, 414 nt, Artificial Sequence
  derived and/or modified sequence opt5 from anti-influenza_Chain
caggugcagcugcaggagagcggcgggggacucguccagcccggcgaaucccugagacuuucuugcguugggagcggauccucuuucggcgagagcacccuguccuacuaugccgugucuugggugcggcaggcuccugggaagggacucgaauggcugagcaucauuaacgccggcggcggggacaucgauuacgcggacuccgucgagggacgcuuuacaauuagcagagauaauucuaaagaaacgcuuuaucugcaaaugaccaaccuccggguggaggacacaggcguuuacuauugugcuaagcacauguccaugcaacagguggucagcgccgggugggagcgcgccgaucuggugggagacgcuuucgauguuuggggccaggggaccauggugacagucucuucc

SEQ ID NO: 43311 - RNA, 465 nt, Artificial Sequence
  derived and/or modified sequence opt5 from anti-influenza_Chain
cugagcagaaucaaccacuucgagaagauucagaucauucccaaauccucuuggagcgaccaugaagccuccucuggcgugagcuccgcuugcccuuaccaagggaccccgagcuuuuuccggaaugucguuuggcucaucaagaaaaacaauacauaucccacgauuaagcgcucuuacaacaauaccaaccaggaggaucugcuuauccuguggggaauccaccauuccaaugacgccgcggaacagacaaaacucuaucagaacccuaccacauacauuagcgugggcaccucuacacugaaucaaagacuugugcccaagaucgcuacccgguccaaggucaacgggcagaauggacgcauggacuuuuucuggacgauucugaaaccuaacgaugccaucaauuuugagagcaacggcaauuucauugcccccgaauaugcuuacaagaucgugaaaaag

SEQ ID NO: 43312 - RNA, 564 nt, Artificial Sequence
  derived and/or modified sequence opt5 from anti-influenza_Chain
aacgugcccgaguggagcuacaucgucgaaaaggccaauccugcuaacgaccugugcuauccgggcaauuucaacgauuacgaggaacucaaacaucugcuuuccagaauuaaucacuuugagaagauccagauuauccccaaaucuagcugguccgaccacgaagccucuagcgggguuuccucugcguguccuuaucaaggaacccccagcuucuuucggaacgugguguggcugauuaagaaaaauaacacauacccuacgaucaagcgcuccuauaauaacaccaaucaggaggaucuccugauccuuuggggcauucaucacagcaacgacgcugccgagcagacaaagcuguaccagaaucccaccacauauaucucugucgggaccuccacacucaaccaaagacuggugccuaaaauugccacccggagcaagguuaauggacagaacggccgcauggauuucuuuuggacgauccugaaaccgaacgacgcuauuaauuucgaaucuaacgggaauuuuaucgcccccgaguacgcuuacaagauugugaaaaag

SEQ ID NO: 43313 - RNA, 609 nt, Artificial Sequence
  derived and/or modified sequence opt5 from anti-influenza_Chain
augcugagaagccucgugcugaacgagaaacuucgggcccgcguccuggaaagagcugaggaguuccuccugaauaacaaggccgacgaagaaguuugguuucgggagcuugugcugugcauccucaccuccaauucuagcuucauuuccgcguacaagucuaugaacuauauccuggauaaaauucuguacauggacgagaaggaaaucagcauucuccugcaggaguccggcuaucgcuuuuacaaucuuaaagcuaaguaucuguacagagccaagaaccucuaugggaaagugaagaaaacaaucaaggaaaucgccgauaaagaccaaaugcaggcucgggaguucauugccacgcacaucuacggaauuggcuacaaggaggcuucucauuuucugcgcaaugucggguaucuugaucuggccaucauugacagacacauccuccgguucauuaacaaucugggaauccccaucaagcugaaaagcaagcgcgaauaccuccuggcggagucccuucugagaagcauugccaacaaucucaacgugcagguuggccugcuugaucuguuuaucuucuuuaaacagaccaauacaauugugaag

SEQ ID NO: 43314 - RNA, 615 nt, Artificial Sequence
  derived and/or modified sequence opt5 from anti-influenza_Chain
ggccuguucggggccaucgcuggauuuauugagggcggguggaccggaaugguggacggcugguacggguaucaccaucagaacgaacaaggaagcggcuacgccgcggaucucaaguccacacagaaugcuaucgacgagauuacgaacaaagucaauucuguuaucgaaaagaugaacacccaguucacagccgugggcaaagaguuuaaucaccuggaaaagagaauugagaaccuuaauaaaaagaucgaugacggguuccuggauaucuggaccuauaacgccgagcuccuggugcuucuggaaaaugagcggacacucgacuaccaugauagcaacgucaagaaucuguaugaaaaagugcgcucccagcugaagaacaaugcuaaagagauuggaaacggcugcuuugaguucuaccacaagugugacaauaccugcauggaaucuguuaaaaacgggacauaugauuaccccaaguacagcgaggaagccaagcucaacagagaggaaaucgacggagugaaacuggaguccacccggauuuaucaaauccuugcuauuuacucuacggucgccagcucccuggugcucguugugagccugggcgcg

SEQ ID NO: 43315 - RNA, 639 nt, Artificial Sequence
  derived and/or modified sequence opt5 from anti-influenza_Chain
gagaucgugcugacccagagccccggcacacucagccugucuccuggggaaagagccacgcuuagcugccgggcuucccaacgcgucucuagcuaccuggccugguaucagcagaagccgggacaggcgcccagacuccugauuuacggcgcuuccacccgggccgccgggaucccugaccgcuucucuggaagcggcuccgggacagauuuuacccuuacaauuagcagacuggagcccgaagacucugcuguuuauuacugucaacaguauggacggaccccucucacauucggcggcgggaccaaaguggagaucaagcgcgccgcugcccccuccguguuuauuuucccuccgagcgaugaacagcugaaaucuggaacggcguccgucgugugccugcucaacaauuuuuaccccagagaggccaagguucaguggaaaguggacaacgcucugcaaagcggcaauucucaggaguccgucaccgaacaggauagcaaggacuccacauauucucuuagcuccacccugacacucagcaaggccgauuacgagaaacacaagguguacgcuugugaaguuacccaucaggggcugucuuccccugugacgaaauccuucaaccggggagagugc

SEQ ID NO: 43316 - RNA, 639 nt, Artificial Sequence
  derived and/or modified sequence opt5 from anti-influenza_Chain
gacauccagaugacccaaagccccuccucucugagcgccucccucggcgggaacgugacaauuacgugcaaggcuucucaggauaucaauaaauacauugccugguaucagcacaagccuggaaaaggcccgagacuggucauccauuacaccagcacacuucagcccgggauuccuucccgguucucuggaagcggcuccgggaccgacuauagcuuuucuaucuccaaccuggagcccgaagauaucgcgacauacuauugucuccaauacgacauucuguauaccuucggaggcggcacaaaacuugagaucaagcgcgcugaugccgccccuaccguuagcauuuuucccccuucuuccgaacagcugacgagcgggggagcuucuguggugugcuuccucaauaacuuuuacccgaaggacaucaaugucaaguggaaaauugauggcuccgagagacagaacggggugcugaauagcuggaccgaccaggauuccaaggacucuacauacagcauguccagcacccugacacucaccaaagaugaauaugagcggcacaacucuuacacgugugaggccacacauaagaccuccacaagccccaucguuaaaucuuucaaucgcaacgaaugc

SEQ ID NO: 43317 - RNA, 642 nt, Artificial Sequence
  derived and/or modified sequence opt5 from anti-influenza_Chain
gacauccagaugacccaaagccccuccucucugagcgccuccgugggcgauagagucacaauuacgugccgggcuucucaggggaucagcuccuaccucgccugguaucagcagaagccuggaaaaguuccgacccugcuuauuuacgacgcgucuacacugcgcagcggcgugcccuccagauucagcgggucuggauccgcuaccgauuuuacacucaccaucagcucucugcaaccugaggacguggccacauauuacugucagcgguauaacuccgcucccccuauuaccuucggccaggggacgcgccuugaaaucaagagagccgccgcucccagcgucuuuaucuucccuccgucugaugagcagcugaaauccggaaccgccagcgugguuugccuccugaauaacuuuuacccccgggaagcgaaggugcaauggaaagucgacaaugcccugcaguccggcaacucucaggagagcgugacagaacaggauuccaaggacagcaccuauucucucuccagcacacugacccuuucuaaggcugauuacgagaaacacaagguuuacgccugugaggugacgcaucaaggccugagcuccccugucacaaaaucuuucaaucgcggggaaugc

SEQ ID NO: 43318 - RNA, 642 nt, Artificial Sequence
  derived and/or modified sequence opt5 from anti-influenza_Chain
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcuccagagccaccgggaucccugaccgguucagcggaucuggcuccgggacagauuuuacccuuacaauuagccgccuggagcccgaagacuucgccguuuauuacugucaacaguauggaucuuccccuagaaccuuuggcggcgggacaaaaguggagaucaagcgggcugccgcucccagcguguucauuuuuccuccgucugaugaacagcucaaauccggaaccgccagcgucgugugccugcugaacaauuucuacccccgcgaggcgaagguucaguggaaaguggacaacgcccuccaauccggcaauucucaggagagcgucacggaacaggauuccaaggacagcaccuauucucuguccagcacacuuacccugucuaaggcugauuacgagaaacacaagguguacgccugugaaguuacacaucaggggcucagcuccccugugaccaaaucuuuuaacagaggagagugc

SEQ ID NO: 43319 - RNA, 642 nt, Artificial Sequence
  derived and/or modified sequence opt5 from anti-influenza_Chain
agcuacgugcugacccagcccccuuccgucucuguugccccgggcgagacagcuacggugaccugcgggggaaacaauaucggcagcaaguccgugcacugguaucaacagaaacccgggcaggccccugucgugguuauuuacuaugacggagauagacccucuggcaucccugaacgguucagcggguccaacucuggagacacagcgacccucacaauuagccgcguggaggcuggcgaugaagccgacuacuauugucuggucugggauuacaccuccgugcauuauguuuuuggcacagggaccaaggugacgguccuuggacagcccaaagccaauccuaccgugacacuguucccgcccagcucugaggaacuccaagcuaacaaggccacccuggugugccuuaucuccgacuuuuacccuggcgcugucacaguugccuggaaagcggaugggagccccgugaaggccggaguggagaccacgaagccuucuaaacaguccaauaacaaguacgcugccagcucuuaucugucccucacacccgagcaguggaaaagccacagauccuacucuugucaggucacccaugaaggcagcacaguggagaagaccguugcuccgaccgaaugcucc

SEQ ID NO: 43320 - RNA, 642 nt, Artificial Sequence
  derived and/or modified sequence opt5 from anti-influenza_Chain
gacauccagaugacccaaacaagcuccucucugagcgccucccucggcgauagagugacgauuucuugccgggcuagccaggacauccgcaacuaccugaauugguaucagcagaagcccgaugggaccgucaaacuucugauuuacuauacauccagacuccacucuggaguuccuagccgguucuccgacagcggcucugggaccgauuacucccugacaaucagcaaccuugagcaagaagaccuggccaccuauuuuugucagcagacauacacccucccguggacguucggaggcgggaccaagcuggagauuaaacgcgcggaugcugcccccacagugucuaucuuuccucccuccagcgaacagcugaccucuggaggcgccuccguggucugcuuccucaauaacuuuuauccuaaggacaucaaugugaaauggaagauugauggcagcgagagacaaaacgggguucugaauagcuggacagaccaggauucuaaggacagcaccuacuccaugagcucuacgcuuacacugaccaaagaugaauacgagcggcauaacuccuauacaugugaggcuacccacaagaccagcacaucucccaucgugaaauccuucaaucgcaacgaaugc

SEQ ID NO: 43321 - RNA, 645 nt, Artificial Sequence
  derived and/or modified sequence opt5 from anti-influenza_Chain
gacggcgugaagccccugauccucagagauugcagcgucgccggguggcugcuuggaaacccuaugugugacgaguucauuaauguuccggaaugguccuacaucguggagaaagcuaaccccgccaaugaucugugcuauccuggcaacuuuaaugacuacgaagaacucaagcaucugcuuucucggauuaaccacuucgagaaaauccagauuauccccaagagcuccuggucugaucacgaggcgagcuccggggugucuagcgcuuguccuuaucaaggaacccccuccuuuuuccgcaaugucguguggcugaucaaaaagaacaauacauacccuacgauuaagagaagcuauaacaauaccaaccaggaggaccuccugauccuguggggcauucaucacucuaaugaugccgccgaacagacaaaacucuaccagaacccgaccacauauaucuccguugggaccagcacacugaaucaacggcuugugcccaagauugcuacccgcucuaaagucaacggacagaacggcagaauggacuuuuucuggacgauccugaagccuaaugaugccauuaacuuugaguccaauggcaacuucaucgcucccgaauacgccuacaaaaucgugaagaag

SEQ ID NO: 43322 - RNA, 645 nt, Artificial Sequence
  derived and/or modified sequence opt5 from anti-influenza_Chain
gacauccagaugacccaaagccccuccacacugucugccagcgugggcgauagagucacgauuaccugccgggcuucccagacaaucaacaauuaccucgccugguaucagcagaagccugggaaagcgccgaagcugcuuauuuacaaggcuucuagccuggaguccggaguucccucucgcuucagcggcuccgggagcggaaccgaauuuacacucaccaucucuucccugcaaccugacgauuucgccacauauuacugucaggaguauaacaaugacagcccccuuaccuuuggcgggggaacgaagguggaaauuaaaagaaccguggccgcuccuucugucuucaucuuucccccuuccgaugagcagcugaaaagcggcacagccucugugguuugccuccugaacaauuucuacccgcgggaagcuaaggugcaguggaaagucgacaacgcccugcaauccggcaauagccaggaguccgugaccgagcaggauucuaaggacagcacauauucccucagcucuacccugacgcuuuccaaagcggauuacgaaaagcacaaaguuuacgccugugaggugacacaucaggggcugagcucucccgucaccaagagcuuuaaccgcggagaaugc

SEQ ID NO: 43323 - RNA, 645 nt, Artificial Sequence
  derived and/or modified sequence opt5 from anti-influenza_Chain
agcgugcugacccagcccccuuccgccucuggcagcagagggcaauccaucacaauuucuugcacgggaagcaccuccgacaucggcucuuacaacuaugucagcugguaccagcagcacccggggacagcucccaagguuauucucuaugaggugucccagcggccuagcggagugcccgaucgcuucucuggcuccaaaagcgggaauaccgccuuucugacagucucuggacuucaagcggaagacgaggcugauuacuauugugccuccuacgccggcaacaauaucuauguguucggcagcgggaccaagguuacagugcugggacagccuaaagcuaaccccaccgucacgcucuuuccuccgucuuccgaggaacugcaggccaauaaggcuacccuugugugccugauuagcgacuucuaccccggcgccguuacaguggcguggaaagccgauuccucuccugucaaggcugggguggaaaccacaacccccagcaagcaguccaacaauaaauacgccgcuagcucuuaucucucccugacgccugagcaauggaaaagccauaagucuuacagcugucaggugacacacgagggauccaccgucgaaaagacaguugcccccaccgagugcucu

SEQ ID NO: 43324 - RNA, 645 nt, Artificial Sequence
  derived and/or modified sequence opt5 from anti-influenza_Chain
agcgcccugacccagcccccuuccgcuucuggcagcagagggcaauccaucacaauuucuugcacgggaagcaccuccgacaucggcucuuacaacuaugugagcugguaccagcagcacccggggacagcccccaaggucauucucuaugagguuucccagcggccuagcggagugcccgaucgcuucucuggcuccaaaagcgggaauaccgcguuucugacagugucuggacuucaagcugaagacgaggccgauuacuauugugccuccuacgcuggcaacaauaucuaugucuucggcagcgggaccaaggugacaguucugggacagccuaaagccaaccccaccgugacgcucuuuccuccgucuuccgaggaacugcaggcuaauaaggccacccuugucugccugauuagcgacuucuaccccggcgcggugacaguugccuggaaagcugauuccucuccugugaaggccggggucgaaaccacaacccccagcaagcaguccaacaauaaauacgcugccagcucuuaucucucccugacgccugagcaauggaaaagccauaagucuuacagcugucaggugacacacgagggauccaccguggaaaagacagucgcgcccaccgagugcucu

SEQ ID NO: 43325 - RNA, 648 nt, Artificial Sequence
  derived and/or modified sequence opt5 from anti-influenza_Chain
cagagcgugcugacccaacccccuuccgagucugucagcccgggccagacagccuccguuacgugcucugggcacaagcucggagacaaauacgugagcugguaucagcagaagcccggccaauccccugugcugcuuaucuaccaggauaacagacggcccucugggauuccugaacgcuucaucggaagcaauuccggcaacaccgcuacacugaccauuagcgggacacaggcccucgacgaggcggauuauuacugucaggcuugggacucuuccaccgccgucuuuggaggcggcacaaaacugaccgugcuuggggccgcugccggacaacccaaggcugccccuagcguuacgcuguucccgcccucuuccgaggaacuccaggcgaauaaagccacccuggugugccugaucagcgauuuuuauccuggcgcugucacaguggccuggaaggcugacucuucccccguuaaggccgggguggaaaccacaaccccuagcaaacaguccaacaauaaguacgcggccucuagcuaucucucccugacgcccgagcaguggaaaagccauagaucuuacuccugucaagucacacacgagggaagcaccguggaaaagacaguggcuccgaccgagugcucu

SEQ ID NO: 43326 - RNA, 648 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcucuuacaaccucguuagcugguaucagcagcacccggggaaggcccccaaacugaugaucuacgagguguccaagagaccuagcggagugucuaaucgguucuccggcagcaaaucugggaacacagcgucccuuaccauuagcggacugcaagcugaagaugaggccgacuauuacugucaucucuaugucgggucuuccaauuggguguuuggcggcggaacaaagcuggccguucuuggccagcccaaagcugccccuagcgugacccuguuucccccuuccucuaaggaacuccaggcuaacaaggccacacuggucugcccgaucagcgauuucuaccccggggcggugaccguugccuggaaagcugacuccagcccugugaaggccggagucgagacgaccacacccucuaaacaguccaauaacaaguaugcugccagcucuuaccugagccucaccccugaacaauggaaaucccacaagucuuacagcugucaggugacacaugagggcuccaccguggagaagacggucgcgcccacagaaugcagc

SEQ ID NO: 43327 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuggcccccucgccugacauuuggcgggggaucuaaagucgagauuaagagaaccguggccgcgcccuccguuuucaucuuuccuccgagcgacgaacagcucaaaucuggcacggccuccguggucugccugcugaacaauuucuauccccgggaggcuaaggugcaguggaaaguugauaacgcccuccaaagcggcaauucccaggagucugugaccgaacaggacagcaaggauuccacauacagccugucuuccacccuuacacugagcaaggcugacuaugagaaacauaaggucuacgccugugaagugacccaccaggggcucucuagcccugugacgaaauccuuuaaccgcggagagugc

SEQ ID NO: 43328 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuaucccccucgccugacauuuggcgggggaucuaaagucgagauuaagagaaccguggccgcgcccuccguuuucaucuuuccuccgagcgaugaacagcucaaaucuggcacggccuccguggucugccugcugaacaauuucuacccccgggaggcuaaggugcaguggaaaguugacaacgcccuccaaagcggcaauucccaggagucugugaccgaacaggauagcaaggacuccacauauagccugucuuccacccuuacacugagcaaggcugauuacgagaaacacaaggucuacgccugugaagugacccaucaggggcucucuagcccugugacgaaauccuuuaaccgcggagagugc

SEQ ID NO: 43329 - RNA, 648 nt, Artificial Sequence
  derived and/or modified sequence opt5 from anti-influenza_Chain
gagaucgugaugacccagagccccgccacacuguccgucucuccuggcgaaagagcuacgcucagcugccgggccucccaaucuguugacagcaaccuggcgugguaccagcagaagccggggcaggcuccccgccuucugguguauuccgccucuaccagagccacaggcauuccugcucgguucagcggauccgggagcggaaccgaguuuacacucgccaucucuucccugcaaagcgaagauuucgcuguguacuauugucagcacuacaccaauuggcccccucgccuuacauuuggcgggggaucuaaagucgagauuaagagaaccguggccgcgcccuccguuuucaucuuuccuccgagcgacgaacagcugaaaucuggcacggccuccguggucugccuccugaacaauuucuauccccgggaggcuaaggugcaguggaaaguugauaacgcccugcaaagcggcaauucccaggagucugugaccgaacaggacagcaaggauuccacauacagccucucuuccacccugacacuuagcaaggcugacuaugagaaacauaaggucuacgccugugaagugacccaccaggggcugucuagcccugugacgaaauccuuuaaccgcggagagugc

SEQ ID NO: 43330 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagcuccaaccuugcgugguaccagcagaagccggggcaggcuccccgccugcucguguauucugccagcaccagagccacaggcauuccugcucgguucuccggaagcgggucuggaaccgaguuuacacuggccaucuccagccuucaaucugaagacuucgcuguguacuauugucagcacuacaccaauuggcccccucgccugacauuuggcgggggauccaaagucgagauuaagagaaccguggccgcgcccagcguuuucaucuuuccuccgucugaugaacagcucaaauccggcacggccagcguggucugccugcugaacaauuucuauccccgggaggcuaaggugcaguggaaaguugacaacgcccuccaauccggcaauucucaggagagcgugaccgaacaggauuccaaggacagcacauacucucuguccagcacccuuacacugucuaaggcugauuaugagaaacauaaggucuacgccugugaagugacccaccaggggcucagcuccccugugacgaaaucuuuuaaccgcggagagugc

SEQ ID NO: 43331 - RNA, 648 nt, Artificial Sequence
  derived and/or modified sequence opt5 from anti-influenza_Chain
gagaucgugcugacccagagccccgccacacucagcgucucuccuggcgaaagagcuacgcugagcugccgggccucccaaucuguugaccacaaccuugcgugguaccagcagaagccggggcaggcuccccgccugcucguguauagcgccuccaccagagccacaggcauuccugcucgguucucuggaagcggguccggaaccgaguuuacacuggccaucagcucucuucaauccgaagauuucgcuguguacuauugucagcauuacaccaauuggcccccucgccugacauuuggcgggggaagcaaagucgagauuaagagaaccguggccgcgcccucuguuuucaucuuuccuccguccgacgaacagcucaaaagcggcacggccucuguggucugccugcugaacaauuucuauccccgggaggcuaaggugcaguggaaaguugauaacgcccuccaauccggcaauagccaggaguccgugaccgaacaggacucuaaggauagcacauacucccugagcucuacccuuacacuguccaaggcugacuaugagaaacacaaggucuacgccugugaagugacccaucaggggcucagcucuccugugacgaaauccuuuaaccgcggagagugc

SEQ ID NO: 43332 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuggcccccucgccugacauuuggcgggggaucuaaagucgagauuaagagaaccguggccgcgcccuccguuuucaucuuuccuccgagcgaugaacagcucaaaucuggcacggccuccguggucugccugcugaacaauuucuauccccgggaggcuaaggugcaguggaaaguugacaacgcccuccaaagcggcaauucccaggagucugugaccgaacaggauagcaaggacuccacauacagccugucuuccacccuuacacugagcaaggcugauuaugagaaacacaaggucuacgccugugaagugacccaucaggggcucucuagcccugugacgaaauccuuuaaccgcggagagugc

SEQ ID NO: 43333 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguuagccacaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagacuucgcuguguacuauugucagcauuacaccaauuuucccccucgccugacauucggcgggggaucuaaagucgagauuaagagaaccguggccgcgcccuccguuuuuaucuucccuccgagcgaugaacagcucaaaucuggcacggccuccguggucugccugcugaacaauuuuuauccccgggaggcuaaggugcaguggaaaguugacaacgcccuccaaagcggcaauucccaggagucugugaccgaacaggauagcaaggacuccacauacagccugucuuccacccuuacacugagcaaggcugauuaugagaaacacaaggucuacgccugugaagugacccaucaggggcucucuagcccugugacgaaauccuucaaccgcggagagugc

SEQ ID NO: 43334 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuuucccccucgccugacauucggcgggggaucuaaagucgagauuaagagaaccguggccgcgcccuccguuuuuaucuucccuccgagcgacgaacagcucaaaucuggcacggccuccguggucugccugcugaacaauuuuuauccccgggaggcuaaggugcaguggaaaguugauaacgcccuccaaagcggcaauucccaggagucugugaccgaacaggacagcaaggauuccacauacagccugucuuccacccuuacacugagcaaggcugacuaugagaaacauaaggucuacgccugugaagugacccaccaggggcucucuagcccugugacgaaauccuucaaccgcggagagugc

SEQ ID NO: 43335 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaucuguugacagcaaccuugcgugguaccagcagaagccggggcaggcuccccgccugcucguguauuccgccucuaccagagccacaggcauuccugcucgguucagcggauccgggagcggaaccgaguuuacacuggccaucucuucccuucaaagcgaagauuucgcuguguacuauugucagcacuacaccaauuaucccccucgccugacauuuggcgggggaucuaaagucgagauuaagagaaccguggccgcgcccuccguuuucaucuuuccuccgagcgacgaacagcucaaaucuggcacggccuccguggucugccugcugaacaauuucuacccccgggaggcuaaggugcaguggaaaguugauaacgcccuccaaagcggcaauucccaggagucugugaccgaacaggacagcaaggauuccacauauagccugucuuccacccuuacacugagcaaggcugacuacgagaaacauaaggucuacgccugugaagugacccaccaggggcucucuagcccugugacgaaauccuuuaaccgcggagagugc

SEQ ID NO: 43336 - RNA, 648 nt, Artificial Sequence
  derived and/or modified sequence opt5 from anti-influenza_Chain
gagaccacacugacgcagagccccgccacccucuccgugucuccuggcgaaagagcuacacugagcugccgggccucccaagucaucucucacaaccuugcgugguaccagcagaagccggggcaggcuccccgccugcucauuuauggagccagcaccagagccuccggcaucccugcucgguucucugggagcggauccggcacagacuacacccugacaauuaccagccuucaaucugaggauuuugccguuuauuacugucagcauuauuccaauuggcccccucgccugacguucgggggaggcaccaaaguggaaaucaagagaacaguggcugcccccagcgucuuuauuuucccuccgucugacgagcagcucaaauccggcaccgcgagcgugguuugccugcugaacaauuuuuacccccgggaagccaaggugcaguggaaagucgauaacgcucuccaaucuggaaauucccaggagagcgugacagagcaggacuccaaggauucuaccuauagccuguccagcacgcuuacacugucuaaggccgacuacgaaaaacacaagguuuacgcuugugaggugacccaucaggggcucuccagcccugucacaaaaucuuucaaccgcggcgaaugc

SEQ ID NO: 43337 - RNA, 648 nt, Artificial Sequence; identical to SEQ ID NO: 39218
  derived and/or modified sequence opt5 from anti-influenza_Chain

SEQ ID NO: 43338 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaacccgaggauuuugccguguauuacugucagcauuauucuaauuggccuccccgccugacauucgggggaggcaccaaaguggaaauuaagagaacggucgcugccccuuccgugagcaucuuuccgcccucugacgagcagcucaaauccggcaccgcgagcguugugugccugcugaacaauuucuacccucgggaagccaagguccaguggaaaguggauaacgcucuccaaucuggaaauucccaggagagcguuacagagcaggacuccaaggauucuaccuauagccuguccagcacacuuacccugucuaaggccgacuacgaaaaacacaagguguacgcuugugaggucacgcaucaggggcucuccagccccgugacaaaaucuuuuaaccgcggcgaaugc

SEQ ID NO: 43339 - RNA, 648 nt, Artificial Sequence
  derived and/or modified sequence opt5 from anti-influenza_Chain
gagaucgugaugacccagagccccgccacacuguccgucucuccuggcgaaagagcuacgcucagcugccgggccucccaaguuauuucucacaaccuggcgugguaccagcagaagccggggcaggcuccccgccuucugaucuauggagccagcaccagagccuccggcauuccugcucgguucucugggagcggauccggcacagacuacacccucacaaucaccagccugcaaucugaggauuuugccguguauuacugucagcauuauuccaauuggcccccucgccuuacauucgggggaggcaccaaaguggaaauuaagagaacggucgcugcccccagcguguuuaucuucccuccgucugacgagcagcugaaauccggcaccgcgagcguugugugccuccugaacaauuuuuacccccgggaagccaagguccaguggaaaguggauaacgcucugcaaucuggaaauucccaggagagcguuacagagcaggacuccaaggauucuaccuauagccucuccagcacacugacccuuucuaaggccgacuacgaaaaacacaagguguacgcuugugaggucacgcaucaggggcuguccagcccugugacaaaaucuuucaaccgcggcgaaugc

SEQ ID NO: 43340 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaaucugaggauuuugccguguauuacugucagcauuauuccaauuuucccccucgccugacauucgggggaggcaccaaaguggaaauuaagagaacggucgcugcccccagcguguucaucuuuccuccgucugacgagcagcucaaauccggcaccgcgagcguugugugccugcugaacaauuucuacccccgggaagccaagguccaguggaaaguggauaacgcucuccaaucuggaaauucccaggagagcguuacagagcaggacuccaaggauucuaccuauagccuguccagcacacuuacccugucuaaggccgacuacgaaaaacacaagguguacgcuugugaggucacgcaucaggggcucuccagcccugugacaaaaucuuuuaaccgcggcgaaugc

SEQ ID NO: 43341 - RNA, 648 nt, Artificial Sequence
  derived and/or modified sequence opt5 from anti-influenza_Chain
gagaucgugcugacccagagccccgccacacucuccgucucuccuggcgaaagagcuacgcugagcugccgggccucccaaguuauuucucacaaccuugcgugguaccagcagaagccggggcaggcuccccgccugcucaucuauggagccagcaccagagccuccggcauuccugcucgguucucugggagcggauccggcacagacuacacccugacaaucaccagccuucaaucugaggauuuugccguguauuacugucagcauuauuccaauuaucccccucgccugacauucgggggaggcaccaaaguggaaauuaagagaacggucgcugcccccagcguguuuaucuucccuccgucugacgagcagcucaaauccggcaccgcgagcguugugugccugcugaacaauuuuuacccccgggaagccaagguccaguggaaaguggauaacgcucuccaaucuggaaauucccaggagagcguuacagagcaggacuccaaggauucuaccuacagccuguccagcacacuuacccugucuaaggccgacuacgaaaaacacaagguguaugcuugugaggucacgcaucaggggcucuccagcccugugacaaaaucuuucaaccgcggcgaaugc

SEQ ID NO: 43342 - RNA, 648 nt, Artificial Sequence
  derived and/or modified sequence opt5 from anti-influenza_Chain
gagaucgugcugacccagagccccgccacacucuccgucucuccuggcgaaagaguuacgcugagcugccgggcuucccaaucuguggccaacaaucuugcgugguaccagcagaagccggggcagagcccccgccugcucauuuauggagcuuccaccagagacacaggcaucccugcccgguucucugggagcggauccggcaccgaguuuacacugaccauuagcucucuucaauccgaagauuucgccguguacuauugucagcaguacaacaauuggcccccuauguauacauuugggcagggaaccaaacuggagaucaagcgcacggucgcugcccccagcguguucauuuuuccuccgucugacgaacaacucaaauccggcaccgcuagcguugugugccugcugaacaauuucuaccccagagaggccaagguccaguggaaaguggauaacgcgcuccagucuggcaauucccaggagagcguuacagaacaagacuccaaggauucuaccuauagccuguccagcacacuuacccugucuaaggccgacuacgagaaacacaagguguacgcuugugaagucacgcaucaggggcucuccagcccugugacaaaaucuuuuaaccggggagagugc

SEQ ID NO: 43343 - RNA, 648 nt, Artificial Sequence
  derived and/or modified sequence opt5 from anti-influenza_Chain
gacaucgugaugacccagagccccuccacacugucugccagcgucggcgauagaguuacgauuaccugccgggcuucccaaucuaucgggaacuggcucgccugguaccagcagaagccuggaaaagcgccgaagcugcuuauuuauaaagugagcacacuggaguccggcgugcccucucgcuucagcggguccggaagcggcaccgaauuuacacucaccaucaauucucugcagccugacgauuucgcuacauacuauugucaaagauacaccuccaacagccagggguuuacguucggacagggcaccaagcuggagauuaaacggacagucgccgcccccucuguguuuaucuucccucccuccgacgaacagcuuaagagcggcaccgcuucuguugugugccuccugaauaacuuuuauccucgcgaggccaagguccaauggaaaguggauaaugcucugcaguccgggaacagccaggaauccguuacagagcaggacucuaaggauagcaccuacucccucagcucuacgcugacacuuuccaaagccgacuaugagaagcacaaaguguacgcgugugaagucacccaucaaggacugagcucuccggugacaaagagcuucaauagaggcgagugc

SEQ ID NO: 43344 - RNA, 648 nt, Artificial Sequence
  derived and/or modified sequence opt5 from anti-influenza_Chain
gacauccagcugacccaaagcccccucuccccuccggugacacugggccagcccgccucuauuagcugcagauccucucagagccuucuguacacggauggguucaccuaucucuccugguaccaccagcggccuggacaaucuccccgcagacugaucuauaagauuagcaaccgggacuccggcgucccugaucgcuuuagcgggucuggauccggcacagacuucacccuuaaaaucagcagaguugaggcugaagauguggggguguacuauuguaugcaggccacacauuggccccugaccuuuggagagggcacaaaggucgaaauuaaaccuaaggcggcuccgucugugacccucuuucccccuuccagcgaggaacugcaggccaauaaagccacgcugguuugccucaucucugacuucuaccccggcgcugugaccgucgccuggaaggcugauuccagcccugugaaggccgggguugagacaaccacacccuccaaacagucuaacaauaaguaugcggccagcuccuaccugagccuuaccccggagcaauggaaaucucacaaguccuacagcugucaggugacgcaugaaggaucuacagucgagaaaaccguggcuccuacagaaugcagc

SEQ ID NO: 43345 - RNA, 648 nt, Artificial Sequence
  derived and/or modified sequence opt5 from anti-influenza_Chain
gagaucgugcugacccagagccccggcacacucagccugucuccuggggaaagagccacgcuuagcugccgggcuucccaaucuguccgcagcaacaaucuggccugguaccagcacaagccgggacaggcgcccagacuccugauuuucggcgcuuccucucgggccaccgggaucccugaccgcuuuagcggauccggcagcgggacagauuucacccuuacaauuucuagacuggagcccgaagacuuugccguuuauuacugucagcaauauggauccagcccugcucucaccuucggcggcgggacaaaaguggagaucaagcggaccguggccgcucccucugucuuuauuuucccuccguccgaugaacagcugaaaagcggaacggccucugugguuugccugcucaacaauuuuuacccccgcgaggcgaaggugcaguggaaagucgacaacgcccugcaguccggcaauagccaagaguccgugaccgaacaggauucuaaggacagcacauauucccuuagcucuacccugacacucuccaaggcugauuacgagaaacauaagguuuaugccugugaagugacccaccaggggcugagcucuccugucacgaaauccuucaacagaggagagugc

SEQ ID NO: 43346 - RNA, 648 nt, Artificial Sequence
  derived and/or modified sequence opt5 from anti-influenza_Chain
cagagcgugcugacccaacccccuuccgccucuggcagcagagggcaguccaucacaauuucuugcacgggaagcaccuccgacaucggcucuuacaacuaugucagcugguaccagcagcacccggggacagcucccaagguuauucucuaugaggugucccaacggccuagcggagugcccgaucgcuucucuggcuccaaaagcgggaauaccgccuuucugacagucucuggacuucagaccgacgaugaagcggacuacuauugugcuuccuacgccggcaacaauaucuauguguucggcagcgggacaaagguuaccgugcugggacagccuaaagccaaccccacggucacccucuuuccuccgucuuccgaggaacugcaggcuaauaaggccacacuugugugccugauuagcgauuucuaccccggcgcuguuaccguggccuggaaagcggacuccucuccugucaaggccgggguggagacaaccacgcccagcaagcaauccaacaauaaauacgcugccagcucuuaucucucccugacaccugaacaguggaaaagccauaagucuuacagcugucaggugacccacgagggauccacagucgagaagaccguugcucccaccgaaugcucu

SEQ ID NO: 43347 - RNA, 651 nt, Artificial Sequence
  derived and/or modified sequence opt5 from anti-influenza_Chain
cagcccgugcugacccaaccuccgagcgccuccggcucucccgggcagagagucacaaucagcugcuccggaucuagcuccaacauuggcucuuacacgguuaauugguaucagcagcucccugggaccgcucccaagcugcuuaucuacagccugaaccaacggccuuccggagugcccgaccgcuucagcggcucuaaauccgggacaagcgccucucucgcgauuuccggacugcagagcgaggaugaagcuguguauuacugugccgccugggacgauucucuuuccgcucacgucguguuuggcggcgggaccaagcugacaguucucggacagccuaaagccgcuccgagcgugacccuguuucccccuuccucugaggaacugcaggccaauaaggcgacacucgucugccugaucagcgacuucuaucccggcgccgugaccguugcuuggaaagccgauuccagcccugugaaggcuggggucgagacgaccacacccucuaagcaauccaacaauaaauacgccgcgagcucuuaucuuagccugaccccggaacaguggaagucccauagaucuuacagcugucaggugacacacgagggauccaccguggagaaaacggucgccccuacagaaugcagc

SEQ ID NO: 43348 - RNA, 651 nt, Artificial Sequence
  derived and/or modified sequence opt5 from anti-influenza_Chain
cagcccgugcugacccaaccuccgagcgccuccggcacacccgggcagagagucacgaucucuugcagcggauccucuagcaacauuggcuccaauaccguuucuugguaccaacaggugccugggacagcucccaagcuccugaucuauggaaacaaugagcggccuagcggcgugcccgaccgcuucuccgggagcaaaucugccaccuccgcgagccuugcuauuucuggacugcaguccgaagaugaggccgacuacuauugugccgcuugggaugacagccucaacggcuuuugggucuucggcgggggaacaaagcugaccgugcuuggccagccuaaagccgcuccgucuguuacacuguuucccccuuccagcgaggaacuccaggccaauaaggcgacccuggugugccugaucuccgauuucuaccccggggccgucacgguggcuuggaaagccgacucuagcccuguuaaggcuggaguggaaaccacaacccccuccaagcagagcaacaauaaauaugccgcgucuuccuaccucagccugacaccggagcaauggaagucucacaaaagcuauuccugucaggucacccaugagggcucuacgguggaaaagacaguggccccuaccgagugcagc

SEQ ID NO: 43349 - RNA, 651 nt, Artificial Sequence
  derived and/or modified sequence opt5 from anti-influenza_Chain
agcuacgugcugacccagcccccuuccgucucuggcacaccggggcaaagaguuaucauuagcugcuccggauauucuagcaacaucggcuccaauacggugaacugguaccagcaguuccccgggaccgccccucggcuccugauuuaugcuaauaaccagagacccccuggagugcccgaccgcuuuucuggcagcaaguccgggacaagcgccucucuugcgaucuccggacugcaaagcgaugacgagucugauuacuauugugcugccugggacgauucccucaauggccacugggucuucggcgggggaaccaaacugacagugcuuggccagccuaaggccgcuccgagcguuacccuguuucccccuucuuccgaggaacuccaggccaacaaagcuacacuggugugccugauuagcgacuucuaccccggggccgucaccguggcguggaaggccgauuccucuccuguuaaagcuggaguggaaacgaccacacccagcaagcaguccaauaacaaguaugccgcuagcucuuaccucucccugaccccggagcaauggaaaagccaucggucuuacagcugucaggucacacacgaaggcuccaccguggagaagacgguggccccuacagagugcucu

SEQ ID NO: 43350 - RNA, 654 nt, Artificial Sequence
  derived and/or modified sequence opt5 from anti-influenza_Chain
agcuacgugcugacccagcccccuuccgucucuguugccccgggccaaacagcuagaaucacgugcgggggaaacaauauuggcagcaaguccgugcacugguaucagcagaaacccgggcaggccccugugcucgucguguacgacgauucugaccggcccagcggaaucccugagcgcuucuccggcucuaacagcgggaauaccgcgacacugaccauuuccagaguugaagcuggagaugaggccgacuauuacugucaagugugggauucuagcuccgaccaugccgucuuuggcggcgggacacagcuuaccgugcugggagcugccgcuggccagcccaaggccgcgccuagcguuacacucuucccgcccucuuccgaggaacugcaggccaacaaagcuacccuugugugccugaucagcgauuuuuauccuggggccgucacgguggcuuggaaggccgacucuucccccgugaaagcgggagucgaaaccacaaccccuagcaagcaauccaauaacaaguacgccgcuucuagcuaucucucccugacacccgagcaguggaaaagccaccggucuuacuccugucagguuacccaugagggcagcacgguggaaaagacaguggccccgaccgagugcucu

SEQ ID NO: 43351 - RNA, 654 nt, Artificial Sequence
  derived and/or modified sequence opt5 from anti-influenza_Chain
cagagcguggucacccaacccccuuccguuucuguggccccgggccagacagcuagaaucacgugcgggggaaacaauauuggcagcaaguccgugcacugguaccagcagaaacccgggcaagccccuguccuggugguuuaugacgauucugaccggcccagcggaaucccugagcgcuucuccggcucuaacagcgggaauaccgcgacacucaccauuuccagaguggaagcuggagaugaggccgacuacuauugucaggucugggauagcagcuccgaccauuacguguuuggcacaggcaccaagguuacagugcugggggccgcugccggacagcccaaagcugccccuagcgucacccuuuucccgcccucuuccgaagaacugcaggcgaacaaggccacgcucgugugccugaucagcgauuuuuauccuggcgcugugaccgucgccuggaaagcugacucuucccccguuaaggccgggguggaaacaaccacaccuagcaagcaauccaauaacaaauacgcggccucuagcuaucuuucccugacccccgagcaguggaagucucaccggucuuacuccugucaggugacgcaugagggaagcacagucgagaaaaccguggcuccgacagagugcucu

SEQ ID NO: 43352 - RNA, 654 nt, Artificial Sequence
  derived and/or modified sequence opt5 from anti-influenza_Chain
cugagcagaaucaaccacuucgagaagauucagaucauucccaaauccucuuggagcgaccaugaagccuccucuggcgugagcuccgcuugcccuuaccaagggaccccgagcuuuuuccggaaugucguuuggcucaucaagaaaaacaauacauaucccacgauuaagcgcucuuacaacaauaccaaccaggaggaucugcuuauccuguggggaauccaccauuccaaugacgccgcggaacagacaaaacucuaucagaacccuaccacauacauuagcgugggcaccucuacacugaaucaaagacuugugcccaagaucgcuacccgguccaaggucaacgggcagaauggacgcauggacuuuuucuggacgauucugaaaccuaacgaugccaucaauuuugagagcaacggcaauuucauugcccccgaauaugcuuacaagaucgugaaaaagggggauucugccauuguuaaauccgagguggaguauggaaacuguaacaccaagugccagacaccuaucggcgcuaucaauagcucuaugccguuucacaacauucauccccucaccaucggcgaauguccuaaguacgucaaauccaauaagcuggugcuggccacagggcucagaaacagcccccug

SEQ ID NO: 43353 - RNA, 657 nt, Artificial Sequence
  derived and/or modified sequence opt5 from anti-influenza_Chain
agcuccgagcugacccagcccccuucugccagcggcacaccggggcaaagagugacgaucuccugcucuggaagcaccuccaacauuggcuacaaucccgucucuugguaucagcagguuccugggacagcucccaaacuccugaucuacagcaacaccgaacggccuuccggagugcccgaccgcuucagcggcucuaaauccgggacaagcgccucucuugcgauuuccggacugcagagcgaggaugaagcugacuauuacugugccgccugggaugacacccucaauggcccuguguuuggcgggggaacaaaggucaccgugcugggccaaagaacgguugcugccccgucuguguucaucuuucccccuuccgaugagcagcuuaaaagcgggaccgcuuccgucgugugccugcucaacaauuucuauccccgggaagccaagguucaguggaaaguggacaacgcgcugcagucuggaaauagccaagaguccgucacagagcaggauagcaaggacucuaccuacucccugagcucuacacucacccugagcaaggccgauuaugaaaaacacaagguguacgcuugugaggugacgcaucagggccuuuccucuccugucacaaagagcuuuaaccgcggggaaugc

SEQ ID NO: 43354 - RNA, 657 nt, Artificial Sequence; identical to SEQ ID NO: 39234
  derived and/or modified sequence opt5 from anti-influenza_Chain

SEQ ID NO: 43355 - RNA, 660 nt, Artificial Sequence
  derived and/or modified sequence opt5 from anti-influenza_Chain
agcuacgugcugacccagcccccuuccgccucuggcacaccggggcaaagagucacgaucagcugcuccggaucuaccuucaacauuggcagcaaugcuguugacugguaucggcagcuccccgggacagccccuaagcugcuuaucuacuccaacaaucagcgccccucuggagugccugauagauuuagcggcucccggagcgggaccucugcgucccuggcuauuagcggacuccagucugaggacgaagccgauuauuacugugccgcuugggacgauauccugaacgugcccgucuucggcggcgggacaaaacuuaccgugcugggagccgcugccggccaaccuaaggcggccccguccguuacacucuuucccccuagcucugaggaacugcaggcuaauaaagccacccuggugugccucauuuccgacuucuaucccggggcugucacgguggccuggaaggcggauagcuccccuguuaaagccggaguggagaccacaacccccucuaagcagagcaacaauaaguacgcugccuccagcuaucugucucuuacaccggaacaguggaaaucccaccgcagcuacucuugucaagucacccaugagggcagcacgguggagaagacaguggcuccuaccgaaugcucc

SEQ ID NO: 43356 - RNA, 660 nt, Artificial Sequence
  derived and/or modified sequence opt5 from anti-influenza_Chain
cagagcgcccugacccaacccgcugccguguccggcucuccugggcagagcaucacaauuuccugcacgggaaccucuagcgacgucggcggguacaacuauguuuccugguaccagcagcacccgggaaaggcgcccaaacucaugaucuaugaggugucuaauagaccuagcggcguguccaaccgguucagcgggucuaaguccggaaauacagcuagccugaccauuucuggccuucaagccgaagaugaggccgacuacuauuguuccagcuacacaucuuccagcaccuaugucuuuggcacagggaccaaagugacgguucugggagcugccgcuggccagcccaaggccgcgccuuccgugacccucuuucccccuucuagcgaggaacugcaggccaacaaagcuacacuugucugccugaucuccgauuucuacccgggggccgugaccguugcuuggaaggccgacagcucucccgugaaggcgggagucgaaacaaccacgccuuccaaacagagcaauaacaaguacgccgcuucuagcuaucucucccugacacccgagcaauggaaaucucaucgcagcuacuccugucaggugacccacgagggcagcacaguggaaaagaccgucgccccuaccgagugcucu

SEQ ID NO: 43357 - RNA, 660 nt, Artificial Sequence
  derived and/or modified sequence opt5 from anti-influenza_Chain
agcuacgugcugacccagcccccuuccgucucuggcacaccggggcaaagaguuacgaucagcugcuccggaucucggagcaacgugggcgacaauuccguguauugguaccagcacguccccgagauggccccuaagcuccugguguauaaaaacacccagcgccccucugggguuccugcuagauucagcggauccaagagcggcacaucugccucccuugcgauuaucgggcugcagagcggagaugaagcugacuacuauuguguggccugggaugacucugucgauggcuacguguuuggcuccgggaccaaaguuacagugcucggagccgcugccggccaacccaaggcugccccuagcgucacccuguucccgcccucuuccgaggaacuucaggcgaauaaagccacacuggugugccucauuagcgacuuuuauccuggggcugugaccgucgccuggaaggcugauuccucucccguuaaggccggaguggagacgaccacaccuagcaaacaguccaacaauaaguacgcggccagcucuuaccugucccugacccccgaacaguggaaaagccaucggucuuauagcugucaagugacacacgagggcuccaccgucgagaagacgguggcuccgacagaaugcucu

SEQ ID NO: 43358 - RNA, 660 nt, Artificial Sequence
  derived and/or modified sequence opt5 from anti-influenza_Chain
agcuacgugcugacccagcccccuuccgccucuggcacaccggggcaaagagucacgaucagcugcuccggaucuagcuccaacauuggcucuaauuauguuuacugguaucagcagcuccccgggaccgcuccuaagcugcuuaucuaccgggacggacagcgccccagcggcgugccugauagauucuccgggagcaaaucuggaacauccgccagccuggcgauuucuggccuccgguccgacgaugaggcugacuauuacugugccaccugggaugacaaccugagcggccccguguuugggggaggcacaaaacuuaccguccugggggccgcugccggacaaccuaaggcugccccgucugugacacucuuucccccuuccagcgaggaacugcaggcgaauaaggccacccugguuugccucaucuccgauuucuaucccggcgcugugacggucgccuggaaagcugacucuagcccugugaaggccgggguugaaaccacaacccccuccaagcagagcaacaauaaauacgcggccucuuccuaccugagccuuacaccggagcaguggaagucucaccgcagcuauuccugucaagugacccaugaaggaucuacggucgagaaaacaguggcuccuaccgagugcagc

SEQ ID NO: 43359 - RNA, 660 nt, Artificial Sequence
  derived and/or modified sequence opt5 from anti-influenza_Chain
cagagcgcccugacccaacccgcuuccgugucuggcagcccugggcaguccaucacaauuucuugcacgggaaccagcuccgacgucggcggguacaacuauguuucuugguaccagcagcacccgggaaaggcccccaaacucaugaucuaugaggugagcaauagaccuuccggcgugagcaaccgguucucuggguccaagagcggaaauacagcgucucugaccauuuccggccuucaagcugaagaugaggccgacuacuauuguagcucuuacacauccagcuccacccuggucuuuggcacagggaccaaagugacgguucucggagccgcugccggccagcccaaggcugccccuucugugacccuguuucccccuagcuccgaggaacuucaggcgaacaaagccacacuggucugccucaucagcgauuucuauccgggggcugugaccguugccuggaaggcugacucuucccccgugaaggccggagucgaaacaaccacgccuagcaaacagucuaauaacaaguacgcggccagcuccuaccugucucugacacccgagcaauggaaaagccaucgcuccuauagcugucaggugacccacgagggcucuacaguggaaaagaccgucgcuccuaccgagugcucc

SEQ ID NO: 43360 - RNA, 660 nt, Artificial Sequence
  derived and/or modified sequence opt5 from anti-influenza_Chain
accgugcugacacagcccccuagcgucuccggcgccccggggcaaagaguuacgaucucuugcaccggaagcuccucuaacauuggcgcuggguacgacgugcacugguaucagcagcuccccggaacagccccuaagcugcuuaucuacggcaauagcaaccggcccuccggggugccugaucgcuucucuggaagcaaauccggcaccagcgcgacacugggcauuaccgggcuccagacaggagacgaggcugauuauuacuguggcaccugggacucuucccugagcgccuaugucuuugggacgggaaccaaggugacaguucuuggcgccgcugccgggcaacccaaagcugccccuucugugacccuguucccgcccuccagcgaggaacuccaggcgaauaaggccacacuggucugccugaucucugauuuuuacccuggagcugugaccguugccuggaaagcugacuccagccccgugaaggccggcgucgaaacgacaaccccuuccaagcagucuaacaauaaauaugcggccagcuccuaccucagccugacacccgagcaguggaagucucauagauccuacagcugucaagugacccacgaaggcucuaccguggagaaaacagucgcuccgacggagugcagc

SEQ ID NO: 43361 - RNA, 663 nt, Artificial Sequence
  derived and/or modified sequence opt5 from anti-influenza_Chain
cagagcgugcugacccaacccccuuccgucucugccgcuccgggccagaagguuacaaucagcugcuccgggucuagcuccaacauuggaaaugacuacgugucuugguaucagcagcuccccggcacggccccuaaacugcuuaucuacgauaacaauaagagacccagcgggauuccugaccgguucuccggaagcaaaucuggcaccuccgcgacacuggggaucaccggacuccaaacaggcgaugaggcuaacuauuacugugccaccugggaccgcagacccacagccuauguggucuuuggcgggggaaccaagcugacggugcuuggcgcugccgcugggcagccuaaagccgcgccgagcguuacccuguuucccccuucuuccgaggaacuccaggccaauaaggcuacacuggugugccugauuagcgauuucuaccccggagccgucaccguggcuuggaaggccgacucuuccccuguuaaagcgggcguggaaacaaccacgcccagcaagcaguccaacaauaaauaugccgcuucuagcuaccucucccugacaccggagcaauggaaaagccaccggucuuacuccugucaggucacccaugaagggagcacaguggagaagaccguggccccuaccgagugcucu

SEQ ID NO: 43362 - RNA, 675 nt, Artificial Sequence
  derived and/or modified sequence opt5 from anti-influenza_Chain
auggugggcuucacccccgucgcccuggcugcccucgcggcuacaggggcccuggccuuuccugcuggaaacgccacggagcuugaaaagagacagaccacaccgaauagcgagggcuggcacgacggguacuauuacuccugguggucugauggaggcgcucaagccaccuauacaaaccuggaagggggaaccuacgagaucagcuggggcgacggcgggaaucucguuggaggcaaaggguggaaccccggacugaaugcgcgggccauucauuucgaaggcguguaucagccuaacggaaauuccuaccuugcuguguauggguggacacgcaacccccuggucgaguacuacaucguggagaauuuuggcaccuaugauccuucuagcggcgccacggaccucgggaccguugaaugcgauggauccauuuacagacugggcaagacaacccgggugaacgcucccucuaucgacgggacacagaccuucgaucaguauuggagcguccgccaagacaaaagaacguccggaacagugcagaccggcugucacuuugaugccugggcgcgggccgggcugaauguuaacggagaccauuacuaucagauuguggcuacagagggcuacuucagcucuggcuaugcccgcaucaccgucgcugaugugggg

SEQ ID NO: 43363 - RNA, 687 nt, Artificial Sequence
  derived and/or modified sequence opt5 from anti-influenza_Chain
agaagcgacaagacccacacaugucccccuugcccggcccccgagcugcucggcgggccuuccguguuccuguuucccccuaaacccaaggauacgcuuaugaucucucggaccccugaagucacaugcguugugguggacgucagccaugaggauccggaagugaaauucaacugguacguugacggaguggagguccacaaugcuaagaccaaaccccgcgaagaacaguauaacuccacauacagagugguuucugugcugaccguccuccaucaagauuggcugaauggcaaggaguauaaguguaaagugagcaacaaggcccuuccugcgcccauugagaaaacaaucuccaaggcuaaagggcagccucgggagccccagguguacacccugccgccuucucgcgaagagaugacgaagaaucaggucagccugaccugccucguuaagggauuuuaucccuccgacauugccguggagugggaaagcaacggccaaccugagaauaacuacaaaacaaccccucccgugcuggauucugacggguccuucuuucucuauagcaagcugacagucgauaaaucuagauggcagcagggaaauguguucuccuguagcguuaugcacgaagcccuucauaaccacuacacccagaagucucugucccucagccccggcaaa

SEQ ID NO: 43364 - RNA, 696 nt, Artificial Sequence
  derived and/or modified sequence opt5 from anti-influenza_Chain
cacgcccaggacauccuggagaagacccauaacggcaaacucugcgaucuggacggggugaagccccuuauucugagagauuguagcgucgcuggauggcuccugggcaauccuaugugcgacgaguucaucaacguuccggaaugguccuacauuguggaaaaagccaaucccgcgaacgaucuuuguuauccugggaauuuuaacgacuacgaggaacugaagcaccuccugucucggaucaaucauuucgagaaaauucaaaucauccccaagagcuccuggucugaucacgaggcuagcuccggagugucuagcgccugcccuuaucagggcacacccuccuuuuuccgcaacgucguguggcugauuaagaaaaauaacacguacccuaccaucaagagaagcuauaauaacacaaaucaggaagaccuccugauucuuugggggauccaucacucuaacgaugccgcugagcagaccaaacuguaccaaaauccgacaaccuauauuuccguuggaacaagcacccucaaccagcggcuggugcccaagaucgccacgcgcucuaaagucaacggccagaauggcagaauggacuuuuucuggaccauucuuaagccuaacgaugcuaucaauuuugaauccaacgggaauuucaucgcccccgaguacgcguacaagauugugaaaaag

SEQ ID NO: 43365 - RNA, 699 nt, Artificial Sequence
  derived and/or modified sequence opt5 from anti-influenza_Chain
augagacccagcauccaguuccugggccuccugcuguuuuggcugcacgggggacaaugcgacauucagaugacccaguccccuucuagccucuccgccucucugggcgggaacgugacaaucacguguaaagcuagccaggauauuaauaaauacaucgccugguaucaacauaagccgggaaaaggcccccggcuugucauucacuacaccuccacacugcagccugggauccccucucgcuucagcggauccggcagcggcaccgacuauucuuuuuccaucagcaaccucgagccugaagauauugcgacauacuauugccugcaguacgacauccuguauaccuucgggggaggcacaaagcucgagauuaaaagagcugaugccgcccccaccguuucuaucuuuccuccguccagcgaacagcugacgucugggggagcuuccgugguguguuuccuuaauaacuuuuaccccaaggacauuaaugucaaguggaaaaucgauggcagcgagcggcaaaacggggugcuuaauuccuggaccgaccaggauucuaaggacagcacauacuccaugagcucuacccucacacugaccaaagaugaauaugagcgccauaacuccuacacgugcgaggccacacacaagaccagcacaucuccuauuguuaagagcuucaauagaaacgaaugu

SEQ ID NO: 43366 - RNA, 702 nt, Artificial Sequence
  derived and/or modified sequence opt5 from anti-influenza_Chain
augaugagcuccgcccaguuccugggccuccugcuucugugcuuucaagggaccagaugugacauccagaugacacagacgucuagcucccucucugcuagccugggagaucgggugaccauuuccugccgcgccucucaggacaucagaaacuaccuuaauugguaucaacagaagcccgauggcacagucaaacugcucauuuacuauaccagccggcugcacuccgggguuccuagccgcuucucugacuccggaagcggcacagauuacucucugaccaucuccaaccucgagcaggaagaccuggcgacauauuuuugucagcaaaccuacacgcuuccguggaccuucgggggaggcacaaagcuggagauuaaaagagcugaugccgcccccaccgugagcaucuuuccucccucuuccgaacagcucacaagcggcggggcuuccguggucugcuuccugaauaacuuuuauccuaaggacaucaaugugaaauggaagauugauggaucugagcggcagaacggcguucuuaauagcuggaccgaccaggauuccaaggacagcacguacucuauguccagcacacugacccucacaaaagaugaauacgagcgccauaacucuuauaccugugaggccacccacaagacaagcacgucccccaucgugaaaucuuucaauagaaacgaaugc

SEQ ID NO: 43367 - RNA, 702 nt, Artificial Sequence
  derived and/or modified sequence opt5 from anti-influenza_Chain
auggaggcccccgcucagcuccuguuccugcuucugcucuggcugccugacaccacaggcgaaaucgugcuuacgcaaagcccggccacccugucccucucucccggggagagagcgacacugagcugccgggcuuccgaaaacauuuggaauaaccuggccugguaccagcagaagccuggacaggcuccccgccuccugaucucuggcgccagcaccggggccacaggagucccuuccagauuucggggcucugggagccgcaccgaguucacacuuaccauuuccagccugcaaucugaagauuuugcuaucuauuucugucagcaguacaauuccuggcccagaacguuuggaccuggcaccaaaguugagauuaagcggacaguggccgcgccgagcguguucaucuuucccccuucugacgagcagcucaaauccggcaccgccagcgucgugugccugcuuaacaauuucuauccccgcgaagcuaagguucaauggaaaguggauaacgcccugcagucuggaaauucccaggagagcgucacagaacaggacuccaaggauucuaccuacagccucuccagcacgcugacacugucuaaggcugacuaugagaaacacaagguguacgccugugagguuacccaucaagggcucuccagcccugugacaaaaucuuuuaacagaggcgaaugc

SEQ ID NO: 43368 - RNA, 705 nt, Artificial Sequence
  derived and/or modified sequence opt5 from anti-influenza_Chain
auggagacccccgcccagcuccuguuccugcuucugcucuggcugccugacacaacgggcgaaaucgugcuuacccaaagcccggggacacugucccucucucccggagagagagcuacccugagcugccgggccucccagucucugagcuccucuagccucgucugguaccagcagaagccuggccaagcgccccgccugcuuauuuauggggcuuccagcagagccacaggaaucccugaucgguuuucuggcuccgggagcggaaccgacuucacacugaccauuucucgccucgaacccgaggauuuugccguuuacuauugucagcaguacggcaacuccccuuauacguucggccaggggacccaaguggaaaucaaaagaacaguggcugccccgagcgucuuuauuuuucccccuucugacgagcagcugaaguccggaaccgcuagcgugguuugccuucugaauaacuucuacccccgggaggccaaagugcaguggaaggucgauaaugcgcuccaguccggcaacucucaagaaagcgugacagagcaggacuccaaagauagcaccuauucucuguccagcacgcugacacucucuaaggccgacuacgaaaagcacaaaguuuacgcuugugaggugacccaucaggggcugagcuccccugucacaaagucuuucaaucgcggagagugc

SEQ ID NO: 43369 - RNA, 705 nt, Artificial Sequence
  derived and/or modified sequence opt5 from anti-influenza_Chain
auggagacccccgcccagcuccuguuccugcuucugcucuggcugccugacacaacgggcgaaaccgugcuuacacaaagcccggggacccugucccucucucccggagagagagcuacacugagcugccgggccucccagucugucagcaucuccuaccuggcgugguaucagcgcaaaccuggccaggcucccagacuccugauuuacggggccucucggcgcgccaccggaaucccugauagauuuagcggcuccgggagcggaacagacuucacccuuacgauuucucggcuggaacccgaggauuuugcuguuuauuacugucaacaguauggcuccagcccuuacaccuucggccaggggacaaaacucgaaaucaagcgcaccguggccgcuccgucuguguuuauuuuucccccuuccgacgagcagcugaaaagcggaacagccucugucgugugccuucugaacaauuucuaucccagagaggcgaagguucaauggaaaguggauaacgcccuccaguccggcaauagccaggaauccgucaccgagcaggacucuaaggauagcacguacucccugagcucuacacugacccucuccaaggcugacuacgaaaaacacaagguguaugccugugagguuacacaucaagggcugagcucuccugugaccaagagcuucaaccggggagagugc

SEQ ID NO: 43370 - RNA, 705 nt, Artificial Sequence
  derived and/or modified sequence opt5 from anti-influenza_Chain
auggccuggaugaugcugcuccugacccuucugauccacugcacaggcagcugggcucaguccgugcucacgcaacccccuucugucagcgccgcgccggggcagaagguuaccauuuccuguucuggaagcuccucuaacaucggcaaaaauuacgugagcugguaucagcagcugcccgggacagcuccuaaacuucugauuuacgacaacgauaagagacccuccggaaucccugaccgguucagcggcucuaaguccgggaccagcgccacacucggaauuaccggccugcaaacaggcgaugaggccgacuaucauugcggggcuugggauucuucccugaauggaggcguguuugggggaggcaccaaagucacggugcucgggcagcccaaggccgcuccuagcguuacccuguucccgcccucuuccgaggaacuucaggccaacaaggcgacacuggugugucucaucagcgacuuuuacccuggagccgucaccguggcuuggaaagccgauuccucucccguuaaggcuggcguggaaacaaccacgccuagcaaacaguccaauaacaaguaugccgcgagcucuuaccugucccuuacacccgagcaauggaaaagccaccgcucuuauagcugccaggucacccaugaaggcuccacaguggagaagaccguggccccgaccgaguguucu

SEQ ID NO: 43371 - RNA, 714 nt, Artificial Sequence
  derived and/or modified sequence opt5 from anti-influenza_Chain
augaugaagaaaaagagcugguucacccugaugaucacaggcgugauuucccucuuuuucucugucagcgccuuugcugggaacguuuucugggagccccuguccuacuuuaauucuagcacguggcagaaagccgacggauauuccaacggccaaauguucaauugcaccuggagagcgaacaaugugaacuuuacaaaugaugggaaacuuaagcugucucucaccagcccugcuaacaauaaguucgacuguggagaauaccgguccacaaacaauuauggcuacgggcuguaugaggugagcaugaagccggccaaaaacaccggaaucgucucuuccuuuuucacauacaccggccccagccacggcacgcagugggaugaaauugacaucgaguuucuugggaaggauaccacaaaagugcaguucaauuauuacaccaacggaguuggcgggcaugaaaagauuaucaaucugggauuugacgccucuacauccuuccacaccuacgcuuucgauuggcagccuggcuauaucaaaugguacguggacgggguccucaagcauacggccacaaccaacauucccagcacaccuggaaagaucaugaugaaccuguggaauggcaccggcguggauucuuggcugggguccuauaacggagcuaauccccucuacgccgaguaugacuggguuaaauacaccagcaac
